United States Patent 12,227,810 (METHODS AND COMPOSITIONS FOR DETECTING ESOPHAGEAL NEOPLASIAS AND/OR METAPLASIAS IN THE ESOPHAGUS) - sequence listing, part 2

SEQ ID NO: 6038 - DNA, 2168 bp, synthetic construct
  misc_feature 1..2168: note = Description of Artificial Sequence: Synthetic polynucleotide
  source 1..2168: mol_type = other DNA
tygygttgtagttaggtagagtttyggggtagttygtttatygyggaggagttattttggagttttaygttttttttatattttatttatggattggaaaggatgtttagttattygygagtttgtttgatattgggatggaaagttatagttygtaggttggagtgaggygygggaagatgtttggtttttgtttygyggatttggtagtygygttttgygggtttgtttattgaattgttgaggattygttygtgtgyggggattygagtgttatttttyggagygttattttgygttttagtttttaggttagataatatttggaaggtagggtagggttgttttygtttttattttttgyggaaggatggtaggattyggygtagygaygtagtagygggagggtatagygatttgtatttttagtttttttttaggatataaggttgattttatttttyggatagttgtaaagtttttgttagaattaaatygaattygygtttyggagaggggtttttggggtygtttygttgtagggygtggggagtggagagagggaaggggaagtttggggttgggtgtgygygygtgggagygygtttyggagygtttygtatttttttattttattttygggggtagtttgggaaggagggagtggtagtygygggaatgagggagtaagagaaatttttttaaagtgaygttttaaataggttyggatttagaattygaagttaaaggttgttagaaattgggatttttyggttttttttgtagttttttttttttygtttygaagttygggyggtttgttggttgtttgttttttygttttyggtttagaggtttttggttggygggygtttygtyggtygtyggttttttttttgaaattygtyggygtatatgaggtygttgttttygtygtaggygttggyggttttttygyggtgttygtggtgatgttatgtttygttattaygygggaggagaggagggyggygtygtygggttttgggtgaagagyggygtagyggyggyggyggygggyggggggygtttgggtagyggtatgaaggatgtggagttyggtyggggtagggtgttgttgaattyggtagtygttaggggygayggtttgttattgttgggtattygygyggttaygttyggtggyggyggyggtggtttgagggagagtygtyggggtaagtagggggttyggatgagtttgttggggaagtygtttttttataygagtagttagagttgtyggygtaaygttaagtatyggygggtgtagaattatttgtataaygtgttggagagatttygyggttgggygtttatttattaygttttygtgtgagtattygygttttttgttatgttygttgtaggggattattgtttttggttttttggggygtgtttygygttygygtttttgggttttygygygygtgtataygtggtggtttttattttttygtaygtgttygtggttttttttttggagtttttttttttttttagttttattttttttatttttatagtttgaatttttttttygaggatatttaatgaattgttyggtagttttaggttttyggggygagagttaggtagaygygggatttaggttgygyggataattgggagtaattaggttttaagataygtaaattttaatygaayggggygttygggagttagggaatgtaaagggaggataggygttygtgtgaggtttgagagtatattggagaggttaggaggtgatggyggggtaggayggggagaagtgagggggtatygagggttaggtttttagttttaggggyggagtaggggaagttgttatttggagagagttgttaggttttaagygygttyggaaataygtttygttattatttagttattattaayggaaaatttgttagtgtatgtagttttttttgttayggagaaggtggttaaggtttagaggaggttagtaggttaggygaagtaaygttttygygttgtagggggyggggaggtagyggggaatttggggygtaggaaygygggyggaggtgygatagtagaagygtaaatgggtygtttttgatagagatygggtagtgggttaagttttygtttgtggygyg

SEQ ID NO: 6039 - DNA, 2053 bp, synthetic construct
  misc_feature 1..2053: note = Description of Artificial Sequence: Synthetic polynucleotide
  source 1..2053: mol_type = other DNA
tygaygtaygattygtttatayggaataagaattttaygaaggatatttggggattatattggtygtattygagggggygggaggyggaaaaagtatttttaaaygtaattttgttaggttttatttttygtattttttggttttygggatagaagtttttttggtatttttygtttagtttaggggttggttgttygttagaaygaaatattttttattgattayggagagttttgtagggagtygaggttttygttygggttaagggaaggygttggygtygygggagataagaagaggyggaggyggaaaagaagtggagaaggaaggggtggtagagggagtagygtgygggaggyggygtyggygtygggttgttggygaggyggggtggggtggagtggggtgtgttttyggygggyggttagtaagttagttygttygagygtyggygtttyggtttttagygttygttygygatagygatygggattggygtttygttgtttygatygtyggygagtttygtttttttttaggttttttattgggttttttygygagtttygtttggttyggygtggggtygttygttttygttagttygggygttygtygtttygtttygttygygtagtttttgtygtttttttygttygygttgtttttggttttttttygttttagttttatttatgaagygyggttttattaygtgttaatgagtttttgttttgttttggtagyggyggyggtatagatttygtygagggaattgygyggggagggatttgagygtagygttygtagttttaaattttgtttggggygggggattygtygyggygttagttttggggttagaggggataagttttttyggttygygttatttatttttttttttttttttttttttttgtygtygygttttyggaggttttygttgttatgatttygttgtgttttyggatatttttatattttgattaggttaagaaggggttggtgtatgygtygtttaygatttyggggttattaattataygttttygggtagygygtatygttaatatttttygygggggttaygtttggggtagygggttgagtyggaaggggaaggggagygggagtttagaggtygaggygygtygggttygggggtgyggtttygygtttttttttttygygtaaggtygttttygtggtaggyggtagygagttgggttyggggtygggttgagttttgggatygygttgygtagttttygagtygttygttatttggttgyggtygygyggttatttgtttttygttttyggggygtygtttagtttygygttaggygttttttttagygttygtygttttttttyggygagattattygggygygtttygttygtyggttttygatgtaaatagttgggtttygtaggyggttggtttygygtttttyggttyggygygtttttttttyggttattyggggtttygtttttygtattttttygttggaggaggaygttttattttagggtyggattgggggttttgggattygggggyggtagyggygggygtttggggagtygyggtgtgtttagtagtygyggtaggaattaggggatatgttygttaattgtttttattattagtygtygtttgttttttgtgtgtayggattaaattttaattggtttttatatttattatggtgaattgygaatttttaaataagtttgggtygtygtttttgtygaggaggygtttttttttttttygttttyggggttttgtagggtgtgyggyggyggtygtggttatttagatatttttatttttygtgagttggatygggagaggatygtayggtttttatttgayggagttaygttaygtyggttataagggtttygtgttgggygttgggttyggttttyggtygtttttttgtggtygttttggygtttattttatgatattttgtyggtgtttttagatattatttygtatygtttygttttatygatttttaggttttttyg

SEQ ID NO: 6040 - DNA, 1679 bp, synthetic construct
  misc_feature 1..1679: note = Description of Artificial Sequence: Synthetic polynucleotide
  source 1..1679: mol_type = other DNA
gygtttttattgygtgtttagyggyggtggaggyggygtttttttgtattaygaataygyggttygttaaggygtygttttagyggttgatggtttyggtttttttttaaaattttyggygttygatttygtygygtttttttaggtaggaattttgygattttattttttgggttygttattagtttaggtttgyggtgygygggagggtattaagygygaggtttttttygygttttyggttatttygtygattttaggtaagtgggggtagtttaagaagggtaaggagtagttggatygtgttttggatatgagyggagtygttygaggataagggtattttttyggtatygtgggyggtttttyggygggggtyggtagtttggttttttatttyggygtgygtttagtttttaagttygtyggtttagygagggyggyggyggtygtttayggygatttttatygggaggagagtagtagtaagtaaggagtyggtttygttttgggtaggttgttgggygggggtygggygtgygggygtttygggagyggggagaattyggyggygggyggygygggttattattattattattaygygtattattattattattttaagtgtttgttygttggggattygtygtygtygtygtygtttggtttgttttgttttggggttttgygyggtttttttttgtttttygttttttyggaagaggygttygtttttaagtaygtggagygygtttygttygtagtygtygygttgttaggagygygttatgygtagttgttttttgygtyggggttgtttttygagygttgygygttgtygtttttygattygggyggttttaaagtttattygggtggtgagtgtagttatttgttygtygttatgtyggtttttatagtttataayggggagttgttttayggtttatyggttattatygtttattattygtttaaattgtatttyggygggttgttgaagtattyggagtttattttttattttagygggtttgtagyggtygttttaagtttygtygagttggggtygttggttagtatygatygagagatygttatgtataattagtagttgttygagatggttgtygggaagggtygyggaygtttggattyggggaygttgttatyggtygtygyggyggygggaggtatygggggyggyggtagyggaggtagyggygtaggtaagtttaagatyggttatttgtgtttttattgtggtaagttgtattygygtaagtatgggtttaagatttatatgyggaygtataygggttataagttatttaagtgtaaagtttgtttgyggtttttyggygattttagtaattttaataagtatattyggttgtaygtygagggtaataygttttatygttgygagttttgyggtaaggtatttgtgygtygtygggatttggagygatatgttaagtttygttattttggttagagtttgttygttaaagygggygayggttygggtgtygagttyggttatttttyggagtttggggattttaagagygaygatagtgaygtggaygtttgttttatagaygattagagygatttygaggttgggggyggyggggagygygatttgtaaygagttttttygggaaggggyg

SEQ ID NO: 6041 - DNA, 1474 bp, synthetic construct
  misc_feature 1..1474: note = Description of Artificial Sequence: Synthetic polynucleotide
  source 1..1474: mol_type = other DNA
tygtttttaaaggttyggggaaggaggttgygggtgggtggygyggatttygggtttttagttatyggygttttttyggggttttttgatttygttttttaaaggaggagggttygtggtaayggtttttttyggttaggygttttygggaygygggggtgaggagtgagygtygtggtttattttatttttygagyggggayggagtgggygatatygygygttyggttgtaygtaggttttgygyggttygaggyggttttatagggggygaggaggaatttyggagattyggyggagagagtagagayggagtttattaaggggtttgtygtygtagagygygggagtyggtattyggtggggtygagggttyggggaygttggggttgtttgatttgagyggyggtygttgatygttgagggtttttgtggtygtagygtttagattyggggagaagggyggtttttaagggtygggagtttttygagggygyggttagygaggagggatagagggyggygttttyggttgttygggygygtagaataagtagttgtygttagggtygataaagttgtttttygaggggttgagatttaattttygtttttygatttagttaggggagygygaggtygtatataattyggygyggggggaaagtyggttgtagttgygttttttatttttattyggttggtttttggyggggagtttgggtagygtygattaaagttyggagyggtagtttyggggygygggaygyggggtataygggtttagttgttygaygggagttygaygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttygygtttttyggygggyggagttyggygtygyggttaggattttttatttygttttygygatttygttgygggtttgtatattygaggattyggtttgaaaygttygtttatttatttttttgtygtttygttataagattttatttttgtttgggtatgagtggggggyggtagtttygtgggatyggyggtattygtygtttttttttayggggataattygagaagtgyggttygggtagggagagaaattaggagagaaaatgagaaagagaattttygtttttttttaaagttggaygatttattygtatattttttttttgggagattygtttataatttagtataaatagggaatagttyggaaagygygygagttttygttygattgtggygggggaggttgaaygtttggtttataygggtgtaggaygygggggttaggttttttgttgyggaggaagagggggaagaggtygygygggagggatttttgataygyg

SEQ ID NO: 6042 - DNA, 675 bp, synthetic construct
  misc_feature 1..675: note = Description of Artificial Sequence: Synthetic polynucleotide
  source 1..675: mol_type = other DNA
tygyggtgygaagtttyggattygttgggaatygtatagttttyggtatttttggtygtatgtttgttagaggtgggtttygggaaatatattygttgtttttttaataagygtttttygttttttattggtttttyggttttygttttttatygttttttttygtttygtagttttygagtggygttagtaygttygtygggtatgggttttaaatgtttattagygggagtttaggygtttttgttttggagygyggtygggagtaaaatygtaggagtgggagggtagygagttagttggatttygagtygyggagygygttggttttgtttygtttgatgattttagagygygggtttaagygtygtttatgtagtatttttgagtttyggggaaggagagttaatgaaaaaatatttaatygttttygttgyggagagttatgagttgtttggatgttatgtattaagtttatggtttttygtagttttatttygtagtygtttatattttttattattaggtaygtgttttttttggggattttgggaaggagtgygygtttttygtttgyggyggtatggtttgtaygttaaggtttgttgtgttttygygygtttygggygttygattaygatyggygtagtygggatgyggggattgtyggagtyg

SEQ ID NO: 6043 - DNA, 1133 bp, synthetic construct
  misc_feature 1..1133: note = Description of Artificial Sequence: Synthetic polynucleotide
  source 1..1133: mol_type = other DNA
tyggtttygtagtttttygygtttygattttttagattttygggagtttaggggagttaggtgttgggyggtgygttyggtgtygtygygttttttttygttatttttggttttttygttattygggtttttyggtygttttggatgtttyggttgtatttttgttttatgattttagtttttttttttaattttttttttggttttttttttttygagygygygygtatatatatattyggttygttttygyggagtggttttgggagtaygatygattttagtttagtaaatygyggttatgtygtttagatttttygtttygaggtttyggttttygtygtygtygttttygygtygttttttttygtttagatatygtygtttgyggtygtttgggyggtagtttttgyggtttttaaagttggttttttgggagggggyggtagggagtaggatgaaggatttgttgtaggaggaggatttatatatttgggygaagggaggggtagygtygttgttgggaygyggygyggattygtattattgygygtagtagtygttgtagtagtygtyggggatygyggagtygggaygttttygttyggttygygtttygtttttygttttattttygttygtygggtttagtaaygtagggtgtttaggagtygygggttgygtagggaggygggtagyggttttygygygtttttgtygttttyggagtyggygygyggygagygtagggygagygygygtygggyggyggtygygttggggggygtgaggygagyggygyggagagyggtaggggygaaatttygygggttagatgttygagggygyggyggygttgttaggttgtygttgttgtttttgygggtttygagygygttttygtaggyggtattgttygyggygyggygtgtgtatygagygagtgaaggtatgtgtggygggygyggttggagttgtygtygtygtygtygtygtgttagtaggttttaatgtttgttattttttaggaygttggtagtagtagtagttyggagttttygagttttyggtaggtttgygtgttttttttygygatttgattggataaagtgggggttygayggtggtygayg

SEQ ID NO: 6044 - DNA, 1808 bp, synthetic construct
  misc_feature 1..1808: note = Description of Artificial Sequence: Synthetic polynucleotide
  source 1..1808: mol_type = other DNA
gygygtyggygttggggatggggtgggggygttggggtataagggygtaggggygtayggttatygatagtygggtgygtttagtttgaggtygyggagaggagtygaattgggatgggtggggggttttyggttttaatattgtttgttagttttagtgygtttaagttttttygttagagttgtttttttggaggggtttttygtaygtattgttttttttatttttttggttggaatttttyggtygttattgtagtgtttagagatgttgygttgtagattygggattttttaggygttttttttygtttttttgttaaagygtaaygtttgtatttttttagtttttttttttttttttgaaattgaaagttattgaggtygtttagggttgttgttttagtagttttttttttygttttygagttttttttygttttttatagttatttttttttttttttttttttttgttttttttttttttttttttttttgtttttttttttttttttttttatgtggtgttttygggagtttagtttaatattggagygttttttgttygygtaygttagaagtagttyggggttttttygtygttttttggttatggtygttgtgtygayggygttygtttttttgygttttaggggttttygtygttgtagtygtagtygtygtagtttttgagtttaaggggtygtygttgtagtygtygtygtygtygttygttygttyggatttygtttgyggtagttgtygtataatatgttatttgyggtygtttyggyggtttttggaatttyggttygyggygatgttagttattttagygaagtygtygtagtttagtgtttggataatttgaaagtataatagttggtttttttgtttattygttttatttygtttgttattatagtaygtttatyggatgtgagaggagaagtttygttgttygggtattgtttatataygtttaatatttatatatattttaaaaatattaaatataattaataattaaaagaaagaggagaaaggaagggaagtattattgggttattatgtatttgygattgattttttggttttttattattttgaattttatggaatatatyggtagttaaaaygtttttyggggaaggygttagygaagaagtaagtgtagggttttttaygygtttgttttttttygtygygtttatttgtygggtygttttgtttgttyggagtyggtttttaattgtagyggttttttygttttgygtttygtagaggagatgtaggttygggttttgggggtatggayggygttttttatttttgtttttyggygtttttgtttttygtagtattttagtyggtgygaggggygggyggaygyggygttaaggtggttttygttttatggtaattttaggttygygggaaagttyggttttgggttagattygtattygggatttgtgttttttttttgaggatyggataggggtatttagtygaaggtatttgggatttttagaygtaggatgtttttgatygttgagtaaatgataagggaggygyggtygyggtattygtttatttagygtaatygtttygygyggggagatttyggttgggtttttaggttggatttyggtagtygaaygttygttattyggttaggaagttagggagygagygtttgygyggtygtattttygataygtattagyggagttaaagggygygygaggygatggggttygygtgtttgygygtttgtagagttgtyggaygtttttygttyg

SEQ ID NO: 6045 - DNA, 1323 bp, synthetic construct
  misc_feature 1..1323: note = Description of Artificial Sequence: Synthetic polynucleotide
  source 1..1323: mol_type = other DNA
tygaatattygtattgtttatygaagattttygtgttttagttttttttgttttttatttttttygtttatggttttygtttttttaagtygtttttyggaattttttgtygggtyggygggaagygtggatygagygggttttggtygygtttttttyggttaggtttggtttagttygygtagygttygygtagttygttagggggatttyggttygtygggyggtatttgaggagaaagygttygaggggygtggagttagggttttgyggtgtttgtttygggaatattgygagtyggttggagttttttagtygtttyggagaattgggggagtygggtttttggttyggtaatyggtggtttygyggtagttagaggygggttttaygggtgggtgtgttygttttygtaygttagttttttagttygggaagagygtttgtaagygggtattttgtttttaaagatgggttttgtttgygggtgatttgggttttygaagtgtaattttgtggtygggaygyggatyggtyggtttgggtttttgtagagtagattttgtttgygttttttaggaggagtgggtggtaggattggggttttttataggttttggggyggyggygagattggtayggttyggggtygtaggygygtagttaygtttttggaagttygtttyggttttygtttttaattygttttttyggggttttatggygtgaggtttggggttgggatttatttggagtygagtagaaaattttttttttttygttttyggttttttttgttttttttggaygyggtggyggygtygtttgagyggygatttttttttttttgttyggtttgttgygttyggtgtttttygagggtaggygygtttggattttgygttyggatggyggyggttttttgtgagtatyggtagyggygtattttttgtttygaggttttyggtgttttttyggygygggtataggggygtttttatttttygttygtttgtattttttgttattygttttttygtttgatttattygttygyggtggtygttygagttttgggatggggagggagatygyggttgttygyggyggtygagattttygttgaygttttygattttgtygtttttttygttygtttttagaggygttygaygtttygatagtttttggagtgagattaggattgagaatagggagaggygattygatttttagggttyggtgtttaggataggtgaggggaaggaaagggtgttgaygggagtggggaggtgggtgggyggttatygtagtygaaatyg

SEQ ID NO: 6046 - DNA, 1501 bp, synthetic construct
  misc_feature 1..1501: note = Description of Artificial Sequence: Synthetic polynucleotide
  source 1..1501: mol_type = other DNA
tygatagtggtttttyggtttagggaggagagygyggtygygggtttttttttttagtttggaggttgtagtygttygagtyggttygggtgggggyggggtgggggyggygyggagggtayggagattayggyggygttattygggatatttagggtttygaggttttgggyggtttttaygygagatygtaaattatgataataggtagttattygaggttaaataaaaayggagtgggtttttygygygtygtygtttttygygtttttggyggtttttttygaggttttyggyggttttaygagttygtagtagtyggtggygaygtygttttygttttatttttttgygtaagtgygaggttgtyggtagygyggygtaygtttyggtygttttyggttttygygtaaaatttttattttgtttaygtgaagttgtygttgttttagagagggggaaagagttgygggaaaagtyggggagtgaygattgyggyggttgggygygtttttttattttttttttttttttttttttttttgtygtagttyggagttttggttttttttttttttttttttttttyggagtyggttttttttttygtttygtttttttttygtttgtgtaygttatttgttgtggggtggtygaaggggatgttttgtttttattagaggtatagygygaaggggaaatttygatattggaaggaaygagaataaatatttaattayggaygtattgaatygyggttgggatagatatttygggaattygaggyggatygggygaygaggtgagtgatttttttttttaattttygttttagggttttygggggagtttgagttgagagaatttttaaatttttygggaaagtgygygaggtttygtyggggaygtygagygttgggtattgaggaygygtagttggayggtgygtgggygtttgygttttyggggggygtttggaggtygggtgttttaygtttgagggttygggtygttyggatygtagyggtgttttttgttttagaagaygtttttaagttttaagggtttttttygagtttgtttgtttttttyggggtyggygyggagtttgygygtaayggagtttatttagtagtttagygygyggtttttatttgtatttygtttttatttggtagaggygygagtatyggggttttttttatattttttttatgaygtgtattattttttgatgattttttagatggtttaggygygaggatgttgatttagagtttttyggagggttataggygtttgggttttttyggtgtygggtgygtgtgtattttaaaggttygygttttaatttttaggtattgatygggttttttaattgyggygattttattttaatagtttttatgtggygtggattgaatgttttttgtagtttgttagggtyggtgaaattagaggygttttgttagagtagtygygtttattggttygagtagyg

SEQ ID NO: 6047 - DNA, 1744 bp, synthetic construct
  misc_feature 1..1744: note = Description of Artificial Sequence: Synthetic polynucleotide
  source 1..1744: mol_type = other DNA
tyggtgggtygggggygtggygagattttgttttagtggagggagggtttatgtattgtygagaygtygattattagattttgattttgtygtttttagaaaaattattggtagaagattyggattatggttaatttgtyggttataagtttttttaagaagygttaygtttgggtgtagttggtagggtatattggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttataggatttatttagaggaggagttgattaaggttygtgagyggtttaagttgyggaaggatatgtataagaaaatgttggyggtggattttgaagtttttayggaggaggagtaygygtagygygtygttattaagtygygttatatgtagtggygggaaggtattagttttagtattattttyggttttygtatygagggtattaaggtgaggtaggygygtttygttggtatygtygtagttttattgygygttgtttttttygatttttygttttygtttygtttgttttttygtttttttttatygtttygtygttttttgtaattgggaggtatygttgttttaygttgtttttttttttattggygggttyggggtttttgatatttttgttttatatttagaaagyggayggtttttgtagtatygattttaagattaygygaagtygagagtaggtgtttygygtttttgaagagtttgtgtaaggagatgaggaagtgttggtgagagygggattttaaattttgaggtgttggggagtttgaagtygaggattgtttttgttatttggtttagtgttttyggttgtgtttttattatggtttttatygygttggttygtaattgttttaygtttttttttttttgggttaygttgggyggggttttgggttttttttttggyggtatttgttaagtatagygtgggtttyggttttttatygttagtaggggtttatttggygtttagttaatttgttttttttttttattttattttttgtagaggyggtatttgaatygtttgtagtagattygggatattttggaggtattygagttttttaggaggtaygaggtaagyggyggttgttygggtgttygggtygygagggttagggygggaattyggtaagggygtttttgggtagggtygyggtttgayggtgyggggttygtaggtgatyggtagttygtttttttttgtgtaygattattgttatygygtyggygtgtggtttatygatttyggtaagattaygttttttttygatggttagattttggattatyggyggttttgggaggagggtaatygygaggayg

SEQ ID NO: 6048 - DNA, 1801 bp, synthetic construct
  misc_feature 1..1801: note = Description of Artificial Sequence: Synthetic polynucleotide
  source 1..1801: mol_type = other DNA
tygttttygggygataggggtttttttaygtgaatygaygtttygggtttygggygaggygtagggtttagggygtagggygggtttygtaygtagggygggygygygggtatttttgtggttaggygatttyggttygttttttyggagtttagggattttygaggttggygygggttgttygygataaggtgttagtagtttygggttygygaggagtagtttttattygyggttttygagtttagttttgttttttygttattttttagtttttyggtatttatttagggagatagggaggtagagagaagaggagaaagyggtygtgtttgtatttagtttttgtygtagtattygatgagggatagtagggaggttggyggggaggtagagattaaattatgattttatygattayggaaagattattattatttatagtaaaggaggtttygatgygtttattygggtagygattygyggttggtgggygtttttygttttygttttttyggtggttgtggaatttatttygygtygtataygttaggatttttttttttttgattaaggggaggggaaggaataaaagagattttttattttttatatatatatatatatatatatatatatatatatatatatattttttyggtattttattgttggttaaaggatttattttygtaatttttttttygaatattttttttatttgagtagtgtatttttttaaaggtaaagagagataagggaggaaatatagtatttaaggtgattagtygattggatattgttgatggtatatttttttygtttttaattaatygtataaaattygtaatatttygygttttygyggggtttttygygtttttggttyggttttttyggtygtttttagtaggygtttygtttttygygggaattttgggatttggtygagygtttttyggygggtaggatattygttyggttttttgtagtagttgagggyggygagyggatygygtttaggtagygaygygggatttaatttttyggattygyggygyggttttygttttygtttagggygtygyggttatagttgagattttagygtygygtagtygttttygtyggggtatgggyggtygygtttttygtttttttttttttttattttttttttattttgaaaaaaatttatttattggtgtaaagtagatattttgatgttatttatttagtatygtttgttttggaggtagygttttattyggtygtttggaggtgtgggtagygygtygatgggttygggggagyggggttgggyggttyggttttttagyggagtyggtttgttgttattygtttaattttagtatttagtgggygaggagagagggagagyggygaggatgtagaggagggggagggggaggagggagyggtgggyggggagggagygagagtygttyggtagygygtatgygtttygygggtyggygtagtttttygttyggygyggtyggaggggtagttttttagtttttgygygyggtygygagagtttyggtttygtttttttttygggyggttttyggtttygttygatttygygygttygtttgggygyggygtttatygtgyggaggggttyggtygggattttyggtttyggtgaygttygttyggagtttygygggaggttyggagtttygagagtttttttgggtgatagyggtttttygttygggtttttgtaattttattygttygtagttygygygttgttgttttgggttgygyg

SEQ ID NO: 6049 - DNA, 1801 bp, synthetic construct; identical to SEQ ID NO: 6048
  misc_feature 1..1801: note = Description of Artificial Sequence: Synthetic polynucleotide
  source 1..1801: mol_type = other DNA

SEQ ID NO: 6050 - DNA, 1684 bp, synthetic construct
  misc_feature 1..1684: note = Description of Artificial Sequence: Synthetic polynucleotide
  source 1..1684: mol_type = other DNA
gygttgggyggtgagtttagttaggttatttttgygaggatatyggtyggyggyggatagtagtaygyggygtttaggattyggtttttttagagtttaggttattgtagtttttaggggygtttygagtttatttggagggtygygaggtttttaggttggaaggaggaatagggagaaggaggaatagggagatttggggtagtgttataattatagaaaagggagaggygaggttygttgagtttttggtttgggtaataaggtatattgaaaattgggttttttttygattygtatygtgygygttttagaaatgatagttagayggagtagggtttaaggaygttgaaaatttttgaygtgggygygtygggtgygggtagggaygtggaaggattgggttagttataggaattatagygttgyggatygggtgaggggtttyggttygagtttttatttggggygtagaggtgtttttgtaaggggataaagggtatttttyggygygatgggygatttttttagttagaaaatgagagggttagaygaggggaggaatttttttagttatttggttyggtatagygatygttttaagtttagaatygttaagttagttyggggygtttyggttttttygtttygygtttygttygtttttagttygggtttygtygttttygtygtttttgtygttygggtygttttygtyggttttggtttyggtttygtatatyggtagggggygttygagygtagttaaaaggttyggygggaggtyggyggttttagtggyggagygyggttgtyggtgtgyggtygggagygatygtygyggggtaggggygyggygggtatygygtagagygygtagaatagayggayggyggyggggattygayggyggygtttyggtattttttagatttyggttagygtttttttgttagtygtaagtatttagtttyggtttatttygggttttygatggttttygaggtyggggygattttgygygygtygygtyggttgttttgggyggygttgttgtttttggtygygttgtttttygtygttttttyggyggyggttttaggtaygygtygygttygggttttyggygttttttagtttttygygtatttttttgygttygggtttygtygtttygtttagtgttggttaygggtygtgttattagtttgtgygttttygttattygygggtyggggtatttggygttttgtgtgggtggygggagyggggaygtttyggtgttyggggatygtagygygttggygtttaattttgtygtygttygttttggagtygggaggttttagtygtttaagtgtttygggagatttaggtatagyggggaaaaaaggaaaagaaaggygatttttagygtgyggattggggtaatgtttttttttgtttagaatttttygggagygtaggtggttattttatttttttygygtttatttttygygaggtaggatgaygggygtattygggagatyggagggaggtagagtagggttgttttagaaggtygtgggggaaaggttgygagttgtygtagggygtygggtgtttttgygttttagaggagaagygttttagtgttagttyggttttaggyggtaggaggttygygygttyggggggaayg

SEQ ID NO: 6051 - DNA, 6657 bp, synthetic construct
  misc_feature 1..6657: note = Description of Artificial Sequence: Synthetic polynucleotide
  source 1..6657: mol_type = other DNA
tygggttyggttygttttgtttttttgttttttggaggtttgggygttttygygtagggattaagggttggatagtygtaggtaggggtttygtttttggtttttatttttygtgtttagtaatttygggagtaggyggyggtattttttttatgtttyggttttaattayggttttagtttttttaatttygttttgtaggaataagtgtggtagaggttyggggtyggagggygggyggtygtttygygggttggayggagtttttgggttgyggagaggtygttggatttaygttyggataggagtttygygygtttattttyggttyggttattttyggggygygttgtttgyggtttttygygttatttttatttttgtttygggatttttttygggaaagatattyggggagtagtttttttttttttagtagttttttttttttttttttttttgtttttttgayggtgtggggtttttyggtyggaggggygyggygttggtagyggggtttagagtgtygygtttagygygygttgggggtttygggtttygtagtttygtaygyggtyggtttgtgaagyggygygygggggtttagtygggygagggygtttttgagtttggtttggaatttttagtttataygaaagtygtaggttggggaaggggygggtgggagygggagaygttttgggaagtygtgagatygttyggygagggttygggattattagggagygaygggggatttttyggtttagagttygagggygygatttyggattygttgggatttyggaggtatatgaagggagagggaaattygttaaatygaatttttygggaatyggaaggygtygggtygtttttaygttttttttttttttyggtygaaaggyggggggygaygygtaayggggagggaagggagggaggggtyggygattttaggggagggygagtttttggggaygyggggtygttaggggttygaygattttttygttttattttttygtttttaagtgtttygtttttttttygtttygtaaaygygygttttgygggttgtgttttggttttygyggaygygygygtttatagagggtttgatttggggttaatttttaygaggttgtygggygtttgtgagtatagtygtgtttttatttaggggtttattttttagygttattagggtttygatttttagattttyggaygttttttttttaaatygaagtttgggagtttttgggtggtttggggygggggtagggggygagyggggygggttaggaggagggggygaggtygttattyggttttttaygtygttttygyggttggttttaatttttttttyggagttttttttyggttattttttagtttatygaygtgygggtagygatttygtttttygttttttyggtygttttygtygyggttttygttttttttttattttttttygygygtttttttatatgaaattttttattaygtttagaaagaatgtgttataatttyggygttgtygyggtygttattattgygttygygttygagttygagtyggagtyggagtygtygttttttygtttgttyggttagtttygggtttygagygygyggttttygtygtygtygtttygygttygtttygygtttgaygtagtgagygtygtagtttggttttygtyggtttygttgggtttygggtygtaggtygagtttagtygggygggtttygggaggggtyggtagggygggagggggaggagggttgtttggagttagygagttyggaggaggaagaggaggaggaaggaggggaagtygtygtygtygtygtygtgttyggggaatyggggtgygygygttttgttygttygygatagtgtttttagttyggggttygtatttyggtttaggtaagaaggggtttgaggggtagggggttgttyggggtygggggatttttttgtygtygttgygggatyggagggttttygtttttaggggaggtagggaagaggatgttttttggggggggyggyggggggtagygtagggtttttagyggttttygtagttygggttattttatttttggtgttttgatttyggygttygygttagggtygagttttttygttygyggggttttggatgyggygttyggggttygyggttttygggygtttttatttatttatttaggttyggaggygggygtattygaagttagyggtygtygagtttgggtyggataaattttttttttygaygtygyggttggaagggttaggatttyggatttttagggttagggaggygtygyggggatttygaaatttttyggagygygttgagagtaaaaagtyggttgggtagaaagagggggagggggttgggygygttttygagtgygttggggtagtygyggygttttaagttgaattatagaygaatttttttttatttgaaatttggtttyggagtyggaggtggggagggagtgggttgtgggtgtttygatttygtaaagtyggygtgggggggygtagygtttygtttygygtygtttgaattttyggagggggtgttaygggattttygtttttattttagtyggtggttgggttttgtygatygttgyggagttttygggaaggattygttygyggttattaataggygtyggtgattttagtttttttyggttygggaagttggygtggyggggttgggttgggttgggttgtygagtggggygggatttyggggtttagagyggatttttagtttttttggtttttttttygtygtttttttttttttgtygtttgttttttttttatttttttttttygatttyggggtgtyggttttttttygaattttttttttttttaaattgtayggtggttattyggttayggttttgggtygtattygygtaattttagtattattttygatygagtttttygtygygggttgagygygagttttyggggttaggttgtttagggaggagtagggattttttataattygygtttttttttttaatttayggygagygtaatatattygttygtttttgyggttttatttgagggyggggagaggtygttgggggtagtttygggggttgtggagggtaggggggattygygaagtttttggagygtttagggatgtagttygggyggygtgtgtagggaggaagtagygtttyggygttttttttttagygtygttttygygygtttygagggtttaggagggttyggttttttttattttatttggatatttaggtttgagtttgagtggatttgaggatttgggggayggggaatayggagtttttttttttgtttyggtgtttgtagagtttagtttttaggtagygtggggatttttgtttttagggttagygtyggtttygtttttygtttygttaatttygggatttygtygttttttaggttttaattttttagttttatygtygygtttttttttyggttttgggtttgggggaggggtagggggygtggagygyggygttgggtttyggatagatgttttygyggyggyggygtyggygttygggtaatagtaggtygttaatyggygyggttaygggggaggggygattyggtygggatttyggggattyggtygtagtyggayggygtagttttygttyggggtggggggggggggyggtygygaggattygatttttgtygtgtagttyggtttttagttttttgtygtttttttttttagttttaggtttygttttttgttggggttttggttttttaggttgygggatttygttttttayggtttygygygygtatttttattygttttttaagttgatttttgaggtttttygtggattttagatttygagtgatygtagaattgatttttggggttaggtagtatyggttaagggygttttgaagaggttttyggttttagtttgtatttygaggaaatggatttattatgtttgtttttgggaagtagtaggaygttttggygyggttttttygggtaggygtttagtatagygtagggtataygggggatatttgygaaggtaaaggaggtttattttagagtttyggttgtatttggttagtataggtttgggggaatttgttggaaatggggatttagtattttttttggggtttatgtttggtaggyggagtggataggttggggttyggagttyggtggttattttttgtataaggttggttaggttagaagttggagggtagtttattgggattttttaagygtgattaaggaagttttgggggtygattagtttttttttagtggagttgtagttggggagattttatagataggtagggaggagagggtgtttygtttatygtyggtttygttttataggtttaggtttggtatattttaggtttgtagtatttatttggtgggtaaataaggatttgtttttggtttgyggtttggttttgatygtggtttaggtyggggtagagggagaaaggttatagtttaggtgttttaaattatyggtgttttttttgtyggtttttggggttgtgttgggtttttagggtttttgttttttagtatttgtatgaaatygtgggggygtattggttttygttttagtatttttttttaaggttttgtatttttattaygggagttttatttagttagtygaaggaggttataagttttaaattattaaattygggttagtgttgggggtttgggagttaaggtagtttagagtttatttttygattttggtttttggagaattttaggattygggygtgttaggttttgtagtygggttaggtyggtttatataggattgaayggygtygtgggygtttatttatatttttttttyggtttttatatattataggatttattttgatttgttgtttttgaattgagttaatttttttgtatgttygttgaattgtttagttgttggyggygagyggagagygtgtygggggtattgaggtygggaattagaggygggygggggataggaagyggggagggggygtyggyggggaygygygggttgygyggggattggagagggtttttaggygtyggtygttttgygaaygygggtttgtttaggtatygtyggggtttgttyggtttgagygtggagtttygaggtttttgtygggggtttaggttgtttttggggttttgttttygaygygttgtgtagggttagattttgggttttttttgatttagtttttttttttgtaatatgyggaygggggttttygtataggtaggttgttagggtgaaattgagtygaagagtgttttagaattttttgaagtttttatagaggttggggtgaatgaaggaaggaagyggggttagggttgggtagaggaggttyggtttgygttttgygtttttygtttttaggtttttgttttttyggataaggggyggatygaygggaggatttgagaaygttttggttttgtttgaggtggtgggagtygygggtagtttgtttagttaatagttgtygtttttattttttttatttatttatttattttttttattttttagatgtgggyggggagggtyggggayggatygygaggaygttttttgygttttttaggattttttttttttttttagtttttgygygtygtygggagagggaaggagygggttgtygyggggagtygaggagagtagggggttygggaggttagggagagaaggggagggttagaggtttygagtyggattygyggyggaggaagagggggtggaagggagygygtaggygggtgagggagygagggagggagagaaggagggagggagggagggaaggggggygggagggggtagggygagtttgaattttttttyggtygygyggygaggggyggggtygygygygtagatygatgggygaagttggggaggaattttaatttygggagygaagttagagtttgaaggayggyggyggttgygggygtagtttyggaatygaggtygggygggtaggtaagyggygagygyggtygggygttgaatttgggggatttgggattyggattattttyggggagyggygyggttaagtttttygttatttygaatttygggygttttygagtgygtagygtgygtttttagtttttgttgygtttttaggtttggygygygattygagygtagygggtaaagttggaggaatttggyggyggyggagygggygtaggtttagttygataaagttygggggttygggtyggggtygttgtygtagttygtaygttgtttygtgttttygagaggttttttttttagygtttttttttttttygttttttttygtygttygtattttgttyggygttttttagaygyggttttttgttttttttttttyggaaattagggggttgtttttattttttggtygagtygttgatttttttttaggttygtatygttttttttgttgggtygtttttttttygaygttgygagttttttygtttygygyggggatygtttagttaygtayg

SEQ ID NO: 6052 - DNA, 546 bp, synthetic construct
  misc_feature 1..546: note = Description of Artificial Sequence: Synthetic polynucleotide
  source 1..546: mol_type = other DNA
gygggygtttyggttattttattttagygagaagaygaggttgtttgggttttggttttttygggygggggttaggggttygtygattttttttagygtttygggyggyggggttygagaattaaggtggttttygyggttttygtygtygygygttttttttttttttttygyggattttygyggtygtygtttatttygygtatttygttttttggaaatttagtagtyggggggygaatatygyggygtttttatgggaatttggtttygggtttagagygygggtagttggtagagtttggggggygyggyggyggtagtagtaggttggagggygygyggygggggttaaggggatttggtyggygttyggagtyggagtyggagttygagtyggagttggaggygttyggagtygtygaygttaaatttygagtagatggtggygggggyggggygggygggggtaygggggggttttygggttygygttgttaatygtttaagttyggttttttttttttygygatttygtygttttyg

SEQ ID NO: 6053 - DNA, 288 bp, synthetic construct
  misc_feature 1..288: note = Description of Artificial Sequence: Synthetic polynucleotide
  source 1..288: mol_type = other DNA
tygygagaggaagagagttgagtygttgtaattttgggtttgggattgyggggaygggaygggtgggaagyggttaaaggygtagyggtttttggttagagtygtagaggtttgagaygtgggtygygtttyggtttaggagatttygyggtygygttttaatttttagtttttygattgygattgygattygggaaaaygtttaygtttttggaaaggaagttttattatagggagttgattyggtgttagygygtagtaygttttyggttygtagtgygtygygyg

SEQ ID NO: 6054 - DNA, 947 bp, synthetic construct
  misc_feature 1..947: note = Description of Artificial Sequence: Synthetic polynucleotide
  source 1..947: mol_type = other DNA
tygtatttgtttygyggttygtttttttgtatataygttttygagtygggagagttttygtagtatttagagaagagatyggaatataaaggatgaaygaatggggagggggggtttggggggttgggagaaygaaaatattagttgygtttttaatatttaaggaaggaagtggtagyggggayggggagaggatgggaaggggatgttgattgygagttggggygggaygyggtgatgggaggggatygggtygggaatgygggaggygaggggagygaygggatttgtygtttyggyggtygggtagttaatygattygttttttttaggaaggagygaggggagggtggtttagagagaaagygtygygyggtttyggttgttttyggttygggatatttaaatagattaaagaggattyggagtggagttyggagyggatttygtagttygygttygtygygtatttattygygygttygttgttgggttttyggtagtygygttttttgygttggyggagtyggaggagtttgygttgggtyggyggggggygggygtttggggagggyggagagagggttygttygtygggatttttgttyggttygggygttttagagtygygggattggtygtyggaggttgygggaggggttygggttagattttttagaagttttagagagagtygttttttttttttygtgtgattttttgggagtygggttgttgayggtttagygtttagtyggagttttygygygtttttygggatttattygggagatgtyggggtttttygggaagagtgggttgygtttgtttttygyggtygtttygttttttygttgygygggatygtggggtttgagagyggygttttttygyggggtygaattygttatttatagtggagtgtggattgatatygyggttttayg

SEQ ID NO: 6055 - DNA, 1313 bp, synthetic construct
  misc_feature 1..1313: note = Description of Artificial Sequence: Synthetic polynucleotide
  source 1..1313: mol_type = other DNA
tygtgttatayggygttgggttttgtaagttgttgtttgygtagtygttttygtygttgtygttttygggygggtgtattagggttygygtgggyggggyggggtyggggygggatyggggyggggtttgttttttygaygygtyggtttygtttttygtttygtttttttttagyggatygtaatgatttagaagtttaggaattttaygtgaygttatygggggggtgatgtaatgtattttaaatagaatgtattgtaatttttgtttagtttaaygtggtttttttattygggtttygtttttgttttttttatatttgtttggtaagtttttaaaaatayggttyggttatttttggggtttttgtatttagttatttttgttgtatttgtygtaggagttatttygggagtgtatttgtttgtaggggttggttttyggtagtagtygygaggttatttggtttagtgggtaggttatagggtaaggagtagggaagatgygatgtatttttttttggagggtgatttgtgtttgtaaatattttggyggattagagggaagttyggtttygagtgttggtagattgtggaattyggttgtgttttgaggttattttagagatttygygtygygtgagtgtyggagygttyggtggtygtygygtygygygtttggagggatgttaaygtggagtyggygtygagttygttyggygtgygtgygtgtgtgggagygygygagttttttgaygyggggattagttatgaatygggggtgtgtgtttgtttttagagatttggtaaggtgyggagttttttagaagtgyggttaagyggtagyggagayggygagttaggaattttttttygygtttttagttttttagygtggyggyggaattttyggagaaagtttgtaaatttttagygggygyggygaggaygtygggttatttagggggygggtgggygygygygtagggggttygtttttttyggtgyggagttgtagttgttatttttttygtygggttgtyggttgtagygggtgggygygygttyggggaggggaggtygttttyggagggygtttggttttygttttaggygtttygggttggagagyggygaggtttygttygttttagtttattttttyggtygttttttgttttygttgtttttttgttggtatygttattttttttyggtygttgttttaaatgatagtttyggttygagttttggyggygtttaggtaatttttaagatttggyggyggagtttttttttgyggtagattttyg

SEQ ID NO: 6056 - DNA, 848 bp, synthetic construct
  misc_feature 1..848: note = Description of Artificial Sequence: Synthetic polynucleotide
  source 1..848: mol_type = other DNA
tygttttttygtttagttygygatgtttagttaggygyggygygygtttgttyggtattttttyggygygtttttttttttgygtttttagatttygatttagagyggatttygatygyggtaaattatggttttaggtgygtttyggaggtagttgygggaattagttatggtttygggttaatgtttagggataagtatagggatagggatagagatagggattgggattggattttagttttaagagaaagtatttygggtttattygtattttttttttatttttaaataaagttatagaagygattagygygtagttaaagggtttggaggtgaaaaggagggttgggtggggaggagagaaagtgagaagggagagaaaagyggyggttgagtaaagygggagtyggygygggyggtggggtttgattyggaygtygygtattyggtttygtttygygtttagygtttygtttattttttggtygygtttgttttygygtttttttgtttttttttatttattagtagttttgttgataagygagaaaattgataagtgagaaaagtygtttgttagygttygggttggtgtttgggttgttatygygggygyggagggaggggygygygggtatygtygtttgtygggtataygttgggtttygatttyggtygggtatatttattttygtagggtagtygyggttattatygatttgyggagttgygtgggttttyggaatttttattttaataagagttyggtttygygygtaagtaggagggaagggaaatttttattttttyggggttagggtaygtagaagtygygaggtttygyg

SEQ ID NO: 6057 - DNA, 2406 bp, synthetic construct
  misc_feature 1..2406: note = Description of Artificial Sequence: Synthetic polynucleotide
  source 1..2406: mol_type = other DNA
gygtagygttatagtygygattgyggyggyggyggyggygtagggggygggggaggagagaagygtttatttygtttygttgttttygtagtagttttggttttagtttyggygtattagagyggtttttgggaatttttgggtttgttgtttyggyggtygttagttgggagtttattatygttygatggtatygaatygattygtgtagttttataattttagtttaatttygaggagttagygtagatygtttttygtttttagttgyggygaggtaagggttggtagygttyggaygttttygttttgttttttttatgtttaagygyggggaattataygttttyggtgtagaatagaygatyggggttattagggttgggyggtgggagtgggggttgggagtattatttttggttggaygtgtgtttagatttatygtttttggtttttaggattttatttttttttgtatttttaggtgtyggtttttttgtattygttttttayggggttygttyggygaagggtagtygtagtttatatttatttttygtttttaatttttgttttttttgttygtygtagttattygtttggttgggagtaagttttttttttygttgagggtgtagagagygtttagggygttaagagtagaggggttaaagtttaagygttattagttagtygaaggttttgagtttttagggtygyggtygggaygtagggaggttaggaygygaygttygttttatttgtttttttagyggttttttggtygatagygtyggtttgggggagggygygyggtygtagaygtagttttttagtaggtaaagtttygagggtygygagttygagtygttttygaagtagaagagtaggttttgtagtagygygaattatttggtttgttattttgtgttgttygaatttygtttgtttaggtagtttttgygygtgtygtttttgygygttagtagttttagggaygygaygtggttattatttagtyggatttttttttgtatggtgtttagaggttagygagattttaygygtttatatttttttygygtagtagtttttygttygtgygygttgygygttgtttttttttggygttygttygttygttttttttagtttttttttttttttaaatatttatattttaggatttggygtygagtygyggttttttgaatttagatatattatttttygttggaatttttttttygtttygtagagttttagtattyggaagatgtygttygattttttttyggtgtygggtaaattgagggattggygatttgygygttggygaggggtaggyggagttatgtgaygtygatttttygaagagttygttttagtagygyggatagggatataygtaygtagtttygtygaggygtagagtygygygtaggttgtaatttggtgttttttttttttttttagatatatatataygtataygtataygtatatatttaaattttgttttttttttttttatttttttttttttttttyggatgttaaaaagtaaattagattaattttygtttaatttaatgaaatttygaaggttygttatttygggagtttgygtttttgygttttatygyggygtattgtagatttggggttaagtgttagttgttatttttttttttaaaggttygttttttttttttattttatttttaataygaggtggaaggaggaaggtgggtggygaaatagagttgtaaaagygtttagttttagtttttgtatagttagtygggttatattgaattttagtattyggttgtattttyggyggtttttttagttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagtttttattygtttatatagttatayggtatttattygagaaygttatagygttygtatgttgtatygggagggygygygggtygtygggygagtygggagttggggyggggagygygtatygttgtttgtygtagagggtagygagttygtttygattyggagtaagtygygtttggttygggygttttgtagyggggatgggtgttygygtagttttgtgaaggaaagatattattttttygtayggaaattgygtatatttttttttyg

SEQ ID NO: 6058 - DNA, 1218 bp, synthetic construct
  misc_feature 1..1218: note = Description of Artificial Sequence: Synthetic polynucleotide
  source 1..1218: mol_type = other DNA
tygygtttgtagttygtgtattttttttyggagttgygttagggaattayggaygaattggaaggggtygagaagggttttggttattatttttagttttaagttttttygtttttttagatttgggatttttttyggggaggattttttggygttttttggtagtttttygtygtttagggtygatttttttatttttagttttygggygggggaggtttygtayggtygtttagaygggttggggygggaagattgtagyggttttgggtttattttttgtttttttataatttttagtggagttgggttaattttaggtatagtttattygagttaggygaggtttagaaaggtttgattygtttggtagttttaayggatttgttttygtagtygttgattagtygttgaygagyggatttttyggtygttatggygattgtgaaatgtagggtggagygtatgygttygaagttattygygygggtagtttttgygtgtttttttgygtgtttttttaygtgttttttagygygygtagtatttygtttttgygttttttygagygtgtagttttyggtgagggtagttttaygtatagtttttaatattttttttagygtttgtagttttyggtgygygtagtttttaagtttatatgygtagtttttattttgygygtagttttaygtatagtttttaataygtttttagttttattggygtagaatttattatygtttgttttttaygygttttattgggagtgtagtttttatttygagygygtagttttaygtagtttttttatattttttttagygtttgtagtattttttagtgygtatagttttgttagtagtttttyggygygtygtttttgtatygtttygggttataattttgttggygattaagtttgaagaattttttgtggttttatttttttttttaggtttagttttagttttgatattttaattaaaaggttataygttaattaaygaggtattaaaggggaagattttagttgaaagaaatgattgtaggaagtgtgttagggaagttaayggaatygttggttygtyggtggtgygttyggtattaggaaagtttttaygatygttgaggtatygggtagttagtgttygttgttaaygyggagggaaygggyggagattgygggtaataygtggtagagtyggygtgagttyg

SEQ ID NO: 6059 - DNA, 1848 bp, synthetic construct
  misc_feature 1..1848: note = Description of Artificial Sequence: Synthetic polynucleotide
  source 1..1848: mol_type = other DNA
aygaygaaggygygtttttttttattygtttatattatattttygtttttygaagtatagttygggttggagaagttttagyggyggyggttttygyggyggaggttttygygygtatttattatgtttttygttttttttygtttatttygagygtygtgygygttygaagttygagtygtagagygttatygygtaaaggaaggagttaggygygtgyggggttygyggagtttttttgaattttttggatgggggyggaggygaggggygtygttattattgyggtaaatttygtttttttttygggaggtgaaattttttaattygttttyggtyggttygygggtyggatttttyggaaaggattttttaggaggagggagygaatgtaagttttgttyggaygttttatyggyggttttttaaatttgggygttttttgatagttatttttattttatttygtttttaygttggggattatttttggtttyggaggygygggygyggtygtaggagygggttgyggggttygygaaataaagaatttygagygggaygtatttgyggyggtagyggttgttaagttttygaattttttatagattygyggayggggygtaggttggyggtttttygtttygygyggtygygggyggttayggttattgygagyggtygggttgggygyggggtgygttygtygygggtatggtgyggygygggyggtygyggggygygyggggaaggygggagagyggygygggtgagtgggagyggygggtgtgygygagtgygagtgtgygagygygtyggtggygttgtttttgttygttttttttygttygtgtagtttyggtattagtttyggggatygtgtaattygattttttttgatttataagttttgagtgatagttttgatttggtttaatygygggagggaggggaaagagaaagaaagaaatttttagtygtaygttttttttggtatttaatygattttttggaaaaaggttttatttyggtttggtgtttygtgttgggtggagaagtttttygtttygatttggtatygtttgtattatttayggggtggaaaagttgtttttyggtttygygtttttttttygygygttttttttttttttttttttttttttttttttttttttttygygtttttttttttttaagttttaatagatgttgtyggatttttttygttttttygtatttttttttttttygtttyggttttygtttagtttttttttttttagttattttygggttyggaggggaygygttgagtagtaggaygtttgtygtygtagggggygaagttgggaaaatttggagtgttgttygttttatttttgttttttygttttttttaggtygygtygggagttttygtttttttygttygtygggtttttaagttyggagtgggttttagttgygaggygggyggyggyggttgggaggyggygygtygygggtyggggtygggggttgggggggagttygggygtygygagttaygygygygtttttttttygtttttygtygtygtygtygtygtygtygtygttttttttttttttttttttttttttttttttttttttttttttgttttttttyggtttttatatagatatatttatgtttgtttttttttttttttttatttgatttygygttttttyggygygtygaagttttatttattyggygaggggaagggggttygggygtgatgttattygygtttttttttttttttttttatatygttaggatattttttaaatgygygttttggtattygtgttgyg

SEQ ID NO: 6060 - DNA, 2119 bp, synthetic construct
  misc_feature 1..2119: note = Description of Artificial Sequence: Synthetic polynucleotide
  source 1..2119: mol_type = other DNA
tygtygtttttttagtatagttttygtagttygtattygtttatagggttttygygattttagagtttagggaagaattgtygaggggyggggggttttttatgygtatggaagggaygtaygttttaggtttttattttttttttgatttyggggatttttggaygtygatttttygtttygtaggggygagggttttgggttygtagttagaygygggttttttttaaatttagtggtttggttttattgagtgggggaaggtatatattttttaagattaattgtttygtaatagggaatttygtaggattttagtattttygattttttaggtgaygttaagagggtgggttttattgtgtayggtggggaaattgaggttyggaggggataaggaaggtattygaggttaygyggttttttyggygggygggaaygtaggaygyggagttggggygygggttgtgygygtttaggttygyggttttyggggttyggttgtygtagygyggtygtygtygaggattayggtyggggygygggygggttttagtgygtaggygyggygggygggaggggaygygtttygggygygygygyggggtagtyggygttttaatttygttygtttygygtttygygtttyggygtttygtygttygtygttygttygtttyggygtygtygttygygtttyggygtttygggtyggygaggggygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyggttggagtaggyggttaygttgaaggygttggtygtttttagtttgttggygggygygttggygttggtygagttgttgggygygtyggggttygygttyggtttggttaagggtttatattyggtgtattgygttttttttttggygttgttygtggtaattaaygttyggtttttgtaggtgttttagttgtagtaggtyggttagttggygttgttttttagttttattttygygttgttttgttgttttttygygttgggyggtttygttyggggtttygtyggggtygttggggggttagygatygtygaataaggggtttggtagttttttttggttattttygtgttttatgttttgttgttygtgygtagtttgttggttataggttttgggttygtggtggttgygtygtatttgttggttatagttattttggttttygttaagygtttaygtttttggaggayggtaagtgtagtygygtattttttatttggtttyggatatatttgttgggaygatgttgggaatgttyggagtygggygygtttttttttatgyggygggtggggatattgaggtttygagtgggggtgtgtttaaggttatttttaygagttggggaygtagtyggggttggtatttttyggttagggttttttttagagttataatttaygaagygtttttggygtgaagtgtggagaggggagataggtgtggagagagaaaggtttggttaaggttagggagttgatgagyggttagayggyggttagaggggttygtyggttttttgtygtatttatttttatagagggattgaaagtgggygaggagagtagatttttagggtaagttttaaggtyggttttgygygtagygttgggttttttttttgygtatttagagygygtgttgggttygttttttaattttgyggattygagggtggtatatgggtggtgggaaaggatttyggtttttttagttttgttggttatttttttgtggatatgttttyggtttagaaagagtggggtttgttaaggttaaatatagtttagtttttgtygttgttattyggyggttgttttgattttgttttttttgygttygaattttgttattgtttttttagtygggygggygagatggttgtaaggayggggaygttgtttgtttttygyg

SEQ ID NO: 6061 - DNA, 562 bp, synthetic construct
  misc_feature 1..562: note = Description of Artificial Sequence: Synthetic polynucleotide
  source 1..562: mol_type = other DNA
tygtagggygaaggggtgygttgttagatgtggtattttygttttayggagatatayggtgttttataygttagggagaggtttgagaygtaaagagtygtygagygggttgygggattgtttygttgttattttygtttgtagttattttttygtaygtatttgtgtgtgtatttaggttaatatggaaggygttattttaatttttgtygtgagtaggtgggagggaagagagaygagaggtattttattggttgtttgggaaaatgaattgtattttttttttttttgyggaggattaattttttttattttttygggtgggtattygtattttggggtyggagtttgaattygggagttaaggggttttagttttagggaygtgaagttgagygtatagygggygtttttagatattggggaaagtgttttaygatgtttygagtttttttagtttygttagyggggygagygtgagggtgtttygatygattagyggtttygggtgtagggtggygggttyggyggygygygttttttttttttttttggyggttyg

SEQ ID NO: 6062 - DNA, 1404 bp, synthetic construct
  misc_feature 1..1404: note = Description of Artificial Sequence: Synthetic polynucleotide
  source 1..1404: mol_type = other DNA
tygtttygttygaggygaaatygttgaaagttyggttatttaatttttgtttttataattyggaatttyggatattagyggttttagttgttggygygyggtttttttttagttttttggattttaaagttttttgttatagygyggygttttttttttttgttaatttttttttttgtattgtgayggaggtaaagtaatttagtttaggaggttgaattygagttattagagaaggagaaatagtgtygaaaayggttygtgygttattagggtagtttattaaygtattaattttaggttygttgggtagaagtygggaggaaatattttggggatygtatttttggttaaatgtttagtaygagttaaattyggtttttttaaagygagttaagtttattattataaagagatttttygagtgttttgttttaattatattttagatagttagttttgtggttgttgtttgattttaattttttttttaaatttaaaaggatgtatatttttattagayggaaygtygygatttttyggygaagaaaaaggygtygtttattttttttttaaaaygttataataaaaattattaygtttttttttttttttttttgtttttttttttttttttagattaataaggaaaggagygagygagggygtagatgttttttggttaagtatttttyggatgttttygattaaagygtttttaaatgaatttgtagtttgyggaagtyggggatatatttatagaygttttttgttgtttagattaggaggggtggtgggggaattaggaagttagggagagagtaaagtttttggaygygttttaggaggaaaattttgtgtagtgttgttaggyggaggttygttagaaggtttygtagttgttgaggyggggtgggattgygttttaggggtygygttgaagttggygtygygattattgygtatygatttygtttattttttgttygttttygggagttttttttgttttaggayggttttttattttttaaattatgttygttttttatttyggatttatagttatttttaaatttyggttattttygtttagtatygyggtttttagtatatttttttattggagtagtaggtgatttaaattagatttatttgttgtgaatttttttttttttttttttttttttggtgtttttttagggagaggggaaygggatgtaggttgaggtttagyggygyggtaattyggggtatyggygygygtttttttgagtygtagttttggttgagtaagyggagtygtyggtagttttggtagagtygggaagttgyggtygtaggggttaggtygggaggtagggggygttgttgtttttttygagagtygygttaggataggyg

SEQ ID NO: 6063 - DNA, 819 bp, synthetic construct
  misc_feature 1..819: note = Description of Artificial Sequence: Synthetic polynucleotide
  source 1..819: mol_type = other DNA
gygagaygtgggaaattggygaagttgttattagtygtyggygtaaggagygygagagttttgggtgygygtagggtatttattttttattttttagtaagtatygtygtaagttttttaggtgtagaaattgttggygttgttttygtagttttygtataggaattggyggtagttttgygtgtatttgtygtagtagtaayggagaagtagggttyggtagggttygtagtttaggggtaggagatagattttygygttattttttgaagaaggggtagaaggagagtaaaagagagggaaagtggttaggygtagtttttaggaggaaagaatatttyggggagttttgttttttttygagyggaggggtttttgtagagaaagtgtaaatttgggagygagttttttttgttagyggagygygyggtagggatttggagaaagygaggtttggagggygtttatayggggttttatggttygttgygtttttttygtyggttggggagagaagtttttggagyggttagatatttgttggtttttgagtagtatygtttagtgtagttttygttaggaaaagtagtagaatygatagttttagggggygagyggggtttatggtgtagggggtygggyggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttygyg

SEQ ID NO: 6064 - DNA, 1128 bp, synthetic construct
  misc_feature 1..1128: note = Description of Artificial Sequence: Synthetic polynucleotide
  source 1..1128: mol_type = other DNA
gygttggygggygtattyggyggyggygagygyggaggtgttgyggtatttattatggtatttttgtttyggaaygtagtaggtggggttgttygtaatatgtagggaaatgagtatttygttttgttttttatttttttttagtttttygtggtgggtgtataggaaaaagaagggygaaaagygggggtaatagttagtygtygygygygtttttagygtygtttttagtaatagygttaggaggaaagtttgtygggtttagttattgygttttatgtygtygtygtygtygtygtygtygygygttttaygygtygttygtttatttagttttggagaygtygggayggaggagttaygyggagagaaggygagaagaaggyggaygggagyggaaygggttygggagygggtttgggagygggttttygtygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttygtttygttttatatttttttaaagtttygggygtygygtttttttygtygtygttataygtgtttyggtygttttttygttttygygygtygtttygttygtttttygttttttygggttggttyggyggtatttygygyggygaggggygtaygygttttyggagttttyggttagygttyggttygtattygggaggatagggaggggygttygtyggggagygggayggggaygttgtygaggatygttgagttygygatttttttgygagggaygttaaagtttygtagagggtatttttygtttagttgtttgaaggggaaggttagtttttttggtygttagtgtgttttgttttttttgggaggatgygtgagggaaggagaggggyggtagggayggtygttggygtyggtttttttgtttgagtyggttgygtttygygtttttyggggttygtagtttgttagttygggyggttygtattygttttgggaattygttygaggtygygaatygttaggggttttygyg

SEQ ID NO: 6065 - DNA, 1128 bp, synthetic construct; identical to SEQ ID NO: 6064
  misc_feature 1..1128: note = Description of Artificial Sequence: Synthetic polynucleotide
  source 1..1128: mol_type = other DNA

SEQ ID NO: 6066 - DNA, 1128 bp, synthetic construct; identical to SEQ ID NO: 6064
  misc_feature 1..1128: note = Description of Artificial Sequence: Synthetic polynucleotide
  source 1..1128: mol_type = other DNA

SEQ ID NO: 6067 - DNA, 1921 bp, synthetic construct
  misc_feature 1..1921: note = Description of Artificial Sequence: Synthetic polynucleotide
  source 1..1921: mol_type = other DNA
tygyggatttgggtttggygtttattttatygttaggattggatagaaaggttttggtygaggttattaayggagaggttagagyggagtttttggtttagaatggaggtagtagygagttttyggyggtttttaggagtattaaggtggaggyggtggaggagtyggaggyggtttttattttgggtttyggagagtttgggttttaggtttygtygyggaygtygtygtygygtagtttygtttyggttagggttaaggtygagttgtttagttttaygtygggttttagttyggtgttyggygagttgggtttggtyggggttttgtttttttygtagtaygtgttygggttygaygyggygtttttygtttyggagattttggttaagatgttygagttggtgtatagtyggttgtagtagggygygggygygggygtyggyggygygtagatygggttttttttyggggtttttaagggygttaygtgtttygagtgygagattatttttagtaaygttaataattattaygtgtataagygtttttattgtttaggtygtygtgygttygaggaygygtttgtygygygtaggtttaaggygtttttyggttyggttygygygtttttyggttagttygtygaattygaygygtygygttygttttygggtttyggagygygygaggagggggttgggggygyggttaygttygaggayggygygggyggtyggggtagygagggtagttagagttygggtagtttygtggaygaygyggaggaygattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygtagttygggtttygtggttttygggayggtttyggttyggagttttaggagtygtygttyggttygttttygttttyggtygtygygttygaggtygtgtygttttygtyggygttttttttttattyggataagggygtttagatttttagtaagggtaygtyggygtygttgtttaayggtaattatyggtattgtygtttttgtaatattaagtttagtagtttgtttatttttatygtttataagaagtattattgtttttygtaygtygtygagtaygtgaagtgagygtttatattatagtygtagaygttttgtaygtttygttgygatgyggggagggggtygtttttaggtygtayggattgtygtttttgggaatttygttaygtataggtttyggyggagggggtygtagggggtagygttyg

SEQ ID NO: 6068 - DNA, 2872 bp, synthetic construct
  misc_feature 1..2872: note = Description of Artificial Sequence: Synthetic polynucleotide
  source 1..2872: mol_type = other DNA
gygtttttyggaaygttaygttttgygattgatttgygagtaaagtagygggtttagtttgyggygygyggaaaaggyggtyggygaagagtygttyggttygygggtaggggagggatyggagggagayggyggggagggagygttggtttttttttgggttggggtttyggaggaagtttttygttaagatttyggtygtgygtttttttyggggttygtttttttttttttyggttttttttttgttatygttttgggttttaagtaggtygtttagtygggttatattyggtggatagaagtygggatttagggttggyggttgggttygtgtattttttaygygggygtttyggttttgaagtgygygyggagtaggttttgatygttttttttttttttttttttyggttatttttgttttttttagttattgataggatttttttygaaaattttagattttttaagttttagtttggyggttttttttttttaagtygygtttyggtgatttgggttgygygattaygaggaagttygagaattttttggtttaagtgagataggaattagggtaataatgaagagaaagatattyggtttttttttattttaggtygtagaggygtatatygtgaaaagaaaggttaattagygttttaaygtaygttygggttttttttttygattattatgtatttttaattttttgttatygagggttttggattttttygaggttttttgtattttaagtggaattttttgttttatttgttagtagtttygtttgttgagaggaygtattttggggattgttaagaagtagtagatataattyggttttgttaatatagtatayggttttgttttygtttttttttttatttttttttttgattygtygtttggggygagttggagaaggyggagtaggaggtggggagaagggtgggggtgggggaaggtttggygtagtataaataagttttttagygggttgtttatatagtaggtggatttgaygttagttaggaggtttygttgtaaattygaataatattttttttygygtttttttttttttaaagaagttagggaayggggggagataggtggaygggggagaaaggtattttaattagttggttttaaatttattaataataataaygataataataatgtaaagtaaaataaaataaataagtggttyggyggtattttagaattttttgyggygttttgttttttatttygttttttygaggagaggtagtttygygagtagtgtgtgtatagttygtattgttaataataygygygygyggtygggtgygygygtttgttagygtatatttatatatatagatatatagatatatatatatatatatatatatatatagattygggtggggggagyggttgygygagatagygygagttttygagaaagygygagataygtyggygygtgtagtttygyggtygtygtttygttttagttttagtttygygttattygtagttygttygygaaygttygtttyggttatttatgyggyggtygygttygttggttgyggttttttyggtttttttttttttygggygygttttttattygyggtagtagttgttyggattygygygtgggtgtgttgtttgggggtttttgtttygtygtygygggtgttatttttygggaygttgtttayggygttttyggtygyggtaagttttttggtttttattttggygygttatattttygtattttattttgttttagttatttttaygttgggtygagttgygattttattttgtttygygtttttttygyggtggygataaagtttygttttaaaggtagygttttgtttgtyggggygagtgtgatatgtgttaaatttgggttyggygttggggtygtatttyggatttagtattattatttgttgtttttttttattttgttttgtgatgggggaaaaaggggtggagaggggagatttgttgttggtttayggatgatttttagtttggataatgtaaaatgttgtttygttyggagagatttyggttggaggagaatgtgtgtygaaatattagatgtgtgtttgtttatttttttttttttaattgtttgttgttttttttttttttttttygtatttttatttttaatttygggaggagaaataatagtaaaaatatttggyggttagaagtatatattttattgatttaattgttgatttttatttatttagttgggtaagtgtaygtttttygygtttaagttgggtattttagygtttattttagaagtatttttttaggaaggagagagatggaaaggggatatttttgtttttggagttaagaaatttttgggttttattgaygtttygggataatygtgtatagggatgattgttgttttgatygygtttttttttttgtttaygygttagtaygatyggtttttttyggtgtttggtttggttttatttttatttygttttagagaggtygtttggttgtttgtgggtgggtttggggtgaaatygtatttygyggtatttggtgaggggaygtgggaggagygtagatatttttyggtgatagggagggttttttatttggttgttatttggaagtttatagtggtttyggygggtaggygggygggtagagygygggttygaaygtttttygygtttgyggyggygtaygtgyggyggyggyggyggygtyggyggygygggygggatttattgggtggtygygygygttattygygygttttttgygygtttttgtttattygygaggtygtaaygygttttgatattyg

SEQ ID NO: 6069 - DNA, 2906 bp, synthetic construct
  misc_feature 1..2906: note = Description of Artificial Sequence: Synthetic polynucleotide
  source 1..2906: mol_type = other DNA
tygygggggtgyggttttgygtaattgggtgattygygtgttttttygtattttatttgtattaagggagygygtgttagaygaagggaattttttttttttttttggtgattttgttatttttttattaattgtaygaagtttaagggatattygagttttttggttgggyggatgggtttygygtttggtatggttgagyggtttatttttattttttygtttttatttttattataatagygattatttagttygttaggagtttttgttttttagygtaggtttttttttttttttagttttttgggttgttgaagtygggttttgggtagatagagattggggtygtggggagagygttaggttgtttttgtttttttygygtttyggggtatttyggygygttggggatgtagttttygttttygtygtatttggtygttygagygttygygtttaygtttygygyggggtygttygaaattggggtygygttagtygygggagttatygaggagttgttggggtgygtttgtttttgttttttaaataagattttygagattttttttttatttttttaatttttagtaggatayggaatttyggygtttttygaaagttataaaagaggggtayggaaattttaagttygtygtgttaattyggagaaygtaaattygaggtagagygtgygtygtgyggggatgtgggtgtygaggatttygaagygttyggtttttttygygatttttattttttttagattttggttagatatttatttagtttaygtttagagggygggggttatttygatttatttyggaagtygttaattttagaaattttttttgttaggttygygaaaygaaggtatttygttatttyggyggggtaagttyggattttattagggtaggttygggaggttatttagggtagaygattygaggtagagygttttaaaattttgtygtygtaygtttagttagagygtygagygygtttgtttttttttygttattttttagttttttattygtygattaaatttttgggggattatatttttaagttttgggagtttygggtaaagttttttttttttttgaatttttttattgtaatgtaattatgggtagataagaggggtggttgttttgttttttgtaaygtaaaattaatagatatttaattaagttttaatgttyggttagtttttygttttttggtgtttattttttttttttttttattttygttattttygttygttattttttttatagattayggatatgtagggttatttatttgtgtttaggaaaaataaattattagagtgatatgagaaggaatggtgtatttggttgttygttgaaaggttttagagaagaaaayggaaaggggaataaaayggggggattttttttttttaataagtagggygttttggggaagtttgggggttaggggttttttgtttygtggttyggtatttgtttttttyggagtygttttttgttgtygggyggygagttttattttgtttttygtagagggygyggtgaggaagttygtygggggttygtagttttatgttagygtygtygtygtygtygtygtygtygtgtgaggygagtatagyggtygtatttgtggttgatttttgggttgagggggttgagttggtttagtaggygttaagttttttttatgtgaataataaatatttttatyggyggtygygattggtttgygttyggygtttttygatttttygttygyggttatttattyggygyggygyggggagtygyggttaggatygygttygggatygttaatygtttygygttaattagttatttygggaagygggaggaggaattttygaggggygggagtttttggatttyggtgttatttagyggttttggygygggtagggagggggattttyggttygyggattttttttygttttttagtttgaagygaygaggagattagaaatgttaatagttttgatttttaaaaattattttttttttttygtttttaagaaaaaggggaggatttaattatagagtgagagggtgggaagaagygggagyggtagaagaaggaatatggttgtggaggagtttagyggtttyggttgtttggygagttygggatyggygyggggaggygygaygttygttygagtatagygggtagtattygygagttygggttttyggtgaatatagttttagaaagygttatygagaataatatatggtagatgataagtgtttygttatatgtttttttttygggaatgtttaaagtagagtyggtaagtygygyggtttttttgtaaagtttgtttggygtygygyggyggtttygttatttgtttygtttygyggttttggygattgtttttttatttttygttttygagggtttgagggaygygtgtaatagagtttttagggttygaggtattatatagygyggttygttgygggtattgygtaggaaggggtatgggtggttatygggayggttattttattgagatgatttaaggagtygtagaygyggggtaggaaatttygggggagtygtgttygggttttgtagggaaatttygggatttttttygtatgtygtatgyggaaatttgtygggttygaygtgtatagtttagygtttttttttattagttattgtttaggtttttygattttgtattygtyggaatgagagaaagtagtttttygtygtttagttttygggtagttgtttyggtygggttttgygttggtgagaaagttttatttagaggyggtygygygtaattgtaggyggygttttaggttygggygagttagggagagyggggygyg

SEQ ID NO: 6070 - DNA, 2906 bp, synthetic construct; identical to SEQ ID NO: 6069
  misc_feature 1..2906: note = Description of Artificial Sequence: Synthetic polynucleotide
  source 1..2906: mol_type = other DNA

SEQ ID NO: 6071 - DNA, 1696 bp, synthetic construct
  misc_feature 1..1696: note = Description of Artificial Sequence: Synthetic polynucleotide
  source 1..1696: mol_type = other DNA
tyggagtyggagtyggygaagtygyggagttgaggygygtttgggagagttaaggttyggygggttatgtaggtgtatgttttttttttygtttaaggagyggygttattagygtttttyggttttgtttttggattttggtatyggttygttttagtygygggggaaggygttttatygttaaagtgygtttyggyggtttyggttygttttgygggtygtygtyggagggagtgygggggygtttygaagtygtttaggtygtattygttggatgttgygttttttttttyggygtyggtygtttygggtyggyggtagttgattgyggtygtgagttygyggagyggygagagttaagaggaggtgttygyggygttttygttttttttagatatatatttttttttttttygttttttttyggagggtggaagagataaaaayggggggttagttttttagttygtyggttgtyggtaygyggggyggygtttygttyggttttygaggattagyggygtggyggttgygttyggattyggttygtyggtyggaggagygygyggygttygyggtygygttygtatygtaggtttttttagagagttygggggygggygygggttyggyggyggyggyggtygtagttttyggyggygygtaatygttygtygtygttygtygttgttyggttttyggygygtygtyggtttyggttttgtgyggagggagygagttygyggtttyggttttyggygtttttagtggtygygtygttagyggattgttgtagyggygtgagtagygggggtygyggttgygggaaaygtttyggagtttaggaatatagttttygttggttagyggyggtagtagtagtagyggggtttttgygygyggygtttatygtttttttttygygtygggttygyggtgttgtaggyggtagttaygtagattgtttttttatttttttgttttttagttagaaygtgaatgtattgttgaygtatattgttttgggagaagattagygtgatgtagtgtttttatgtattagygtygtttttttttygtygtttgtttygyggggttaaygtyggygttttttagygtygygtyggtyggygtygygtagtttygygttttyggtygttygtttttttttttttttttttttttttttttttttttttttttttttttttttttttttttttttygggtygtttttttttygttttttttagaygagyggagyggggttagggygagygggygagygagtyggagtgagygttaagtgaggggtygygygtaagtygtaggygttygtagttattttgggtyggtyggagggagtagttgggtggtygttgataggttggagyggygyggggttgyggygggagagttygygtyggttttygtttttyggttygtattyggggttttttggttttgaagagyggggtttaggggttyggyggttygyggyggggttgttgtatttggtttgtttttygttyggttygygttatttttattttygttgattgttgayggggygyggattygygttyggagttyggaattgygtggtggggattygggggayggyggtyggggttaygaggtttttaggatygagagttygggtttygttgttgtattgtygttagtttttttttyg

SEQ ID NO: 6072 - DNA, 2054 bp, synthetic construct
  misc_feature 1..2054: note = Description of Artificial Sequence: Synthetic polynucleotide
  source 1..2054: mol_type = other DNA
aygyggygatgttttaagtygttttttgtttgaaatttyggygtattttyggggaagtagtgttaygttttagaaaggygtttgtgttgttttttattggggaaaygtagtgtttgttttatatgygtygttttatagaattgtagttttaatygtttatttggtttttttttygggygttgggttattattttttttaaatatgygttygaatatttgtgggtttgtttttygttgaaattttagggtgtttaaaggttayggggtygygatgatattgggtaggttttyggaaattttttaggattttttttattttaaagtttagttagggaygaaaggggttgggagttgaaaaattgtttttttaattttttygggtgggaggtagagtygggaatatatagaattttatttygaaagtttygggaaagagaagtttgagtttaggagygtgagaggagaatatattygggaaatttttgtttyggtygttgtattttygygggygtttaggtgggaygtgggtaggtgygygagygtygtgtgtgtyggtgtggatttgtgtgtgtgtttgygtgtgtgygtgtgygtgtgtygygggttggtttygggatattgaggattttygggtyggtttaggtttgttygattttgttgttttygtygttygttyggttttatttttyggygggtyggttttttatttggaygygtygygttttttttttttagygggagygtygtattgatattgtagatggagtttatgtygttgtttttygtttttttttgaaygtgtgygtgtgygygygtgtggttgttttttttagttttagtttygaaygtaaatattttatygaggtatagggaagtygggagtagtygaggaaygyggagggygtygaattagagtttgyggggtttgatagttttttttgyggygtttaaggtgggygtaatgtttaataaaaaggtyggaaaatggggatygatttygaatattttttttttttatttagtttyggagttygagtagyggyggyggttttygggggttgyggtggygaygtygggttgttttttttygtttttattttygygggttgaatgtttttgatgttaagygggtatagyggygttatttygygtygtttatgttygttyggtygggtygttgttygggygyggygagtgygygggggattygtyggggagygttttyggygtttttgygygtttttttgggtagyggyggtygtttttyggtagttygyggtyggtygygtygyggtagtttttatttttgtygagatattygtygggtagtgttttggggtyggggttggggggtygygggagtygtyggttgtttttyggggaggtgyggggttgyggyggtggtggttgyggyggttggygttgyggyggyggagagttyggtygygggtygagtygggtttttygggygygttttyggtttttygggygggttgttygtaaagtttgtagggggtagggagyggggtygtygttggttyggtygtygtyggagttttygggttgtttgttgtygtygyggttygttgttgttgtgtattgaagttyggttaagygttgtaaaaattttagttgtttggygttttttgggttttttttttttttttttygttttttttgtttttttttttttttttttygtttygtttttttttttttttgtygttygtygttygtygtygttttttttttggttygttttygttggttyggagttygyggttgatatttagagygagggagagyggtyggtagagggggtagggggygtttttttatatgtttttattygtygtygttyggtttgtyggttttttttygtattaaygtttgtygatatttttttgggttttttyggttygtayggagttattttggyggtggygatgtggggyggagagaggggtatatatgggtgatyggagygtayggygygygtttagagggaggygtttagtygtttyggaatttgtagttttgggygttggtygtyg

SEQ ID NO: 6073 - DNA, 1258 bp, synthetic construct
  misc_feature 1..1258: note = Description of Artificial Sequence: Synthetic polynucleotide
  source 1..1258: mol_type = other DNA
tygyggaagygttttttgttgggtagaagagtgggtttttygtygyggygtatttgtttyggttgtyggtttttygtatttatttgtaygagatttgttttyggaaagttaagttttttagttttttttttagygtttygtttttttttttttggtyggyggtygygggttygtttagggtagyggttttygtygtygyggttgattttgygtttygygggttygygtygttttyggygtttaggtagtagttttyggygtygttttygttgttgttgttgtygttygtygttttttttttttttttygtygaggagttggggtttatggygttygtttyggyggtygyggagggagygtaggyggygtygttgtaggggtygggygggttggyggyggyggyggyggyggttgtaggagygygggtaggttygygygtygttggtaggggtagtaaatggtagttttttttygtagtatttattygyggttgtatygtatyggggtattgtgggaaatttygtttattttttygtttyggttaattagaggtygtygtttttygtttttygygttttttygygtyggttygtattttttagtttygttggtttttttttaaatttygagygaaagtttaagttgaatatgaattttgttyggaggygaygggttgyggyggagggggagagagaggaggataggttgygatttygggttggggaygttagggtagggatagygagtattaggaaggagagygttyggggaattygagtggtygygttttgggttttgtatygtgaggttggggggattaggatyggygggygtttattttggttttgagtttagttgtygaygttgggttagtattttttttatygtygttttttagtgagtagagttgggtttaggtagtagtttttgggygygggaaggtagygggagttgtatttaggggaggggggaggtagtaggagtttygttagtgggaattttggagtgaattygtyggygggtgttaagtygaagygtygattttttgtttttggattggggttyggatttttgygtttttaaattgygttttygttttgttygtygttyggtgttttttttaggygtagtagattttyggtaaatagyggttaattygatggaatyggattatagggttttyggtgaagtagaaaggyggaggaaatttaggaggtagaagtgaggattttggygtttggygtygttgygttgttyg

SEQ ID NO: 6074 - DNA, 628 bp, synthetic construct
  misc_feature 1..628: note = Description of Artificial Sequence: Synthetic polynucleotide
  source 1..628: mol_type = other DNA
gygtggaggttgyggttyggyggggtaggygttgagygtatygyggyggtattyggygtagaggttttagygyggggagtygggtttagtttyggtttgttagygtygyggttttagtttattygaggtyggtttggggggttygtagggygygyggagygtygagtgygygtygggttgggtttygtatttyggtgtaggagygygggygyggygyggyggagygtttygtatggagtyggttygggagtttttttygygggttyggtygtygtygtttttygtygygygtttygygttygttttygtygtttttaggtygygttygttygtagaggttgaggttygyggtttygaggggttgttgyggygattygggtygggttaygagggtagtattagttggaaggyggttttggagggtaagygyggagyggttttttttttttggtttagggatttttgtttaggttygattygygattyggaggyggttagagttattttggtygttgtttyggaggggagygttgggagygyggygtygggaygyggyggagttatttattttagggyggttagaygtyggttygtggggtggggtgggagggaatygggggttatygyg

SEQ ID NO: 6075 - DNA, 1075 bp, synthetic construct
  misc_feature 1..1075: note = Description of Artificial Sequence: Synthetic polynucleotide
  source 1..1075: mol_type = other DNA
gyggtttttagggygagtattttygtttttagygttttttggttattaaagaaaaattagaygtttgygaygggtttttttttygttygggttttttygtttttygtttttygtyggttatygggygttattatygygggtagtagggyggggygttttgggagtygttgggtgtttgggttggygtttgtaggggtttygygggattaggtyggttgtaggggygyggyggygtagtttattttgttgttgaagagtygygagaggttgygtatgggyggagggggtygyggggtatttyggagttygygtaygttttagaggygtagggygtygtygtgygaggyggtgtagagtatttggtygtgtatttgygggygtaggggygggygttatyggtgaygyggtaggygggggggatatygttgttygygtggatggatyggggyggggtatttttttttttaygggyggyggtttygagaagggtagagggatttatttggatgtagttgatgatgaatgtgtggtttyggaatatttttygtagttttttagattgygygtygaaggttygggygtaagygttttygttgttygtgaatattgyggatatatagygygygttgggtttttttttttgttyggtttttygtaagtagggatggggyggygagagygtgatttggggygttttygagatttygttttaygggggtattttgaggtttatatgggaagtggatagtgtttttttagagaaaygggtttttayggttattttgttttattttgtagatgtttgygygttagttggttttgtttttgttttgttgaatatygttygggtttagtttttatttygyggtttggtgaagttggttttygtgtttgtttgggaagtttttgtttggggataatygttaggttttygagtygttttttttttatttttygttgygtyggtaattttattttttygtttttattaayggatyggtatttaaattaaagtttagttttttggggtttatgattaygtattttygggatttttagygggggygagttttyg

SEQ ID NO: 6076 - DNA, 5566 bp, synthetic construct
  misc_feature 1..5566: note = Description of Artificial Sequence: Synthetic polynucleotide
  source 1..5566: mol_type = other DNA
gygtttttttagygatyggggtagaattaggaygtgtaatgygattgttttttttttttygtttttyggtagagtttttgttygygttaatttatttattaggttttgttygygttaygygygtttttggtaggtttggggyggggaaaggygaagygttgggtaygygagggtttgtgtattttagtttttaygaygtttttggttttttttaggttygtygttgtygtatttaatttttttttttygggggttattttgaagaagttttagattttagatttagttttttagatttygttttygagttygttyggtgggtttgtaggtyggttttttttygtttagaggagagygtagataygtaatgttygttygttggtttygttygttttatttttgtttttygygttttttygtttyggtttttgtttataggtygggtyggaaygttagttttaggagtygayggtggttttttgttygtttyggggaaggtgttgtttttttatyggttttaatttttygttyggygtttggggtttggttgyggggttyggtttttagtygagggygtagggttggttaggtttgttttggttgaggtggagatttygtttttagggattgttgggygtttttgtttygygagtaaygagatygtygygagygaayggtttttattgagtttatttttttaagtgttattaygttaagttagagaagygaggygagtggaggggaygtagaggggtyggaaaagttatttttttttggtttygtttttagataaaaaygggagtttggttyggtattygggygttyggtgttttyggggygttttattgaggttttgtttgtaaaattagygttygtgttttgaagygtayggygtttggaagttgtttttttgttygtttttttygaggtttttttttgtgtagygagtttgagaaatatggaggatygtttttygtaagygggtggtygygggygtttttygatttttgggtgaagttagagggaaaayggggttttygggttagtgttttattttttatttygggagaaattaatgttyggagagggttygtttgattygtatagaaaggtygattttgagggyggyggtygttygggggagaaagyggaggttttgggttygygggagygyggtagtyggggttggtatygtagaggagagataygttattgtttygtatttttagaaagygygaggygtygttttagttggggtaggyggtygaggtyggtttttatgygygtttttygaagttttttgaaatattttgyggagtttygtgtgtatagaatttagtatygtttagtttttgggtagtttaattttttgtagttttattttagttttttyggttttttgaayggtgattttttttatygtttttttagagttgtttygtgtttgggtttattttggggggttyggtattttttagttatttttttttttatttattttttttttttttatttttttttttattttttattttttttttttttaggagagygatttaygaatttttttttttttagttaattttagggtttagttygtagattttgygagggtaggtttttgtttatyggttygttaggygttttggaggtgaygttttgttttttagagtttttgttgtagttaygaattggggtttgggtygtaggaaagtatagggttgaagtttagygttttggggttatttatattgaggtagttagaggtaaagagttttaagaatttagaaaatattttttaggaagtygtttaattggtttttatgggataggtggagttattaatttgggatggttttgtaggaattaaagagtttagggttttttttttttttaatattatgtttaggagatttagagtygttggatttttttttttttgattggtgattattagagtttttagagttgtagaaaattttttttttaaaaaattaagtaagygttaataagattttttataaatttttattagttttattttttyggggggtaggtagattgtggggtttgattttttgagattyggggaggatttttggtagatgtgtgtttagttagaatatttggtaaggatttttttaatgaagaaaaagtggaggaatttagttttagygagaagaggtttttttattttgttttagatatatyggatagagggtatattttgattagagttaygtttagtggttaggaggttagtttagtatttttttttttattattttygttttgggtgggggggtaatttttttgggagtagttgtgggaattgtygttttttattttagtttagttagtattttgaagtttgtaggggaaggatagtaygtgggatggatattggggaaggagtttygtaaggttagggtgtaatttttaggttttaggtggtttggtaggttaygttgtttyggagatgtttgttagattttttaagtttatttagggtttggtagtaatttgttggttgtttttgygggggtttgggttgttgagtayggtgtagttgtttagggttaattagttttagggtgttygtgttaggttgyggttttttygtttttttygtattgagggtatttatggygtgtaaatgttttygtatttttagagttgttttatyggatgtttttaggaatttatatatttttataaaaatgtattttaaatgatggataggygagtttggggtaataaygggtgtttggtgggtagataagagtaaatgggaaggagttygagggaggagggggaagagaagaggaaatagaatttttagttggatattttgataatagttggaaggaaagtttagaaaagatgaagagagaggaggggagaaattaattggggtttttatttttgtygttggatttttaattttygttttaaatgggttttgtttttyggtaaaattagtttaaaggattttaaaataaagaaaaygagatgatyggtttgggagttttttaattagagtagagaagttagaggggggygggygatttggttttgaagttttagttgaatagttattttttttttttttggtaaaaaggatttttttagaattttygaggtttttggattttttttttygtaaatggagtygtatattgtattttttygttttttyggatygttaagtatgttttatgagggtygttgttttygggtggaatgyggtygtatgtaygygtttttttgtataygtatatataygtatatttataataagtgtttgtaggaggagtgttttgygygttagttttgygtttaagataggaagttgtygggttatygagttaaatgggagtgatattatttttttttattagtaaggaaagyggattataaaagtttttttgtatttyggtagtttatttaatattatttatgtattttgtgtaaggaattgtgggatttygttttayggtaaataatatggaaattttaaaaatagygatttttttgtgygtgtttatttaygygtttyggggtgatttggyggggttgtygtygggtgatttatatttttgaatygygaagygatagggaaagygygggygagygtaggagaygyggtygggggttttttygggtttttgggttttygtattyggagygggggaygyggtygttttaaggggaggaggggyggygggttgtttttgttatttagyggyggtyggagygttaygtgggygygyggygtygyggttattggttygaggtaygtgtttaggagatyggtttgygaygttattygagggggttttgttaaaaataagaataaaaatttagagtgaaagtgttttaggttgygtygagtggtttggaaattttygagttygygyggaggtygaggyggygagggyggyggayggtyggggagygygggyggtttagttyggttyggtygggttttggtttygygttttttatttatgygattygggtygyggagttttgyggggttyggygggggygyggtygtaygtyggtggggygtttyggttygtagyggggyggyggtygygaggagggggtttttatgtgygtgygggyggtggygggygygttgatygygggygttyggtattttygagggtyggttagggygtgygggyggggayggtygggyggyggyggyggtyggagtyggttygggygggygtgagygtyggggaaygygttgtttgtatgygygtagttttygtttygggyggtttaggyggyggygtyggagttygaggyggtyggaygyggagaggagyggggagttygggaggyggttygygttttygtyggattattgygattgtttagatttyggttgygyggygaagtygaggatttggttttgttgaattttttatygtttgggygagyggggyggttygtggtgtttttaatttagttygtggatttaaaggtggtttygygtygagygyggtyggygatttgtaggattttagttttggtygyggtygtygygtaygttttyggaagattyggyggggtgggggygygggggttttygtgtgygtygygggagggtygaaggttgatttggaagggygttttyggagaattagtgtgggatttattgtgaatagtatggaggagaatgattttaagtttggygaagtagyggyggyggtggagggatagyggtagtyggaatttagtttyggyggyggttygggyggyggyggyggtagtagttygggygaagyggatatygggygtyggygggttttgatgttgttygyggttttgtaggygttyggtaattattagtattygtatygtattattaatttttttatygataatattttgyggttygagttyggtyggygaaaggaygyggggatttgttgtgygggygygggaggaggaaggggyggyggagtyggyggygaaggyggygygagyggtgyggagggaggyggyggygygggyggttyggagtagtttttgggttygggttttygagagtttyggtagaattygttatgtgygttyggygygggygggtygtttttagtygtyggtagygatttttygggtgayggggaaggyggttttaagaygttttygttgtayggtggygttaagaaaggyggygatttyggyggttttttggaygggtygtttaaggttygyggtttgggyggyggygatttgtyggtgagttyggattyggatagttygtaagtyggygttaatttgggygygtagtttatgttttggtyggygtgggtttattgtaygygttattyggatyggttttttttaggtgagttygyggggattaygygtttyggttygtygyggggaggttygyggagttggggggyggtgttggygygggaatttatygggaggaaaatatttygaatttttttygygtataygtataaagatttaygygatattgtgtgaagttgaygtyggttygggtagyggttaggagtttagyggtaggattgattyg

SEQ ID NO: 6077 - DNA, 5566 bp, synthetic construct; identical to SEQ ID NO: 6076
  misc_feature 1..5566: note = Description of Artificial Sequence: Synthetic polynucleotide
  source 1..5566: mol_type = other DNA

SEQ ID NO: 6078 - DNA, 1164 bp, synthetic construct
  misc_feature 1..1164: note = Description of Artificial Sequence: Synthetic polynucleotide
  source 1..1164: mol_type = other DNA
gygatttgtttagygttaaatygyggttttagttttttttagttttyggtttagtyggtttattagtyggttygygttttgtagtttttttagagggaygygtttygagatggagagtaaagttttgttygtgttgattttggtygtgtggttttagagtttgatygtttttygyggaggggtggtygtygtygatygtaagttttgygygtaaatttttttttatttgtagattyggygggtggttattgttattygaattgaggatgagaagaaggaagttggaaggggyggtggatgygtttagggatttttttagtttgggttttagtttygaaayggttttyggagtgggatttaggaggggtygggagggaattttttttygatygtgaagyggyggygtttagttttygttttttttttttgtygggttttygygttattttttttattttggttgggatygygttttygggttygtaggtttygtyggggaggtttyggggtgtgggggtygggayggyggaggyggggagtaagggttyggttggyggtgatttgtagttatttttttgtyggaggggttttggaatgaaaggygygygggttaaggtgatttygttttggttggtattgyggtttagttttygttyggggattygygggtygattgtggttttttttggggaagtyggggygyggggaggygtttygggtattttagtygtayggggtaygttygttttyggyggggtttttygtttygttgtgggagtggtagtgggtgtyggggtggagaaagtaygygtggygyggagttttggggaygyggygttttattygttttggggagtttyggattttttttagtttttaggttygtatgtttttttttttttagtgttttgagaatttagygaggggttgattttttygaaatygtggygtagttattagtaatttgtggtygtygattyggggggttgttaggtttgygtttggttattttttttgttttgggggttgaggttagtttygggygttyggtttygtygygyggttgygagtaygtggggttgaygggygtygygtggaggtagygagtataayggtggttatygtygttagggaatygttygttygttggggtttaggygttyg

SEQ ID NO: 6079 - DNA, 1495 bp, synthetic construct
  misc_feature 1..1495: note = Description of Artificial Sequence: Synthetic polynucleotide
  source 1..1495: mol_type = other DNA
tygtaaatttttttttgygtygttttttttygygtggaatgggayggagtagtttttttaggygttgtttggttgyggaggggagygggtagygagagtttygggttttygtttgggttttygggttttyggggygttggtttyggttttygygtagygtttagygatttttgtygggggttttyggtagtygygtygttatttttygttyggttagygygggaggaaaaggggttgygttygggagygtygagtttaggtttttttyggtggygtgttygygttttggggtgggggtgtggtggggaagagggagggggygaggttaggggagggtgygaaggaggygtttgtttttaatttgygggygggaggtgggtggttgyggggtaattgaaaaagagtyggygaggagtttttygaaatttgttggaatttygggttygygyggaggttaggagttgagyggyggyggttgtyggaygatgggagygtgagtaggayggtgataattttttttygatygggttgygagggygtygggtagaggttaggaygygagtygttagyggtgggatttatygaygatttttyggggygataggagtagtttygagagttagggygagygttygttttaggtggtyggatygttygtygygttygygtygygttttttgtaggtaaygggagaygttttygygtagygygagygttttagygyggtygttygttttttttttygagggataaattttttttaaattygattygagtttttggattaaattygtttgygtygagagtygttygygtagagygtttygttttyggygagatgttygagygtaaagaaggtagaggtaaagggaagggtaagaagaaggagygaggtttyggtaagaagtyggagttygyggygggtagttagagtttaggtgggtgygtagygyggttygggttttaygattttttttttgttttttttatttttttttttttttggatgtygtggtttttttttttttttttttttygtttgtttttttygttttgygttttgagygttygttgagtygygyggtgtttttttttttgggggtygtygtttatttgggygtygagttttatygggygtttaygtttagagtttagggtaagggatagtagtttyggtygtatttttttagagtttygggagygtttygttttttggtayggtttttttttagygttttagyggttgagtttagttygggagtgggatttgggttataggagtygaggttgygtgygygygtgtttygygttataagygttttgtaygggggtygtgtgttttttagygggaaaygttggaatgggtygtttggagggagagtyggttttttyggtgtgtttggtagygtagaagtgggtggtygagtaagaggtygygtgggaagttagtttyggygttttggggtatagggtaagygatgtagagtgygygtyg

SEQ ID NO: 6080 - DNA, 352 bp, synthetic construct
  misc_feature 1..352: note = Description of Artificial Sequence: Synthetic polynucleotide
  source 1..352: mol_type = other DNA
gygtttttggtagtagtygtttaygttttyggttttgygtatygggtttgtttygggaggggygygtgaygttatygyggggtagtygagaggggatygygggtttygggtagggtaggygttttygtagttttagttataatataagggagagaaagtaaygttttggttttagaaatttttatygttaaggttagttttggttagaygtatagttaaagagtttttttagtttagyggatgaatygttygygagtggtattttttaaaattttggttttattttttaagatgtttttttattgygtaatttagaaagtattyggatygtygttatttattagyggyggyg

SEQ ID NO: 6081 - DNA, 1141 bp, synthetic construct
  misc_feature 1..1141: note = Description of Artificial Sequence: Synthetic polynucleotide
  source 1..1141: mol_type = other DNA
tygtttagtttttagygttgygttgttttygygtttatyggatgattaygaatatgattagygagttgtttattaagtttaygaygaatattayggagtagatygtygtgatgatgatygggatggtyggggagatgtgygygggttttagttgygygtttttygagtyggygttgtygttgttgtygggttyggtttagtygggaaattaggygttgttgttggggggtaggtaggygttyggggygtaggtagggttyggtttttygyggaagatttggatyggggagtttatggtggggygattgtagtaggaaggygaggataggyggtatttgyggygttgygggagygaaagaatyggttggaygyggagaggtaaattttgttygygttttggttagyggygttggggattyggagtttgyggatttttattygggtygtaagtygtygggggtaggatagggagaayggatttttygttgttttttyggttagtaggygygtygttgggtgttagagaggggygaagagygttygtttttttttttttagtttttgaggtgttttttttattaattttaggtatyggtttttggtggaattgtttttagattgtttgagtttttagggttaagttttttttttattttttagtayggagttttatttagaattgtatttygaaagtttaaagtttatttatggtttttagagataggygaaggygaggttttttaygggaygttttggtaggtgttgaatygygygtttaygagtttygtttagtttttggtattatttgttttyggatttyggtttygtttttygttygagggttgttgtttygtygagygtagttttygttttttagygtaygttttttattattggyggyggttttgyggggyggggyggggygggatyggygggaygtagtygggaygyggttgggygttgggggtttgygggyggagagttygtttggtgygttygttttaggtyggtaggtttttgtttygtttygttygttyggagttagtttttagttttttagttttttagtttygygttttttttagtttygtaggttygttyggtttattaattgttygagyggtatatygtttggttttyg

SEQ ID NO: 6082 - DNA, 3297 bp, synthetic construct
  misc_feature 1..3297: note = Description of Artificial Sequence: Synthetic polynucleotide
  source 1..3297: mol_type = other DNA
tygttygtygtttygaagttgttyggttttttttttagttygttttttagtttygtaaggttttttttttatttttttyggygattttttttygaggtttttyggaggygtttggattttttttttttgtttttygttttgtyggtygttyggttttygagggggtaygaggagttgtygggtygtttttygtttttgttyggggyggygttggtattgttyggtygattttyggggggtygttygttgaggtttttttattyggtagttaagtttagggaagaagaygttatygttgggtagagttygtttatgtyggtgagtatygtggtttttattaygttttatatttagtttttttaggatattagtttttttygattttttttaattttaattgattygtttygttggggttagtagtagggagggtggtaaggtygggaaggtygggaygtggttgggtaagttttaggaygggatattggyggttttygggatatygttttttttygygggaagatattttaagttatttttttttgggttattttttttttatggtttaagaaaaygggagggagttttygttttttttygaggttgttttttaaatttttagygtgtygttttttttygtttatttygagttttttttaaaygygttttygtttgtttttagygttygtttttttatttttttgttttttyggtaggtaagggaggaaatgaygtgatgttatttttgtgttaggttagtttttagttttagtttagtttttygggttttagggaattaatttygyggttttatygggttttattttygaagggaygttgygggttayggggataygyggtgttgygagttyggagagttgggyggttgggttttttttttygttgttttttggtttattttttttttyggatttyggagtttttggagaaggggaygyggagggygattgtygagggttttagygggatttggagttaggggttagtttttttttttatttttygttyggttgttgggtggggttttygygttttggttagttgggagggggygagggtygttttttagggygggaagatyggaggtttaggttgygtyggggtggggyggggatagagtttagagaggygtttygggtyggggagaaggtagggggttgttttttagagaygygtagtttatagaygygaagttttggggattaagygttttttttatgtttgtygtttattttygtttttttttttygttttttttatttaygaggttygagtaygtagtttagtatattttagtttygttyggtttygygygtygaggggaggygatgatatagagggtttygyggaygttttttaygygygtttggtttygtatttatatttttgggatttgttaatgyggggttggagtagtggggttgyggtyggggtggaggtygygtttygygtggggtttygggggtatttttagtattygyggyggtggagtgygtygtygttggagggaggygagaygtgggattgttyggtygggtaaaaggagtgagggggyggggaggaggtagagtaaggggaggaagaggtygggagaagagggttagagtaaagatygagagtyggagaaaggygaaaggygyggtgagtaatygtygaygtagagagggtagtttttygygttgtaatattgagaaggtattygygggaygtatgygtayggyggayggaggygagtyggtyggggtttttttttyggtyggtagggtggayggtgggttygtgagtattttagtttttygaatttttttttttygtttygggttygttttgaggtttygtgttggaaagtggtygaggttgggaggggygygtygttygttyggattttagggtgtygtygttgttgyggggygggagtyggtgygagtygggggttttttttygtagtgygagtttgggggagtggggttgygagtgygttygygtgygaagaggggtatygygttattaggattaatatgtttygggtttgttagggygttygygattttatttttgyggtttygygtyggtgttttggtggggaaygygggagtttagtttttagattttagaaatygtattgattattygaagygtatttyggaaagattaggygggtggaagygtyggtttttttaygggatagggagaggataaggaaggggttgggygttyggggttggtggtttgagygtygttgggaagggtaaggagatagagttttttggaatygtagygtttttttttaggagaagtgtaattagggtaggggtatygaggggtagggtgaggaagtggaygttttaygygtggattttagaagatygattaggtatgggygtttattyggagtttttgtttaygtttttgaaaatygaatgaatagagaagtgttttttatttttygtttgygttagggtagttaaygtgtaggygtygtygggatttttttggaataaattygggtatttgatttttygtattttyggagttgttttgggaagtygaaataagtttgggygttyggattgyggagattggaaagtagggggyggagggygggagattgggggygggaagtggaggtgtaggttgtagttggggatygyggtgggygttggaggggagggtttgtgtgygyggttgttttttagygttgggggagyggaygggttaggggtttttagggaagyggygtttygggatyggggtggttttttygtttttgtgtgygyggygatttttatatttagttygggyggaggagttttgagagaagyggttagttgagagtggggtgggygttttggggaaaggtttgygtgygttgyggttttatygttgttagagaagtggaagagagagagtgggygtygggagggggtttataggygtygygatttattttatttttttttaygtttgtgggggagtgagtggggaaggggttttgggagaggyggygygygggtattgaggtgtatygtgagtttttyggatttgatagtattaaaggaaaattttggygagtagttagggttagygagygattttagtagtagggaygyggtygtgygagagttygyggataggygagggggattttaggggagtagttgttgtttaygggttaygggygatgtayggagtggagaagtgaaygtggtttataggatttttgttyggaaggtggagagygttataggggaattttttygatttttgttygtttyg

SEQ ID NO: 6083 - DNA, 2213 bp, synthetic construct
  misc_feature 1..2213: note = Description of Artificial Sequence: Synthetic polynucleotide
  source 1..2213: mol_type = other DNA
tyggttttaaaygtttttttagttatttgtgaatygygaaggagtyggttttygyggyggggattttgttattagtattttygygggtygaggtygttttttyggtyggtttttygttttattygaaaaggaattagagtatttatttaagayggtgattggtagggtagattaaggtgttttggtttyggttttagtttygyggtgygtttygttygtttattttgatygggtgtaggtagttatygtygygtagggygtttaattyggygttygtyggygtttyggygtygttttgtaggttgygggtgagatgygygatgtaggtggtggttagtagtagtaygtttagtttggatagtttggtgtygggyggtayggayggtagygtgygttgtagttttaggaaagygtgtygtagggtttgtattyggttgygttttygygtygtattygtygtygtyggtygttygttttyggaaygygagtygtttttagggttygtyggtttyggttyggttygttygggaygygagtygyggatggyggyggttaggggygygggttyggygttggygttgagggggttgttygttgggyggtygyggtttatggtagtttttygygtygygygygttgtaaaggatygaaggtgyggtgaggtyggggggyggtygggtttaattygagaggygtagttttttggtttttttygtgygtttattagtagtttaayggggttaagggygtttttaagygagttygttttgtttgggaygygatttgttttyggaygtttggggagagttgyggaatttyggagtttttgggttttttagaaggataagaagaggygtagtgtyggttttgttttttaggggtaaattaagtaaaaggtttattttattygggaagaaagatttyggaagtatagtttaggattagtattygttygygtttgggtgattttatttaattyggtaygtaygagaggtggygyggttttttttygtygaygtygyggaaaattayggtttattagtygttttyggttttttaygttaggggggatttttgttygaggagygggggatttttagttttatttyggggtayggtattygttatygtttygagttygagagttgygtagtaygygtttgaygggttttttattttttttggagyggttgagtggagtttygtttygtygtgagggygggygaggggygtggagtagggtttgtgtggttagggtygygttggttattttattttygttyggtygatgtttaagtygayggttgtttttaattttygttggttgtgatttttatgygggygtttygyggttaggygtgtgtgtttygatyggttaaggtaggtygggyggaggatttggtttatyggagaggttaygtygggggttgaggyggtttagagggttattaattaaatttttyggyggggygggttygggggyggggygtttttttggtttygtttttyggtttattgttttaygttgtttttttygaggygtttygttgagggyggygtgtggagagtttggggtgtttgtygtyggttgyggtggggtygggttggaggtygygggtgaggtttgtggttaatttygygttgtygaggttttattttttygagtttagtttgattttaggtygtttttaggtyggtgtttagttgaggygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttygaatgtttttagtgtttgtaattttttaagaagtttttagagtagatagtttttggatygtgggtattttttttyggggayggggattttgttgatygttttygttgttttygygggggttatygttttttaattatttgggygaaatatttttttttggttttgtatttgtggatttaygggaagygtgatttgtagygaggtaggattygattttaggtttttttagaaagyggaygttgygttttaaggtttgtttagagtygttttaggaagtygtgggttttygatygttttaaatygtagyggtttttgtaggttttggattygtygttttyg

SEQ ID NO: 6084 - DNA, 363 bp, synthetic construct
  misc_feature 1..363: note = Description of Artificial Sequence: Synthetic polynucleotide
  source 1..363: mol_type = other DNA
gygtttagtayggygggtagygtygygttgygtatygtygtygattatgagygaggatagtygyggagatagtygygtygagagygttaaggatttggagaagtagtttygtttgygygtgtgygtgtttagygagttttagaagatygagygggattatgtgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyg

SEQ ID NO: 6085 - DNA, 960 bp, synthetic construct
  misc_feature 1..960: note = Description of Artificial Sequence: Synthetic polynucleotide
  source 1..960: mol_type = other DNA
tygtttttygaygttttaattagttattattttttygaaggaaaataaatyggtttttgatatatttttttaygtgtagygttygaygttaygggttttgggyggttgtattttttttttgtyggttayggtttaaggttttattattgygygtatttagtttttttttaggtgattttygygtatttggyggyggygttttaggtttyggaggttgttygggygggttggggttygggyggygttygttgagagtygyggygttttttagtygtttttygggygtygatygtygtttttttgtttyggggtggggtttaggggtattagtagtygygggttttyggtygtygtttgggaatttagggttagatttagttttataataaygttttttygttayggtaatttaattggaggtagaagtyggyggggyggtygagyggggyggggygggagygyggtygtygygagttayggtggggagygggygygggggattttggygggtttygggtagygyggttgtatttatttgtgttataattgyggygayggggggttgaggaatyggtttttttaaaagtaaatygaaaatgggtaatagagaggtyggggtagygttaagaggggttttgtttyggtgtttagggtaaaaaattyggtttyggtttttagaaattygagttagyggtggtttttttttttttttttttttaaaygtttttgtgttttygggtygaggggygtttttygygyggtttygagtgtatagygatattagggttggygttggagaggggagttttttttttagtatttttygggtttttttygtatttttatttatagttttttttttgggttygaygttttttygttttgtagtyggagtttgggtttggtgtttattgtttygyggggtgtttyggaygtttggtttttgtagygttttttayg

SEQ ID NO: 6086 - DNA, 1404 bp, synthetic construct
  misc_feature 1..1404: note = Description of Artificial Sequence: Synthetic polynucleotide
  source 1..1404: mol_type = other DNA
aygyggggttttygggaatygtygtttttttttttygttttygygttygygttttttttttyggggtttyggtttatttatttttggtgyggtttygtyggatttaggagtttyggtygttygggttgyggggagggggygtttygggtyggttttagaagttattttgtaaagaggtagggggygyggggtygygyggggygagttygggattygyggggaagaagtttttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatgagttgatagygygygtttattggttygtggygtyggaggggyggggygtygtttagggtyggttaatgggygtyggttttyggtttttygaggaagaggggggttygggygtygtyggggggattttttttttggggygggyggtaggtggggggtgtgggtttggtyggtyggttygttaggygyggggtttaggttaggttggggttgtttggaggttgygtttttttttgttygyggygtttyggttttygtygtygagagtggaygtttttttggggtaatttttttyggtttagaggtagtttygggggyggggattttgygaatyggggatttygtgaggtygttygttattygtgggtagtgaaaygygttagygygtagagtagattygtttgygttgtygtttgttggaygttttttgagtatttattggggatygagtgygggygaggtagtagygaaggaatygggaggggaaatttygtgaagattatttgaaaattgaygtttaaaataaaygaattttttagtattygttaaaggatagtggttygttagtgtgtttgttayggggyggtygtaggatttgygtttggaatygggygggygttygggayggataatgtygtttggyggtyggtttygygggaggttttygtayggggttaatttyggtyggygaagttygttgttyggaatgygaggtygaggtttttttttgtgatagatygggyggggttaggaggaggggtagggygggtatttyggttygaagatttaggaattgttttggtttggtttggggtttatatttgaygtttggygagggttggtttygggtttggttttatygggtttgggagggaygggyg

SEQ ID NO: 6087 - DNA, 1247 bp, synthetic construct
  misc_feature 1..1247: note = Description of Artificial Sequence: Synthetic polynucleotide
  source 1..1247: mol_type = other DNA
tygtggggtattaygygyggatttttgtttggyggtttttgygttyggggttgttgagttyggggttygttttgaggtygyggttgtggtttttggttttttyggttygygttattgtygygyggygttygttgtattttgttttttttgyggtttygtatgtttttggtggaatttagttyggyggaygaygaggaggatgagatggaagtttgttggaaatygggtaaattttatagaaaattgatgaggaagayggtygagagtaggattttgggagtatttatggygggtaagtggttgygtttttttaggaggyggtggyggyggygtaggaygygyggggtayggagyggttggatagyggtyggggttyggtttttygggyggattyggagtgygaggagtygggttttagttatataaatttyggtttygttaygttttttttygtttttygttgggaggggaggaatggggagggagggtagaggaggggtggggagggtgggaggagagtygggtggtgygggtyggaggtgtgggggagaggggtygyggtgygtyggtgtggtaggaagaygtagygttttygygggaygygygyggggttgtygggyggtgygygyggygygggtygtaagygttgatygggggaaggygggygttgtyggttygtggtyggggagtaaaggttggttygtygygttagggtttttttygaattttyggaggtgtggttttttygtagygyggtttyggttttyggttttygttagtygtttttatttttttgggagygagyggtttyggaggagggaagyggyggyggygtttttaagagatagtttggagtaggygtttttgttgtaggttgygtgttgtttyggggyggtggtatttttttttttyggttttaatygttaggtttgtygtttgygttttttaggggttagttyggagttagagaagtttygttttgggttaggygtagggtttagttyggaatagttttattttttyggttgggtatygttttttataaagataggygtttattttygattttygaggttaggtaaaggttaygagtttttagagtttggatygatgttaaaagttgttgygtttttttgtaggttttagttttttttttygtagtttttaattttttttgaygtagattttagttgttttattttttygtttgttttygggattttttttttttygyggtttgtttttyg

SEQ ID NO: 6088 - DNA, 1861 bp, synthetic construct
  misc_feature 1..1861: note = Description of Artificial Sequence: Synthetic polynucleotide
  source 1..1861: mol_type = other DNA
tyggtgagtagagtyggygtagttatagygyggagtygyggygtttattggttttyggagttgttaatyggygtgtaattttgtaggaatttttttygggtttatttgggagttatattgtygttttttttttttagtygtttaggggagtttggagaagtaggtttaggagggagggagttagaggaaaagaagaggaggagaaggaggaggattyggggagggaggygyggygygggaggaggaggggygtagtygyggagttagtggtttygtttggaygygttgttttttagatattttyggagttttagtygygyggatygygygttttygtygttttgtttttaaatttttgtygtagtttttttttaagttagygaatttattttttaaaattagaaattgaatttyggtaygggaaaggagttygyggaggagtaaaattatagtagagtaagaagagttttagagagtagttttttyggagtattaatttygtgtygggagtgtagaaattaataagtgagagggygtygygttttyggggygtagttgygggyggygggagtaggygtaggaggaggaagygagygttttygagtttygagttygagttttygagtttgagtygtaatygttgyggtattttgtttyggattygtgtgygygggttgygtygagygttgggtaggaggtttygttttgttttggttgtaagtagyggttgggagtagtyggtttttggggaatatgyggygygygtggattttgtttattttgggtttggtggtttgygtgtyggyggagtyggtgagtgggttaggyggaggatgygygygtygtttagggtgtttgaagttaygagaggagttygtagggaataggggagygttatttggggaatttttagtttttaagtatatatyggagattygttgggataaatgygttygttyggttattttttttttttttttttttttttagaaaagygttgttygttggygttatttygyggttygygggaatgggggtatygagaattgyggtttggtttagtygtagaggtttttgaagttatttttaattttttygttttyggygggttttgttgygtggtttgggaaggayggaggggaaagggtggtaggaggggggagtttgggtygggttygygagggaayggttttatttygygygtttttygagattagggatgatttggaaatttyggggttttttttttygtatattatttttttygygttagtttttttgtttgattgtatgtaagttttggggagatgggggttagatttaagagattygygagtgtttagagagaaaagtttgtaaaagtttttttgtttgatgttttttgyggttagggygaggtaatygatattaygtggaatygtagtaggygattttttaaggggatattgggggaggtayggaaygygttygaaaatgttgggaygtyggttattggatttttagttttgyggygatttttttttygttgaggggtggaggttgtatygyggggygttagggaygggaggatatttttataggagttataygggagtgtygtaagtagggygaggyggggtaygtgtgatayggygttyggtttygggtygtttggtygttgggggatagaggtttttttttygttaygttygttttttttggttttggyggggygtttttggggtygggaggagtttygttttyggyggagygtttgtyggtatttagtttttttttttygttttggyggtgggaatttgatttttttttttggtygygtttygggggttggagtttgtttttttaygtygtttaatgagyg

SEQ ID NO: 6089 - DNA, 3044 bp, synthetic construct
  misc_feature 1..3044: note = Description of Artificial Sequence: Synthetic polynucleotide
  source 1..3044: mol_type = other DNA
gygygygtgtggaaggttgggtggggtgygtatataygtttatttgtgtaygtatatatatatatatatatatatatatataggtatatatattygagtttagttatttatattgtttgtttagggygtttggaagagttggygagttygtttagttttgtttattyggtttygtttygtttttttygggagggtttttygggyggygtttagtttygagtagagtaaaggayggyggyggttattttygtttttyggtygttggtttttygttttttttygtttttttattgaatttattttygtgtttygaaaatttgattttaattygattttttygygttttygttttttttttttagagtgagygttaaaaagggtttgatagatagaagtttttggttttagtatyggtttagttygtttttagaygatttttgttttttttatttttatagtttttagtggtygttttattttygtattttttyggttaattttaatttttttygttttttttygygttgtttygygttttttttttaggattttttygtatatttttagygtttagygyggttttttataatttttttaygtttygtttttttygttttgttttygttttygatattatttgygttttttattygttttaatttttttttttygttatttttatttgtgggtttttagttttttgttttttttttggtttttatttttgatattttagggattttttttttttttttaygttttttttttttttaggatttygtttygatatttyggggttttttygttaygygtattttttttttttaggttttgatatttgggygttttttttttgttatttatttttagttttagttttgattttygggygttttgttatttttaygtttttygtttygtttyggtttttygggygtttttattygtygtttttatttttttatttgttatatttggtatttttgtttttatttttgtttatatttttttttygttttygatatttygggygtttttttataygtttttattttttatattttygttttygaaaattygggygttttttttttttaygtttagtttttttttttttttygttyggtttyggatttagtttggagatygygttygggaggggyggttgtygttygyggggygttygyggtgttygggtttgggtagygaggaggtgaygtygttttygygggatgagttygggaggyggaggggyggaggaggtgttggyggyggtattgagyggyggyggygtagggygygygggtttttygygtygattttatygatttaaggggyggyggyggtggyggyggttgagygattttgggtygggygygtgatgaggaggggtyggygttagatttygttgtaygtyggagttygtttggattygggygttggtagtygaagggttttggtttygggatttttygtygttagttttygttatatttttttygttttygtttttttattttagtygggggtggggtgggtggggttggggttttygygggggttttyggtttygyggttygttttygggtgtgtttggaggagttttttttttgtggygygygggagttttgtgatgygttagtyggygggayggatgagttgttttttygggaaatygttttygtttttttaygattttttyggttttygtttgggtgtttttygggtyggtagtatttygttttygggygttygaagygagtttttygggggtttgttygtaggtattttttttttttygaggyggygygygygttttyggttttgatygyggtyggatatattygygtttyggttygtttgtygttttttygtttgttttttttagttattttatttttagttgttttygttattttattttattattttttttygttttttygygtatttygygtttyggtttttagttttttttttttttgaatygtttattttatagtttttygttttygggaagaagaaatatttttygaagygtattttttagttttttttttttaygygttygtttttttttttttttgttttttttgggggaggggggttgtygttttggattgaaggttattgatttgtatgtatttgttttagygttggaggttgttttagtygtygygtyggtgtygtygttgttagtggagttgttttttygtttttttagggtggttyggttttattaaatatgtyggtttttgtygggtttyggggtygtttggtttttatttyggyggttttttagtygtttttgtagttygagatgtttgattttagttattttayggaggaggagaggaaaattattttggtygttatggataggtagaagaaagaagaggagaaggagtagttygtgtttaagtaaggatttggttttatattttygtttttttttttgtttttygttttttygtttattgttttgyggtygtttgygygttttagttygtygttttttttttygttggyggygtttaggttaygagggttgyggttagygtyggtygttygggttgttttaggggtgtttgagagtaggggtgtgtgtyggggagggagggygttaaggtyggttgaggtgagggtggygagttttaggyggtgtgattttttttggygttttttyggattttttygttggttattttggtttyggggttttagygggattggggttgaatttaggttttgtgygtatttttttttttttygtygygttgaggtagtgattggggtatagaatttaatatggtygtgtataggtgttttttggayggattygggygaaggygygttggtaggggatgyggaygttattttggttttaygttttygyggggyggttttattagtaaygygggatagagtagggttgtttatagtggttgygagtagygggyggyggygygggttaggggtttaagttttgtygyggtygggtgggtgtgygttygtygttattttttagtttttttttttyggyg

SEQ ID NO: 6090 - DNA, 1603 bp, synthetic construct
  misc_feature 1..1603: note = Description of Artificial Sequence: Synthetic polynucleotide
  source 1..1603: mol_type = other DNA
tygtatttygttygattaaggtyggggtygtagtttgtattyggattggatttggatgtagttaatttttttttggttgatggaatagttttttttttttatagtttyggygygtttttttttygygygtttygtygtttttygtygtagaataggagttgygyggttyggagyggyggyggyggygtyggagtattygtttygtaygtyggggygaggggygagygagygygttttttttttygygttttgygttttygygtttttttttttttygttgttygttttttygtttttttttttttttttttttttttttygtgttattttttttttttttttttttttttttttttttttgatygttygtttgtatatttttatttttttttygtygttttttttttttttttttttttttattgttatattttttgtgttttygtttttttttttttatttgtttgtttattttygaaygtgaattygyggttttyggaggagtttagygttyggagtatttggagttyggtyggyggygggtygagtttggttagyggyggyggyggyggyggyggyggygggagtygagggagyggtagtygygatygygggtatygygggagttttagyggtagtagtygtygtygagatgtttyggygaaagtaaagtaaatttyggtagattaaaygtaagtttgygygyggggtygggagttggtgggattattgtttaggagyggggtgygygggaygggaaagyggtgggtgggtggyggggttaggggagattygttttyggttttttagatgttttaaattttgtttgagtagtygaagggataattagatagttatagatagatagayggttagttygagtttygggtaggagagaggttgygaggagtagtttatgtttgtttygtttagttttygygttttygggttgtttttttaatttygattygygtaygttgygagttttyggygttgtygtttagtyggaggggtagtttygtttttttagaygtttattattgttgttgttattgttttgtgygattgaygtgggattatttttgggaattatttttagtaattagggtagaaattttttagaaaagttgggyggtygagatttyggggygagggaggtaatttttttaygyggtggaaaattagagygttagggtttygattttgggyggtgttagagttatattaaattygaagygaaataaaaagtaggtgtaaaagttygygtttttgyggygggyggtygtgygtttttgttttgygggygygggttggtggttggtaggtygtgttttgggatttygggygggttyggtttaygtygttaggaygtttagtygagyggggattygggtggtgtttggttttggtggygygyggagttttttttgggaggggtygttagttattttttagygyggaagttgtgagtttaaggyggtgggygygtaggggagtgtatggttttgagttttygggtgttygggggtttygatggtgtttagaggatayggygggttaagagatatttttygaaataggtaygttygtagagattaagtyg

SEQ ID NO: 6091 - DNA, 1365 bp, synthetic construct
  misc_feature 1..1365: note = Description of Artificial Sequence: Synthetic polynucleotide
  source 1..1365: mol_type = other DNA
gyggygaatatgagtgyggatygtaygatttagttttgagygttygattggygttyggttygtygagtttttagygygtttygtttyggtttttygygtttttagggtatagaaaatagagtgttttgtagagttttagggttttaaaggtggggattggggattygtaaaagttggggtggagagtatagttttgattatttgagttttyggagttagggygtgagtgagygtttttataygttatttttgaagtttattaygtatttttggtagagagggatttatttygtttattgygtttttatyggttgttttggtagtggttgtaatttatgtagtttagaatgatgagggtaaaggagaaaaggygaaattgtatttgggyggtygggygggggagagaygttttttaaagtttaggaattggagggttygtttaaagagtyggygtyggtygygttgttggggaggatttagagggagattygttatttattttygggtygtatyggttagtttagygygattagtattttttygttaygaatttgagagataagaagygaaaatagggtgtgtgggggatggagagagtttyggggaggtagttgygttttygtaygttttaatttaaagaagagagggaaggaggaagygaatttattgtttagtaygagtygyggagyggtttaatttagagygggtagttgyggaygagttggagaggaaggtgattataattagtgaattagtaatttttgtygagttttaagtttygatttagyggtataatgygttgtgtyggygtttyggggaaaggaaagaattttaaaggtattgagagygtagggttaaaagaaygtttttaggttatttggagtttayggyggtgtatttaagygtygtagttgyggttgttttggtgtgggttgtttatygtgygtaygtttygggyggygyggtttttttaggygyggtgttttatttygggttygggaagygagtygtttggttagtaygtgggttggggaaaagtttgtygagatyggttgggagygtttggtagttttggaattttagyggtygtygyggggttggygaygttaggtaggagygyggagyggygggtgtagttattgggatgtttygttttygttygygagygyggtttttaggtaaggggtgygttygtttatattttttgtttttttaattaattgtgtygttttttgygttttttttayggttattttatagttaagattttttttttttygagttgtagaaggtagaaygttttygggaggaygaagtgattygaagggatgtggtaagygtatttttygatggagatgtagatyg

SEQ ID NO: 6092 - DNA, 419 bp, synthetic construct
  misc_feature 1..419: note = Description of Artificial Sequence: Synthetic polynucleotide
  source 1..419: mol_type = other DNA
tyggggaggygatttttggatgygttttgtgygagtaaagtygggagagygagttttaagtatttggtagyggtgtttttagtaggygtygaggaattyggttatttatttttggtgaattttgygtttattgaggtattygaggtayggatgtgttygtttagtattyggagaygaaggagagagagyggggatatgygttttagttttgttaggttttagggtttttatttttgtatttaaagtttttattttattttatttttygttatttattttttgtttyggttattyggtgyggttttagtatygygygttttttyggtayggttttyggagaaagttttttaattattagttayggtatttgtagtttttgtaygtygttyggtttygtygggtgggtagygttygttayg

SEQ ID NO: 6093 - DNA, 3675 bp, synthetic construct
  misc_feature 1..3675: note = Description of Artificial Sequence: Synthetic polynucleotide
  source 1..3675: mol_type = other DNA
tygygtagtttagttygygtyggggyggtgggtgggtgggtgtttgttatgggattatttttagygttttatttttttygtaaaagtggygttttygttttttyggtttaggtatattygttyggggttygtaygttyggtttagatattagygyggtggagagtatygggtggggttttygaagggtgaggttyggaggygtygyggagggggggttttttagagaggagggggygttgygggaaggtttttaagggaggttgygtttaattttygaygttttgtatttagttyggygyggygygtttagtygttttttyggatttttttyggggygygggagtttagyggygygtttagtttttatttatggtggtgatgatygtgatygtaaagtagaaggagtyggygaatttttattggaygtyggygyggtgyggtttygattgtaggattattagttttagttgtyggtagttttygttgttgatgttgtatttttttttgattyggattttttyggttttgagtttttttttttygygtatttygtggttygattygagggygtygaatayggyggygtttattagtaggtaggtgaaggtgtagaygatgagggatagagttygtaygttttgtttttttatggtygttagtaaggagtyggygyggggggtatgtttygtaggtttatagtygygygygttttattgtagygttyggyggtygtygtygttttttttttygtygtygtygtygtygtttttaagttgtaagyggyggyggtagtagtagtagtagtagtggggaggyggggggyggggaggttggggggggtttttttygttggggtygttatagttatygttatygygaggyggttggyggggtaggggyggygygggttygggtttagtygagaaggyggataggtataggaggttgttygagygtyggggttaggygttygggaatttygatattttgygttagattyggtygaagtagttygttttattgygtagggttatgtagggyggtttygttgggtatygygygggttttgttgtttttygtatttygtttttygttttygygggaaaygtagggaygggaatyggagttagaaagyggtyggagggyggtygyggggttyggtatttttgtgggtttagttygygggtggyggtgtttagtaaggagtttgtaggttygygygtttagyggaatttgtttttttttttattttttttygttttttttyggtggtggggaggaaaagtttgygaagtggyggtgtttttggagttttttgtaagyggggagggggtygagtaggtgtagygggaggggtagttygttttttaaaggttygygygtttagygtttattygggygygygggtgygtagyggggttttygtygggygtyggtyggtgygygaagtttgttyggtttaatttttaaggygygggagyggggygyggttttaggayggtagggatygygatggagyggtttygggggyggtygggggayggygyggtggyggtyggttagttygttttttygggggyggygggygyggyggyggyggygggaggggtttygygggtttygyggagtagyggggyggaygygggygtatgagtygygygggggtyggggtttttyggygttygggygtttygggaggyggtygtygygttggtttgtttygggygttaygtgygtgygygtygttgggagttygaatgtgtgtgtgygygtgtgtatgtgygtgtgtgtgtgtgtgtgtgtgtgygtttggtagtttygtttyggygggagggtttyggggagygggggtygggttaygtygaggtygggttttttttttttttttttttttgtagtttttagggygygttatttttygtttggtttttagttagttggygaggttgttgtggtagttttygttgtagatttagygyggygtagggygtaygyggagggagttygggaggggyggtttgagtygttagggagggggygggggyggagtygtyggygggttttggygggggatgggaggataaaygyggttttttgggtttttttagtttygttttttaagagygtaagtagttttggygggtggagagtttgagggattyggggttggaggaggaaaaygggatttagttagagatggtaggttgatagttttaggtagattgggtagagagtggggagtagaaggggagggggttatgggtatataggagagyggtagtagyggtttaygaagttttttttattttttattttttatttagttattyggygygggagygtgttattggttagggatatggtttygtggagtggtggggtttygagggttgtttyggttttttygttttttagyggtatagttygtttgggttagtatttgtagattygagtygtttttttggagagygttaaggatagtatgggtygttatttttggagttaggatagyggggaaagatatygtaatttttygatttagtaatttttttgttgttttattgaaggaaaaaaaaaaaatatatatatatatatatatatatatatatatatatatatatatatatatatatatatatatatatatatataattattttttgatatatataattattttttggttttttatagttgggygtaaggtgygtygtggatgtagttttgagttaygygatagttttttygagattatttggggtaggaataygaggttygggttggggygtatttattttttgtttttagatgagttttttttaggttttattttttttttattttggttttttttatttttttttttttttygttttttttttttaggttatygaggggtttttttttgattttyggttttttgaatttygtttggagttttggagttttaaaaggatagatttaagttttagagatttttgggttttttttttttttttgattttagttaaggaagggatggagatgggaaagagttgtttggyggtaggttagtagttggttaaggggtggttggggaattagatttaattttygggtagttygygggttttaggagattagttttttttgtgggtygttttttggagyggtgttygggttttttggttttagggatttygggtttagagggtttgggattttagtgatttatygaggttttttagttgggaygttttgtattttatttttagggattaygggtgtttattagggaaggggagttygygttgtgggttaygtttgagtygttaggttttygttgggtttgygggygttttggggygagggagyggggagttttatttygagtaggtattttttttagatttattttggaaattaaggttttygygttyggtaagtgagtttggttgtygggtgagttatygygagygggygataaggatttttagtagttggtaattaattgygtygtggtttagtttaygayggaattttagttaggtttttygtygttttggtagyggygttatttttgagttatagtygtygggttttygygyggttyggaagtygtttgttygtttyggygttattagggggtattggatttygatttaygyggyggtygygtagtyggtttygttgyg

SEQ ID NO: 6094 - DNA, 3675 bp, synthetic construct; identical to SEQ ID NO: 6093
  misc_feature 1..3675: note = Description of Artificial Sequence: Synthetic polynucleotide
  source 1..3675: mol_type = other DNA

SEQ ID NO: 6095 - DNA, 3378 bp, synthetic construct
  misc_feature 1..3378: note = Description of Artificial Sequence: Synthetic polynucleotide
  source 1..3378: mol_type = other DNA
gygagygyggagtyggagagtygggagtataggyggtygygtygygttttggttyggttygggttygygygttagtatygttygtagygygggtattyggatttttygggygttyggggggttttagtaggygygggggaaygggagggggtttgygtgygtyggygggtgttttttagggggygtttyggygaggtttagagygggtygggggyggyggyggttggaggagttttttttattttyggtygggygttyggtttagtygtyggygaygygaggygttygyggggatttgtaattygtyggatygagttttygtyggyggggtygttgttgttggggaaggtaaggaaggttttggyggggggttgggggygyggygggtgggggygtagygagggtgggagggggtygggggaggggygggygtttagattttttaatttygtygtttggggtttygtagtttygaggttttgygtttagagtttaggagtttggatttttattttttatttttttagttttttgttttttttagyggtggygatggaatgtggtaggttttygygagttygtattgggtaggttgaggagggggygattttggaygtaggagaggtttttyggygtygtygttttttttttatttatatattatagtttggtatttttttttattatatgtatagggtaggttggggagggygttttygttgtatttttagtatatatagaygttggygggggtttaagggagttttttatggtttttaatagttatatatagaygtagtaggtttyggagagttttygagygtgttttttttttgttaattaygtttagggttttttatagatattgtaagggttygagaygttttttttttaygtatagagttyggggtaggtaggagaaaattttagattttttttygaagttttygttygtagaagttttygtttgtagatttggtattggtagtggagattttttggaggtatttttttttatttygggyggagggttatttttgygttttttatttttaygygaaygtttggtttttttttttttgtttatttttttattgggtyggataggtygygyggataagtygtttttaattttgggtyggttttatgtygttttygttttaagygtygagtattttygggygtygagtattttygggttygygtygtyggtgagtagaggtygtyggttttttatygtygtygygttagtttggagtygygyggagttgtttygaggaaygagtayggttttygtttttttttggggaggttgggagttttggattyggttaggagttttttttttaggttttygyggttttttgggygaggtagagagttttttyggtttygggagggggyggyggagttgagaattatygygaagygatgygatygggagggtttgayggaggttgyggtttygagttygygtttttttttttggtygyggyggtttttgtttggttatttttyggtagtttgaagagaaygtttaatttggtattttagttttaggtygttgggtattttatttttttttatttttattttgggtttttaagttttttggagygtaggygtttaggttgggattygaagagttttaagttagtttttttttagtattygttttygtygygattttttygtttttttttygggtttggggygtagatttttgggttgtaatttyggagtagttgaaaggtaggaaggygtgtgggygggtagggggtttgtattttygttttagaggagtygtttgtygtttgtgttggggagggagttgggaggtttgttttttygttttattttgggaatttayggagattttyggtattttttttatagatataaatataygttttttyggagygagagtygtygygggggaatagtagaggtygygygggyggaggygggggaaaggggagttgggttttttttttatttgggagggaggtggtatayggtgtgtggggtttggggaggygattgttaygttttttagaatttttatgttttttattygtttgygatttyggttgtygaggaggtaaygagggaggtygagtygttttttttygtgggyggtagygaaattttgygttygtaygtyggggtgtygtygagttyggttttgagtatttagtaaggttaagtaggygaaggagggggygggggtttttgggygygttttygttygygtatagtyggggttttggaagggggtgtgygtagttygtygagttagtttygttygtttgtygttygygttyggttttyggaggyggaygttgygygygttyggggatttyggagygttyggygttttaygtttttttttyggttygttagttgttttttggygttgtttttagatttgttgygtttygatttggggggtagaaggttggttygggagattyggyggttgagggtygagtygygaagtttagggatgygttagagaggygygyggtttygygggtgggygttgygttggggggttygagtttggggtttgtygttttygattttagggaygggygtttgtttttgtyggggtttygygtaggggyggatagagggygattygtygtttyggttttaggtagtatttattyggatttygggttagggagggggygtagttaagttgtggagttttyggaggtttttttttttttygtaggtttyggtttttttyggatttyggtggtygygttygtgaaatggggaygygggttttgttttyggattttttttagttttygatttttygtatttgtttygagatttaaygtgttyggttygtagygtgttgggtttgyggygttagggtggttygagtttygagattatttgygtttgyggatatagtygyggggtttggtatgaagggttttagggagggtttagtaagygttyggggttygagtagttttttgyggygtttttygttttyggtyggttygatttygttttygggagtgggtygtggggygyggagttygtttttyggggaygtygyggggttttaggtttaggyggtyggygyggggtygtagtggyggaaggyggagggtyggygygttgtygttgattgtygggagagggygttygtatygygttygygyggttttgttygtttttttygtttttttygygtttggttygyggtttyggttttattttgggtagtttyggtygttatttttttttygttygttygttygttygttygttygttygttygttgttygttttygtygtygggtttygtgaygygtttygygtttyggtyggagtttttttygtyggttyggttyg

SEQ ID NO: 6096 - DNA, 1108 bp, synthetic construct
  misc_feature 1..1108: note = Description of Artificial Sequence: Synthetic polynucleotide
  source 1..1108: mol_type = other DNA
gygtgtttagatgaaaagyggggtagtygyggttygtagatagygggyggttgggttagatygtagagggaagtttttagyggtaagttttttygyggggaaggttgtgtttgttttaggagatgagtygtaggtattaggggtgatgaggttygggggaggtggatgtgggggatggagyggttttaaggtygttagttttagtyggygttttgggtygyggggtyggagagtttyggagyggattttygtygygtttygaattygtttygygtttttaggttatattyggttygtatttttttygttttaygtgygtttaygygttttttygggtttttttttttttttygygygggtygggggygygggtttyggaggagttgggggyggygggggygyggggygggygattgtygggtttygggttagttttygtttttygtttygttttygatygttyggttttttygttyggygttttttygggttgygtttygyggtttttggyggyggyggyggygggygtagagygyggtatgggygttygggtygyggggtttggyggyggygggyggaygggygygyggttgygggygtaggtgyggggyggygggtyggggtyggggtyggggygyggagtygtygttygggggtyggggygttygygttttygtygtygttgaygtttygtttgtttttttttygtgtttygttygtttttagatttttttttttygttttttygtagttygggttttggtygtggygyggttgtygtayggtgtttttygaygtttttyggaygygttgtttttgtgatyggttttttattttygttattttagtttagtttagygtygaygyggtgagatttyggtygggtyggygggaggggygtygggtaggggygygggygggggttgtyggygggtttgygggtggggagggttygtattygttttgtttyggaggggtygttgtggttygtagtygtygtggtttggttyggtyggyggggtttatgygtttttggagagggtgggtgggygtygagygggtggtagtgtggagttggagaygggtttgggaggagtygggattttyg

SEQ ID NO: 6097 - DNA, 1700 bp, synthetic construct
  misc_feature 1..1700: note = Description of Artificial Sequence: Synthetic polynucleotide
  source 1..1700: mol_type = other DNA
gygyggggtgggygttttyggttttttagtttttaattttttygygtattygggaygggtgaaggygtttagttgtygagtatattygygaygygggtttaaatttygtyggtttttaggtatttttatttygttatagygygggttgttttttttttttttttyggaggaattttttaattttttagtatttatattataataaaggaggttyggtttattaatgygygatygtagtttatagggatttttaaygaatttyggtttagagaatgtatttggtygtgttaygygygattttygaggggtaggyggaygggtttaggygyggataaaggggtttttyggggygtttaagttyggggygggaygtygggagyggagttggtygggaatttattttygtagyggttyggttgtgtttttygtggagtagaagggyggygggtagtagtagtagttagaygttgagtyggggttttatggtggygygttygaggyggygagggayggttgttyggygtgygggggtygyggyggatagttagttttyggaaggtyggatttttagygttaygtatygtttygggtgyggyggttttaagyggagatttgagygyggygggtygagttttttaatttgttggygttgttttttttttttyggyggtgygygggyggygttttaaaggggaggattttgyggygygggtaagaggyggygggagygygyggttygggagtgtggttgtagtgygtygggatattagggtttygygtttygtatttaagaggttttygygttttaatttttygygttygygygttygyggatttaggtygaggatygaaaggggtygttygagttttyggggtyggygtttagagagtttagtaaggtyggtygttttgtyggtgtgtygtyggygggtgtttttggaagggttaatgygttygggtagtagtttttgaagtygagttygaggtgagagygattttygagyggygtttagattttggttygagagtatygatttggagygttttgtgtaggttagggttgtaygtttttttgtttgggagtagaaagggggagggtgggagagygaagatygagtttttyggttaaggagtatttataggggtttaaygggaggtttttttttttttygggtygtgggggggayggtttttyggttatttttgtatgygggtygygtatygygttgttttygygtttygyggatygagatyggyggtgaggatgggttgttttttttattttgygttaaattygttttgtttgtygtttttaggttaagtgggattgatyggggtttagagtggaygaatygttagtatggggagagattagygygyggtggtyggttttgttttayggyggtaagygattttttgtttggttttygtgggttaygygygtatggatttttyggtgtaattttyggggattgataagtygggttygtaygtttaygttttttttttttttttttttatgtaggtggttgttgttggggatagtgatygtggggtttttygtttagagygttttggyggtaagttttggttttygygtttggatttgygygttygagagtggttgggaygtttgagtggttttggagaaggtagttygttygtgygttttygagtgtgtgtgtgygtgtggatgttyg

SEQ ID NO: 6098 - DNA, 692 bp, synthetic construct
  misc_feature 1..692: note = Description of Artificial Sequence: Synthetic polynucleotide
  source 1..692: mol_type = other DNA
tyggygattyggttatttttygagggttttaggygttttatttaayggtygtttttygttttttgttygttattttttygtttttttaygaaggygygaaygttttagattttygtyggttttygatagtatttatttagttttttttttggagattttaggttgtattttgggatagaaaagaaggygggtaygatygyggtgtygggttttattttagtygtttttttttttgagggagttaggygggagagaggggaattatygaggtttyggttttttygygttttagagyggtygggygagttttattttyggtttgtgattygttgatttgtttttgttttattagtygggyggtgaattggattgattggtgatttttggtattaggtttttttatgggtatyggagtaggyggataggggtggggtttygygagygatayggaagggttagtgtggyggagyggattttgtggaggyggggttattgtgtttttgagaagggttttygggggtggagtttattaaggttgygggggygtggttayggagyggagttaataaaagyggggygtgtayggtygygggttagtgtttatgaagggygaggggtgtggttatagggygggatttaygaaggatgtaggggygaggtygggtttttgtaggatgtgyggtygygggtyg

SEQ ID NO: 6099 - DNA, 1924 bp, synthetic construct
  misc_feature 1..1924: note = Description of Artificial Sequence: Synthetic polynucleotide
  source 1..1924: mol_type = other DNA
tygtygtttgtttaatgttttygttagttttgtyggtttttatygtygtttgattttattgtttttttygtggtttttgttgtttttttaaattgtttaaygatygttatttagtaaaaatgaatgaaayggggtygtgtgatttaggtagtttggagatgagattttggaattataagttatattttaaygtataaatygattttattygttttggatattygatgtaygyggaatgggygttgtaaaatgyggttgtttygtyggaggtatttgtttgggatttgttggtagtygtyggttttttttgtttgygattttyggtttagtygtygggattttggtgtatttgtttttgggygttttttttattttttagtggtygttagttttatttttagtttgtggtttyggattygtyggtttgagygttygtagagggtyggtygtygttatagtttygygtttyggttttygygttttttggattttygttttaggtyggygtagtttagtttttygggtaggttttaygttatyggggtttagtgygyggygaygaagyggagagttgtgtttagatttyggagagaaatttyggtttygyggggyggygyggggyggygyggggttyggagttgtttaatttygtygtttygggaaggyggtttygggttygtagggagtttyggggagggttttyggtttygtyggtagyggygtygaggggtgtttgggtttttggggatygygagaggaaaaagaayggaaatygtatyggggaggaaggaygygtagaaygttttygtgaagyggggtgtttyggttaggygtgygygggagygyggttygggggagttyggyggygtygtygygygtattyggtagaggtttygygggagaaygygtagttyggggygtggggyggggaattgttygygygaggttttyggygygtttgggtttyggygagagtaaagygygttttggtatygggggyggyggygtagaggtygggaggaagaaattygggttttggtttaggtygggtttttatttttgygattygygagaggtttaggygggaaaggyggygagtggygttagyggtttygaaagtaaatttggttyggtgttattgttygagggtygtygggygygttttttaattttttygagtttggaaaayggagattttygtagygttttttttagtgygtgttgygagtgttgaaggaggattyggtgtttggaygattyggagtaggggaagtattyggtygaygttgtygttgttatyggygttattggygggtaggatagtggggygggtaaggggttttttygygtttttyggtttttygygttyggygttagttttttggtttttttttttgygtagttttaggtttagtttttagttattttttaagaagaygatttygagggtygaaggtygtttttgatttttgattayggatttttygtgtaattyggaagagtygtgattttaaaattyggtttyggggttatagaagttygagatttgggaggygttygggattttttttttagaatygtagggattyggtttgggatttagggtgtggtttttygttttgygyggtygggaaggyggtygggttyggttatygygttaagtattgygtatttttgggaygygtygttgyggggggttggggggttggggygtttttaygaygtttggtttgttyggttagtgtttggtgtygttggtgggttygtggttgygaygggtaaaygttygtttygygagtygggtaaggtaatttttgygggtygygttygaaggtyggatttttttaagtygtttgggagtttttaaataggtggattygaagtttttgtttgatyggagaataaygtttaatttatttygtyg

SEQ ID NO: 6100 - DNA, 1991 bp, synthetic construct
  misc_feature 1..1991: note = Description of Artificial Sequence: Synthetic polynucleotide
  source 1..1991: mol_type = other DNA
tyggtgtatygtgttttggtaatygggttttggygttttygagagyggggygaggggtgttaygygatttttaggtygttttgtatttttyggtgygtttgtagggattttgtagtaaagttttggatgtttgtagtyggtgtaagtttgtaagtagttggagagyggtggttggagtyggggggyggtgggygtggttaygtttttttttaggtagtttygggaatgttttgaaaagtattygaaagttttgagtygygygygygttaaaagaaaaggtataattttttattatttygggygtggygtgtttagatttygttattttagttgygttttyggttgtagygtataygttttttgygttttttttttyggagygtygttgttygtygggtttatttttygtagtagtttttaggygagagagggggttagagtgttygtattttttttaggggtattatgtttaaygaygaggtatttagtaagttttttatatygtyggaagttttttaygttttyggggtatygtygtagggtagagtygggggttttggtaaagygtttggggygttagtgggggyggttagyggttygagygtygggggtagtagtagaggaggyggtttyggtttyggggygtyggatttgggtgtygggagtaagaagttttygyggttgtttaagtgygtaygttgtaggaattayggttaygtttygtygtttaagggttataagygtttttgtatgtggygygattgttagtgtaagaagtgtaatttgatygtygagaggtagygygtgatggtygygtaggtgggtgygggygtgygggagttygggtttagttttagtttttttttttttttttttttttagatggagtttygttyggttgtttaggttgtagtgtagtggygygattttggtttattgtaattttygtttttygggtttaagtaatttttttgttttagttttttaagtagttgggattataggygtatattattatgttyggttaatttttgtatttttagtagagaygggggttttattatattggttaggtyggtttygagtttttgattttaggtgatttattygtttyggttttttaaagtgttgggattataggygtgggttatygttttyggtggggttygagttttttgaatgaagtttttttagtatggtygttgttatgygggttttgggttgtggagagatgyggyggtatttgtygatagyggyggygtttggggttttgggttttyggttaygttatatygtyggtttgggagygtyggagaygygtttgatttygttygtygggtagagttgygggtttygttyggttyggggttttttaygattttttattttgtgtttyggyggagttgygggggttttttttgttttygggtttttgagatttttgatttygtttttagggtagggaatttyggggttygtttttttgggttttttygygattttagagttygygttttaatagaattgggagggtttattgygttagaggagtttttaggattttygttttygtttttygaggtgaggttagaggggagggttygattttaagggaattttagggatttttagtttygtttttttagtagagaattaaggaatttttttygttttggggttttaaaaattttygatygygttttgggagtagagggtttyggggttygattttttygagygtttttagaatttttgattttttttttttgttgagttgtatttaaattagaaaggattttggagggyggtagygttggttgttaggttagygggaaagggaggttyggtyggttgttgtttaygygggtaatttgtyggaaagttttgtttgtttttttggaaaagtygttgtaatggatatagygttgygyggtttttttgygygtttggggygttttttgttttygtttttygtggatggaggttgagyg

SEQ ID NO: 6101 - DNA, 1667 bp, synthetic construct
  misc_feature 1..1667: note = Description of Artificial Sequence: Synthetic polynucleotide
  source 1..1667: mol_type = other DNA
tyggggtgtaatygtaatattttygtaggttygagttttttyggagttgagtttttgyggttaaatgtygggataaaagyggttttgggttyggaaaaaygyggttagatttggattggagggaggagaagagagagaagyggagyggttattttattygtttataggtatttttatttttattttygttggtttttttttttttygtttygygagtatygtygygttttggagygtygtagtttttagtygygggttggggtagyggagagggtttggaggagggggtygygagygttttygygagagtggtttggttgtaggtggtaaggaaggtgaagtgtaggtattygaggggygtaaaggaggaggaaggygtggggyggggagtgtaaggagatagggattttaggggygggggtggyggtgggaaggaggaggggttgggggagggyggyggaggtgttgggttyggtyggtttaygagggagttgtagaagagttggtttagattttaattagagttgtygtyggttttttgtagtygtygtagygttttygygaaggaggaygtgtygattyggttgygygtttaaggtagaggttygygtyggygttggttgggygtgagttgggaggtygagttgtgagygygaagggagttggagagaygattgyggtattttyggtygtttyggagtatataygattatyggggttgygggattaagggtygygtygttyggaggtygtttttgagygggtttygtagtttygtygtttagygttttttggttttttttygtagttaggttgttaatttattygggagttyggggtatgaayggttayggttttttttatttgtatatgggyggttyggtgtygtagtygttaygggygtttttgtagygtaygtttaagtgygygygttgtygtaattatggygttttgttttggtttaagggttataagygttattgtygttttaaggattgtatttgygagaagtgtatttttattatygagyggtagygggttatggttgygtaggtggygttgygtyggtagtaggttaaygagagtttggagagttttattttygattygttgygygttttgttagggttttygtygtygggggaygtygtygtygtttygtagtygtygttagttttttagtygtygtagtygtagtygtygygttttgttgtygagttggtygyggtygtygtgttgygttggattgtygagtygtagttyggggttttgtaggygtagttygttaagttaggtaagagygtttgaggtgygggagtttggtygggygygggggtaatttyggagtgttagttgtagttttatttgggaggattggaggtaaagttttgggaygtgggtttgtyggggtttttttttttatttttygttaggtyggggttttttttttygggagaagtyggttgagtttggatttagygygagtggtattygygttygtagggaaggygttttygggtagttaaaygaygggattgtgygttagtatygttaggtgtttttttaggttgaagggttyggaaygtgttagattgagtagggagataayggagttgagataggataaaattaaaatttaygtgygtatatttattayggtggggtyg

SEQ ID NO: 6102 - DNA, 433 bp, synthetic construct
  misc_feature 1..433: note = Description of Artificial Sequence: Synthetic polynucleotide
  source 1..433: mol_type = other DNA
tygygagataaatggtgattttttttttgtaggtatygttatatttygggtttagattttggataggygagtyggttgtatygaaggttyggtaggyggattttggyggagygttttagagagaagagtgtagatygygggaggyggagggttttttgttagygtgtttyggttaattagtatttatatygtttgataatyggttaattagaggaygtaaagtttyggggtttgagyggatagtattaggaaggggagygtagtttgtagattgaagttagtggygttgygttgaatgtaattgygygygttygtygggtgagttagygatttgagttaggygggggyggttygatttttttygtttagtttgggttagaggaagtygaaagyggttttagtaaggtgaggygttygaggttgtagaagatyg

SEQ ID NO: 6103 - DNA, 896 bp, synthetic construct
  misc_feature 1..896: note = Description of Artificial Sequence: Synthetic polynucleotide
  source 1..896: mol_type = other DNA
aygaggattaaaggtaygaatttgtttttaygttayggttygggatttagggtgyggggattaygyggagygtagtagagtttagggtaggagtygggaggtygygtaggtagagttygggtagggyggaggggaggtygyggagggtygggtggaggtttttatygttagttttaaggtttgtagtatttttttttggtttttgtttttagggtygatgtgttttygagygaagtygtygtgtttgggtagaaggygttttaggaggygygaggttttagtygyggygttgttttygtygttattgttgttgtttyggtttygyggygtttagtayggtttygattttttagttaggyggyggtygttttygatttygyggtttaggygtagtttttaygttttggtataggattgtatggtygyggttatygttttttgtttyggttygtaagggttagtygygtttttggttttttttttggtttyggtttttygggtggyggttgygttyggtttggagtttttttygttggatagtyggtyggatagatggatggaygttygygggtaatgaatgggygttgygtttaattaagatattygygtaaagttgtggttttatttaaggtatttgtttygtatattttaagyggygttttggaggygggaggtgggttggggttaggaagtttttggttaatgaaagtagatagagggggagggggyggaatagttttygttttygttttttttttttattttttttttagttttttygtggagtttygttttttttggatyggaggttgttatttttagttttatttatttygaygttggttggtgtygggggtygggaygtttygtaygtygttygttagggtgtggagtyg

SEQ ID NO: 6104 - DNA, 1494 bp, synthetic construct
  misc_feature 1..1494: note = Description of Artificial Sequence: Synthetic polynucleotide
  source 1..1494: mol_type = other DNA
tyggggtttttttaagyggagtattttaaaagtygtatygygtagtagaggtttttaggggtttttattygtttttagtgattayggagyggtttttatttttygtyggygtttggttattttttttttttygtagttttygtttgatttttatgtgattgtaggtaagaatagtttagtttttgtgtttttgtaaagaaygtaaataaaaatgtatattattattatttaataaaygygtaatttygtaagatataaagygttttttaaatatygtttttttggtaatattyggtattttggggttgttaaatygtagataaagaygtttattagygyggggggtgaggagattaagggagagataagattaaygtgtttttattaaygggagyggyggttaaaagggygtyggtgttaggggtgagggayggggtatyggtattaattagyggttygtttyggggttttygyggttaaggygagaaygtaggattaggagtattgttgtttattttttatygtaattygtatatttygggattaygtaayggyggatggggygttygggagyggtttttgtaggggagagtaataggttttygygttttggaggtttggtttgygtttygggtttttaggttaatattttatttttagtttttygatattaagattgtgtttttttgggttaaggaaaaggaaaaatttttaaattttttagttagygagagtaaaagaaaggggtggygggggtgttgaaaggtttaggattatttatygyggggttggggggagtggagatttgygagtagtaaaggaaatttttagattttatttttttaaaaaagttatagtagyggttttygygaagygtygggtygygyggggtggggtaagygtatygttttatygttttayggttygtygttatttttatttttatttttatttttatttttattttygtttttatttttatttttaagygtygagtttagggygttygygtatttttttygtyggygygygygtagggygygggggygygtttyggtttttgggtyggggtttaagygtygtttattyggttygyggygttygtttagggtygygaygygagggggyggaggattggggagtaggggtygtyggggtttttggatgtttygtttygtttaygtttattgtttttttttttgaagtaaygattyggygaggagtttyggattaaaaygtatagatatttaygygtgattgagaaatttaatttygyggtggttygaygttagtttagygtttygtygygtttttttttttagygygygtygtatttgygtygatyggggttgtygyggaggyggtggyggggtttaggttgttggggttgtygtgaygtttgygatyggyggggyggygggygygttttggttaattaggggaygyggtygagtaggtttgtgyggggttttaaattygtttttgggtygttyg

SEQ ID NO: 6105 - DNA, 828 bp, synthetic construct
  misc_feature 1..828: note = Description of Artificial Sequence: Synthetic polynucleotide
  source 1..828: mol_type = other DNA
tygygattttatyggggaaatatygyggatagtygggttagtagygttyggagtttattttaggtttttaaatttgtagtattttttagagygygygygttyggagygggatttgtttgttttagtgtaygtygyggagygaattatygggttggygggggtggaggggtgtaggygtgggggttgygggtygttygggttttgggttttttttgtygtygtygtygtttttygttttyggttaggagtygygygtgaygyggttygtygtaggagtttygaaggygyggygtyggygagttttttttyggtaggygygtgggtggtagyggttaatttgatagtttttygggtygggyggttagygyggaggygttaygttygggtygggggygggttgaygtygtygtygtygygggaggagggataaaggggtgggttttygygggtyggtatttyggyggttgggttgygggttagagtattgttyggtggtgtttaggaggagtaggagtaggagtagaagtagaagyggggttyggagttgygygtttaygygggatttgtgttygaaatgtyggtgygaggagatygygggtttttatttyggygggagttgttaggttggtttygygtaagtgtttttttgtgtygygyggttgggaggagggtygtgagygtgagygtgggagygttgggggttttgttygygtgttgttttgaagttgtttttygatgygtygtaggaagttgggatttttttattyggaygtgggaygtaggggaggggtaggttttatygttygggttgatgattygtggttttyg

SEQ ID NO: 6106 - DNA, 2705 bp, synthetic construct
  misc_feature 1..2705: note = Description of Artificial Sequence: Synthetic polynucleotide
  source 1..2705: mol_type = other DNA
tygtgtttggtggttygggtggggygtagttgygggaaatgtattyggagttgtgttttttttyggygaatagtttgygttattygtygtatygggaggtggttgggggttgtygagygagtggtgaaygygatgggtggagagygttygaaaygaggtggaaaagggggygggggygaggtayggygtttttttgttttttttttagttatagaygyggyggyggyggttgagttttttagtttyggttatgtgatagtttygaagygttagttgygggggtttyggygtttyggggattattataaaaygtagttaggagagygygtygttgttattgtygtygttttttttttttaagataagttygggagaaaggyggtagttgyggygyggayggttgagttttttyggttagtatttatttagtattygtagaygttttttttagttygtygttygtttttagagttttgygttttatattttttagtagaatttgygggygttgtygttttagaaattattaaagttttttttttttagygatagtttagggttgygygttttttttaatttyggygaygttgygagtttyggagaaaagagaggygttttagaagttaattttttttttttttattttgattttttattttaggaaaaggagaattttagygyggtttggttaagtgtttggttaggggtttgygtttagggtattggaagttttgttgttattggtttttaggatagtaggygtaaatttagatttaaagggttagagtttttattgtttagattttttttttagttattttggtttgggtttttttyggatttagaaaaagtaaagaggtygggaggaaatayggttttttgttatttttttttgtagttagttttagtatttagtttttggttattygggggaagaygtagagaaggyggyggtaaatttggtgtatttygttygygattgtgygygttagtyggtaatygtyggggttagaagttgttagttttygagagttgagtaggttygaaaggttaaggtyggagatattaggtaattyggagaaggtaggagagagaagtagagagggtttggagggygagagggtaaagtggygggattggaggggtygagtgggaattagtgggggtagttaggttttaggaayggagtgyggagagattttgtggtttagtgygggtyggagggyggtggaggagtygggggygatgtygyggtyggggaagagttygtatagygattaaaaatygttttatttttatatttygttgatygttatggtaatttagtattyggtygagaagatgttgtygttgagygatatttataagtttattatggagygttttttttattatygygagtatatatagygttggtagaatagtttgygttataattttttttttaaygattgttttattaagatttygyggaggttygattagtttggtaagggtagtttttgggygttgtatttygattgyggggatatgttygagaayggtagttttttgyggygtygtaagygttttaaggtgttgygygtygattatatttatttgtaygygggaagtattaagagygygtygggygtyggttygggagggtatttttatttttattattattattatttttattattattattattattaygttgtygtatattattattattattattatttattttagtygtygtygtygtygttttygtygtygtygtatatggtatattatttttattagtaatygtttattgtttygtagtygttttygtatttttygttatagttttygtagtaatygttttagtagtygtagttttagtagtygttttatttyggtaagatgtaggaggyggyggtygtggyggyggyggyggyggyggtygyggtagtygyggtgggtagygtgggaygtttgttttagtttttattttaygggttgggttyggtygtygtygttgtygtygyggtygtggygtttaygttaggttttaagtatttttttgttattgagaatattattggtygggattataagggygtgttgtaggttggagggttgtttttggygttygttatgtattatttgggttatttygtgttyggttagtttggtaaygtygttagtttygtgtggtygtaygttggygttatggattyggtggtygtygtygyggtygtygtagtygtagtyggagtttttgtaggttyggagtatggggttttyggggtttyggttaagtttttgtgttattyggtaagttagagtttgtttgttatgtyggtgtttattaagtttaygtttgygttgtygttygtgttygygttgtagtyggggtttattgttttygyggtttygtagtagttttyggygttatttatygtgtgtttygyggtygyggtttygttygttgtttttttgttggagtttatagtttttatttyggtygaaagtaagggyggttttttgtattyggtgttagtgtatttttaggggattyggygggygtggggagattagyggggtgagagaygtygggttyggaatygtttaaattattygayggggagagggygttttggttaggtygggtagagttggygagttttagtttttgttggaayggaaggtatttaaatagaygaataatttyg

SEQ ID NO: 6107 - DNA, 704 bp, synthetic construct
  misc_feature 1..704: note = Description of Artificial Sequence: Synthetic polynucleotide
  source 1..704: mol_type = other DNA
gyggaatgtgggyggggygtagttggggagtttgyggggaatgtgggyggggygtagtggtgggagggygtaggagtgtgggyggggygtagttgggggagggtgtagagatttgagggtttgaggttgtttggttggtttygtttttagaggygggtgtygygttgtygtttaggtatttggggtttttggtgtttgagtgttttattgtyggygygaatataattgttttagttataggygaggtttggttaaggtgtgggygtatttggggtaggttttgagaggtttagygttyggtggtgyggatagaggyggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyggygttgtagaataaggtggtggtattgtatttygyggyggttyggtgygygtygagtygygattttaygtygttgttttgygatttttatayggygttggtggtygaggygyggyggttygygtttttygaagtggttttygtgttagtygayggtagtttttaggagatgttggattttatgygygagttgtatggygtttggttggygttgtttttttaygatttttatyg

SEQ ID NO: 6108 - DNA, 950 bp, synthetic construct
  misc_feature 1..950: note = Description of Artificial Sequence: Synthetic polynucleotide
  source 1..950: mol_type = other DNA
tygggayggagygggttattygagtggtaaatttttttttaatggatgygggaaaagygtatttgtagttttttttttatygttgttaagygagttgattgttaaggagtgygtatttgtttgtttttaaygtgatagtygygggagygtttygtatttygggttttagggaatgaaggagtttgtttygaattggttttagaatttttagtttttagggyggttygygttygtatttattttgattaygtaggtgatttygggttttagtatttggtygttggygtgyggygtttttygagggggtttgggtagyggttygtygtygggtyggttttttttggyggygtttatggtyggggygyggggygtygagggygtattgtygttyggggyggttaggttgggygygttgtagttgttygagagtygygygttygttygttttygggyggtygaygataggtygyggaggttygagttggagagttttaggtgggatattttgtggagtaggtggtttaggttgtygggtttatygtygggygttttgygtagygtttygtyggatattaagtagggagtygtygtyggggtygygygygtygtygaaattttgttttygtygtygtttatygataggttgtggagaaggttatygatygatgttatygagttatttttgaagyggttatatttggtgygtggaagtatgttttttygtgggttygttgtattygttygggygttgttggtgtyggtttyggygygggttgtygygtatagtaggygagttattgttttyggagygggayggagagtgggggtttygggatagttttttggagaaygagagtagagtaagaggatggtgtttttttatygttaaaagttagtatagyggyggtygygtagtttyggttygggagatygttgtttggggttgtayg

SEQ ID NO: 6109 - DNA, 4861 bp, synthetic construct
  misc_feature 1..4861: note = Description of Artificial Sequence: Synthetic polynucleotide
  source 1..4861: mol_type = other DNA
gygtygtygttttgagtattttgyggaaaatgtgagaattttggggagttattgttgttgtaaggattygygggygggttatygygttggtgggggggttttgtttaaattttgygttttygattttttattygttttataaagggttggtgaagattattttaaggatygtaygaattggttttttaagttttaggaaatygaaataataatygaggyggttttttgttygggttattttyggagygagttttgyggyggatttttggttttygtttttttgggtattygyggtgyggttagatygtttttgttagygattttttggttggtaagggagaggaggtggagtttagattggttttttaygtttagagtggaagygatttttaggattttgtagttatygagtygttygtygtgtttagttygggtttgatggtgaagagtatagttgttttygatagagtyggaggaaaggaagtttaagaagtaattgttygygtttygtttattttgtygagtttatttttatttttatttttattttttgyggatttagaagttgttttatygagttygattgtgttataaaatattttattggaaaaaaagttatygttttygtaagagggggtaggggttttagygatatyggggattyggtttttaggtygagtygaygggttgtttyggggtaattttaggtygttgtggtttgagtttaatygttgggttttygaygtttagaagygggtgtgtgtttggaggtttttyggtygggagggtaggttttagayggggtgggggtgtaggygaggagyggggygtgaataygygtggagygttttgygttayggagtttagggtagagattgtagttttygtygggttggatgygagttttttaggttagagtttagaagygygttgggatttgggtttggtttttgggtttgtgttttttttygtttggttttaattgttygtatttaagattataataaaaaggtttaggaagtaaattttttggaygyggaagggtyggttygygggttttygtygagtgagggggttgygggtggygygggtattttaggtttygtatygtatatygtttttagttttygyggtttttgtygttgggttygttyggtattttygtyggtttttttgtatttttggygygtttttgtttagtaagttgttygttygttggaattgagttttttttgggtygttttttgggtttggtgggagattttaggtygtygttttgtagtatttgtaygggggatygttagtatttgggtgagttagtaygtggattggggattttygaggagatttgaatttaggtaggattaaggagtgtagggtttatatgaggaaatggtggggaaatgtttygggaaatggyggttatttgtttaaatgtygtttggggagyggttyggtttggggagtataagattgttaggaggtttgaaggtgtygygggaaaggaygaaatgttggtttatttaaggggtagaaaaaattgagaggatttyggtgygtattaggtatygagggaatyggggggttgggtagagttttagtggggagaaagaggagagtagttttgtatgtatyggggtatggtttaggaagttgaggggtgggaagttattaggtatatttattatttttttttattttatttttygattttggtattaygtttttatttgtaattggtttaggtttagggatttagtaagatttattttggaaagagtagggygtatttttagtaaggtaagtgattatatttttatagttygttggttttagttttgtatygttttatttgttyggygtggaaaggtatttttgtttttygaagygtttttttaggtttattagttgtagttyggtgaatatagtgyggtttygaygtttttttttggttttggtgtttggttttttagggtttgtygtttttagtttttygyggagttgtaattygagyggtaggtgtggygtattygyggygtygggtagttygggttttgtygttagtaaygtagagtttagttttgaatagtttagyggygttagtgggaatttgaatatygtygtttgttyggtttttagtayggttgygaagaaagagaatgaggattygggtgagttayggtygygtttttttgttttagggattgtygtattaygtgtygygggggtgttygygtttggttagtgttttttagygtaaaatttttaygttttgtyggtyggygtyggtggygtagatggagattttttttaaygttgtygttttttagatttgggagggagtattttttygattttgttygtgttttgttttggagttttttaggttttagttgtttttgagatttyggggtttttgatgaatatgtttgtagttgygagaaattyggagtgtgttttgtttttyggggaaagtagaaattaaaaagaaaayggtagttggttttaagaagatggygtttgttttaattaaattagttttgttgygttagaaaaagaatatgtayggagygtgtatatttgttttttygtgygtggtataatagttatgyggtggttaggagttatttgggtyggagttgggtgtttttyggaaattttaaagtattttgagaatttggaaattattgtttaygttttttatttttagaygtttttttatgtagatgtttttattttttttagttttaaaatgattgtgtgttygttttaaaygaattagtagtaatagagtagatggagaygaaaggtagtygaatggtygagttttagttggatttagaaggagygygttggttttgtygtttttaggttagggagtatygattaggaggtgggggggtgtagggaaggygatttgaagggttggggtttyggttatagygtaggagtttttttttttygataggtttgttattgaggtgygagttttagtttggttggagtyggaaagggtagggtaaggygtaggtaaatgtggggtagaggattygtagggaaaaggtgggagatgggaggtaggtygattttaatgagagaagygagggaggtygatyggtagayggttggaaagygagatagggaaagataagaygagggtggagtgygatggagatagtattattagggtagagtaggtttygttaaattagaagaaagggtagaagttgaaaaggtttgygtaggtygtttaagttttgtagaggtttagtygatttgaaattagaagggatagttaggtagttgtttatagttaggtttttggttttaaggtaaggtygaagtaggttygtattgyggttaaggtygygtttttygttygttggagttttyggggatttygggtyggtttgggttygygttagtatttagttttygggagygtaggttttttttttagaggttygatttttttgggttgggtagtygyggttattttyggttatttttttgyggygaagtttaggygttygtggtttgaggtygtttttatttaygagagttygtagtttggtagtgygtttgtattggggatgtttattyggggttttygggttggaggtygaagggaagtagtgaaggaaagagygaatatttttttygggyggttygygggtaygaggtttggtttttgtgaggtttggagtttgtatttttygtttttygtttggagggtttygagagayggttttagaatttgygtttttagagtagtttttyggggttgtttygatgtyggaggaggttyggggygttttygyggtttagttygttgtttttygttaagttyggttygygatttygyggtygttataygtatttaggtggttgtggaagggtygygtygttagtagygtttgtaygtygaattttagtagttygttygtygyggtagyggyggttgygggygyggygtttttgggttygggtggtttygtgaggatttttttaattatgaagttgygatagyggtgyggtyggtggttygygtagttttygggygggtygaagygygyggygttyggttttttyggtygttgtatygyggygtttattgttgygttygyggtttggyggyggyggyggygayggtttggtttyggygyggggttygygyggggttttaggtyggttygtagttyggggyggygygygggygtyggtttatgttttttttttygtyggtyggtygggyggaggygtagggygygggyggggygygyggggttyggtyggtygaattygggattgygttttttttttaygtygtygygttttttgttyggttagtttygygttatygtttygtttygtttygtttygygtygttgtttttaatttttaggttgagtyggagggagggatttagaagggagggaggyggaagggaggttaaaaaggagggggttaygtgaaagaggtyggtygatygagatygagggagattgagyggagygtaygttttggaaggagagagtyggagagttygggaggtaagatttttagagaygagagtyggagggattaaaygatataggtgagagaaggggtagaggtagayggygtgggttaaataagattttagatagtgatgtgagggtattagagaygttatygagatgtgygtagagagattaaaagaggygtgagagttagygggttgtgaygtgayggagggtatagaggtaggyggggtagaggaagggggyggtaaagaaatgggaatagttagaaaatyggyggtttgatyggtttttaggtagtttyggaaaggtygggaggaggaggggtaaaggtygyg

SEQ ID NO: 6110 - DNA, 999 bp, synthetic construct
  misc_feature 1..999: note = Description of Artificial Sequence: Synthetic polynucleotide
  source 1..999: mol_type = other DNA
gygtaayggtttgtttgygttttttgyggttatagtygatataygttygtagaygtaygtayggatatttygttttttattagygtaygaagaygggaygygygtttatagttttagggttyggttttgtattaygagttaaygygyggtttttagggaggtggygtagaaggtatggygtttttgtttayggygtttyggttttggtagtttttatagagattttygttgatggtttaggtttaaaaggttttttttttygagtttgygtttttttagttttttygttgggttagggtttattattttttttygtyggygagygtgggtttttttggaggygggggtggttttgtagaggtagttttaggtgygygttggagaggtyggttygtygygygggagatattttttttaaagtggaagygttgygtgggtagtagygygggtygggttttyggattttagtttttgttgttttygagattttygtttygygtygtatttttygagtttagygttttygggttgygttgggygtagtggttttyggttagggygtagtyggtttgggygttagagttttttttagttttyggtttagggyggggaagygttagttttygtagtttttgtgaaaggttttttgtgttttttgtttaggtgygygttgtggtatttttggttagaagtatttttggyggtttgttgggtttttygtagtttttggttgagattttgtygtyggygttaaygggttgygttygygttttygttttgttttygttygggtttygggtttygygtgtatattattttttggttttttttattaaaattttttgatttttagttygatgttgtygtygyggttttyggaattgttgtttttagayggygagtyggggttgggagyggtttttayggggayggatttttttyggaggyggaggtggtttttttgaygygaaaggtaggggygygtttyggtttttagyg

SEQ ID NO: 6111 - DNA, 1750 bp, synthetic construct
  misc_feature 1..1750: note = Description of Artificial Sequence: Synthetic polynucleotide
  source 1..1750: mol_type = other DNA
tygyggttttagggttyggygatttttaaggttttygttttaggygttgygggtaaatagggtttgggggtttttttttatygygggttgagttttygttatttgttttttttgtygygggtatttaagtttyggaatttgygagttaggtagygttttattttygyggygtygtttttgatggttattttgtggatttttygtagtttttagttttygatgtggtattttygattygygtatttttggtttatggagtttaggagygtttggtttaggygtttttygaaattgaagagtttttttatggtggygattttttagaygttaattattygttattgagtygtygyggtttttygtggtttttttatttygattaagttttaaattygygatttttttttttatttygttatttatttttaaatttaagatttattattaaattagtaatttatttttaaatttaagatttatttttaatttygygatgtagtttagaattygygatttagttyggtttattatagtttttagtagygatattygtagttttygattttttagatygagtgagtttaattaagtygttattygygtgttagtagttgggygtttygattttttagatygygtgagtttagtaaagyggttaggygygygtttgtagttyggygttagttyggatttygggagtygttttygagttygygtggayggtagagggyggttgtagttygggygtaggygtygttggtttgygggtttttttgggttygygtaggatatttyggaatygtaggygygtattttttttygtttgagggttygtttggtygtgattttygttttttttttttttygaagagagatggggtygttggtaggggtttttygtagttatyggggatggggttgagggtyggtttttgtttyggtgtagtygtygygggtagatygtttggtttggtygtagttatagygatatttagtttyggttttgygaggttgggygygttagttagtttgggagttgtttggygtttgtagttgggygtttaggtggtggagtatggtttgggyggtttttggatygygagtgtttttggtttgagagttygttagattttgtttttattyggttttttttttgttagagttygagatttttagttaggggttttttgtaattatyggggatggggttgagggtyggttttygtttttgtgtagttgttgtaggatagatygtttggtttggtygtagttatagggatatttggttttggttttgagatgtggggagtgygggygggttygagagttgtttggaggttgttgtttgtatatagaaggyggttgtagtttgggtgtttaggygggttggaggtgtatggtttggtyggtttygggatygttagygygtttagtttgagggtttttaggtygtgtttttygtttatttttttatttgagggggattggggtygttggtatgggtattyggtagttatttygtgtggggttgagyggygggttttyggttttgtttttgtgtagtygtygttgggtagaatgtttggtttggttgtagttattgggatatttggttttggttttgygatgttgggagygygagygggttyggaggttgttaggtagttgttgtttgtatatagagggygattgtagtttgggygtttaggyggyggagtatggtttgggtggtttttggaatgygtgygyg

SEQ ID NO: 6112 - DNA, 391 bp, synthetic construct
  misc_feature 1..391: note = Description of Artificial Sequence: Synthetic polynucleotide
  source 1..391: mol_type = other DNA
gygtaggtygtagaattttttygygaaggtgtygtaggaggagtygtggygyggtatygtttygtyggygttygtgttttttygygygygttttyggggttttyggtttttygggttygtatygtygttygyggggttggttgygtaggyggygggtttygttagtagtagtaggagtagygaygtttagattttygggtgttgtyggggyggtygygttattygtgygtatagatttygtagttaggtygttygggtygtagygggggygtygygggygygggtygggattgagttttygtygaggttattagtaygygttygygtagtygyggagtttttygtattttygtttttttgtttyggtttgygtattttygttttagtatyg

SEQ ID NO: 6113 - DNA, 817 bp, synthetic construct
  misc_feature 1..817: note = Description of Artificial Sequence: Synthetic polynucleotide
  source 1..817: mol_type = other DNA
tygggatagagaygggtaggtagyggtgggtygaagggttyggggattagggttygggtygggaggggygggygttttatygyggtttgttggaaggygtttttggtgtaggtgtygttatttyggtaggagatggtagggattttttggaggagtagygygtatttgtgttggygygygyggygggtggagatgtaatygaygygyggtattaygtagtttttggaygagaaggttaygatggttaygygygtggtygtgggtattayggggaagtyggatagtagtttgyggaygaatatgagttygttgyggaagttgatttygtttaygttggaygaattatttattaggaagataagttttaggygttygttgagttttygtagtagtygtaygygtygtyggaaygtttggtttagtygttttattttgtttttygtygtttygtygttaggagygggyggygyggggatattttygggggtttygggygyggtttyggggaagaggyggaagttgaaattgygygayggggatatttgttgaaaggtygtttagttygaaaygagygttagattttagtaataaaaggttaggygaggttatatygygttggagatagagyggttgtttyggagygtaggyggyggttygggygggaagaggygttgggyggtyggattygtagaggggygtgygyggagttgggygyggggtagyggttaagagttttagygtttttttatttgatattggggatagatataatttagattttttagtagttygggaatttyggagggaayggygygyg

SEQ ID NO: 6114 - DNA, 814 bp, synthetic construct
  misc_feature 1..814: note = Description of Artificial Sequence: Synthetic polynucleotide
  source 1..814: mol_type = other DNA
gygaagaaagtygaggygtygaggtttttaaagttggtagtttygggtggyggtgtaggggygaagggggggyggggggaatygtyggatatgyggttttggagttgggtgttgtatttggggttgttgagygtygygttgggttgygggttggtygagygttttygtygggttyggagagattygygggtyggtygattttygygtttygtygtyggttyggttatttgygttattygggyggttygyggtygtygygtttygtygtygtygtygtygtygtygggyggtgtttgggaagtygtgygygtttttyggyggyggtagtagygggaggygaggggygttatygaggagtygagttygtygagtygggygttttattttagygggygaggygagtagttgygttttygggtygatttygagttgtttygggaygygtttaygttgtaagtgtggttgygagyggaggggggttagaggttttyggtagtgattataggtaggtgagggygtttyggygggygttgtatygtttttgyggttttagaggttygygggtgtttgggygygggtggygggygggtygggggtttgygggygtgtttgtgygagagttgtttygygagyggygtagagatattygggygagttgagagttttattttgttttatyggtggaatgggtatattyggaaggygtagttgttttatttttgggaggaatttggggagtttttttggyggtttygyggattttyggttagtgagggttggttttyggagtttagggtaygtaattygtgtttyg

SEQ ID NO: 6115 - DNA, 1429 bp, synthetic construct
  misc_feature 1..1429: note = Description of Artificial Sequence: Synthetic polynucleotide
  source 1..1429: mol_type = other DNA
gygygtataatgaagtagttgtttgtagygttaattagttggygattttgaggttattgygtggttttgttttggtygtttttaataaygggatagagygtygggtatygygtattgattaattatttttttttygyggtygttyggtttttttttttttttttygtygggtttggttttatttttttygggyggtttgygtttttttttttygyggtttyggtttygtggygtyggtagtttygggagtttygggaagtttgygygyggtagtttygtagtyggtagtygggagtttygtagttttyggggagygtyggggttggtggtttttttgttggaggaggygtggagggagygtttttgttttgagttagttayggtggtyggttggaggttgttattttattatgygtygggtttgtttgtttgygaggaagtagatggtggggaggtaggtagyggygagagtggttagatttgaatttygtttatttgttattttttataaaaggtaggttygggggatttaggtattygttgttattttttgggggagggggaggtygaggggtygtygttttyggygtttgygaaggtttygtatttgtyggtgttygttttttttattttttgttttttttttggttgtagtttttygtatygygtaaatgttatttaygtgttaggatgtgtgtttatagtttgtttttttgtttgtttagtttyggyggatagggtttagyggttgygygaygtttttygtygttgggggagattagtaaagttattygtttttggatttyggggtttgggtttttagatttygtttygyggygggagatgygtttgagttttttatagayggagygygttttagtttgaygtagagggatgaatagataagygtatygggygggaatttygattgtttgtgtatttggggtyggtttagygttggaygtgggttgttggttygagaggtggygayggaatygygtgtttatatgtatgggggagtggaaagtygtagggtgtgtttttaygttttttgagtagttygyggtaagagttgttgagtattttatttttygtttttagattttaaggtagtttttygagttttttaaaygtattgtatttagttttttygagagtggagttgtattaaggataaatattttagygttattataaattttttttgttttttgggygatttttagatgaattttggtgatttttagattggatttttattttttattttttttgaaagaaagtgttttagatgygttaataaaatatgtttatgtattygtgtaggygttygtatgtttgygygtyggtygtgtgtaggygtygaagtataygtttgtgtgaatataygggtaygygygtttttgggtttagtggtttttttttygyg

SEQ ID NO: 6116 - DNA, 7708 bp, synthetic construct
  misc_feature 1..7708: note = Description of Artificial Sequence: Synthetic polynucleotide
  source 1..7708: mol_type = other DNA
tygggaagagygagaagttataygttgggttgtagattgggttttagygggtttggagygtggatatgttggttggttttttttttygggagttatagttttygtyggtttygttatttaggttttgtygggtatttaggaggtttgtayggtygtttgtagttygttgtgtagagttygggtygaaggyggagttygatgggaaayggtyggtygaaggtttttgtaattttgttataggtttgttttttygggttttttaggygggtgtttgaggtygyggttttaggtygaggggagatygtagtgagaygagtatttttttgttgygtttttttaggatagagggtttaatttttttttttgaagatatygtaggaagttgttygtattttaaaaattttaaatttygygtttttttttttttttgttttttttttattttygttttttagtttygtttattagtttttattatttygatttttttttgttttttttgtttttttttttttttttgggtttttygttttttyggagtaygygttgttagggtttggggygtygagyggttaatggtayggyggtaggaygtgatgttaggygyggttgtagaaaaggygyggaggtttgygttggygyggattgtagagtyggggttgggttaggygygygtttggagagtattgygygyggttgggttygyggtyggyggtttttttttttattttgtttttttttttttttttttttttttattttttttttygtttttttttttttttttttttttttttttttaattttttyggtggttygattyggttygtaggtttyggagaaatttttattttagtygtygatttagygtttaagagggtygttttgggttgggggygtattttagggaggggaggggtttaggtagttgggtygtygyggatatttagyggttttagggtgaatttygatygtagtygtygtygtttygggtagagtttgygtttttgttttgygtttygggygttgaagtygggygggygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggygttttgtttygygagygttyggggttyggagttyggtttgggggtttagtygagttygggyggggtyggggtygyggtggygatgtatygggttygttagygttaggagygttaggtagttgaggyggggggtaagttttttttyggaggagtygygttttyggtttygtyggtttygtygygatgttgttttatagtttgtygggtttygaggtgtayggggttatygaygagatggatygtagggttaagagygaggttttygttattagtttygttatygatygyggygatatygagayggtaggygygyggttgtggggtyggggttgagagttgggatggggtygggttagttagygtttttgtttttygaagtttggggagygtttttygtgtygtaygggattgggtgttggggattttyggttagaatgtaaggtyggtggttttyggttygggggaaattyggttgttgggaygtagaagggaaataaggttgaaatygaaatttyggttttgggggtagaggagagygtttttttygaattggaagygaagttttattygyggttyggggyggttttttttttattttgttyggtgtyggggtygatagtttygygtttttttttatttttyggtttyggttgttggyggygtygygagyggygttagggaagggygaattagttgggagtattggggttttagtyggtttgggtygtttttagtttttyggtaatyggggattttttttaatttttagygtagttttagaggtygaagttttyggggttaatatttgtygttgatygygtttttagatttttgattggttagatttagttaggttagggttgggagtttaggtttyggtttggttttygtygaaggagattttatttggatttttatatttggtttygygggtttagttttaaatagttagtttttygttttaggtttttttgggggttagaygagtagatattgttygattagygggtttagaagtgatttttaggaggtygyggaggtggggagtaygggagaagtttttttgtttygggagtaggagtagyggygttagtgttttttyggtttttgagygttttttyggttagattttttttgttggttagtttggatagggaagtatttgggttgaatttgttttttatttayggattttgagggtgtttttgtattttatttattttattttyggatttaagagggttttagttygtgtggtagaggagttagaagttggttgatttgttttggttttaatttttggtttaaggatttagggattattggagttggggtttaggaatttygttgtttttttaaagaggattttgtgtggagggtgatttaatggttattttatttttygggtggtttatttaagaagtagtttagggaaagtttttggagggtttgattggagtagttgttttggtttttaaatatagttygagtattttgggggaaaggatagggaggattggaaggaagagaggtaagtattagagttatttaggttaggagttyggtttgggttygtggttggygagggttgygtaggtaggtttgggttttgaatygtttagaaatggaaatgggttttttggggtggggggaagygygtygtatgttttggtagtttttttygygtttagggtagttaaggttatagagggagttgtgggtgtyggtttttyggyggyggaggggtygttggttgaygtaggygttgttgtttttygttttttttttttygtagattatgtygtttattagtagtgatygygtygygttgtgygtyggttgygggggtaagatttyggatygttattatttgttggyggtggataagtagtggtatatgygttgttttaagtgttgygagtgtaagtttaatttggagtyggagtttatttgttttagtaaggayggtagtatttattgtaaggaagattattataggtagtttttttatttaattgttttttaggatttttttttttaattttaggtatagttttatagtttggttttttttttttygtttagttttaggagagggtttattatttaggattttttygttttttttttaagttttttaagttattataagttgggtgataattttttaaagtagtaatttggggagtttttggaaaggtttaygaagtaggagaattagaaaaaaagtagaagttgtttttttgttyggagtttagattataaaaaagtttgagttgggatttttgtttttttttttttttgaagttttttgagttaattygaggttatagaaataggtatttttaaatttaggtagtttaagttggagtgaaatatagttggaaagagagttgtgggagtgggtgtatttttaggttttttgagaaaatgggaatgaaaggtggttaagattaaagaattagaattattagtagattttaagttttttgtttttttttttttttagttttaggattagggtttatgtatattttttttgtttttgtttttaygtttgtgtttttttttttttttttgtttttgtgttttttttaaattataaaagttagtaggatttttaggygttggtttggagggaggagtaaaggttgaggagggggtaagtggtaagtgtttttttttatttttaggtaaaggtttttttagggtttgyggagattttgggtgaagtagaagtttttgtaggtataagtgtgttaagggaaattattttaggataggattaggtttgggttaaaatttagtttttttttttttttattttttaaataaaggtygggttgttygttttgaggaggggattgtttttygtagtagtagyggtatttggaggaggaaaaggggggtatttaatygtgtgtttttatagtttttttttttatggtttttataggygtttttttgtgtagygttgygttygttgttatttgggtatttyggtttyggagatggtgatgygygttygggatttggtttattattttaattgttttaygtgtattaygtgtaataagatgttgattaygggygattatttyggtatgaaggatagtttggtttattgtygtttgtatttygaggygttgttgtagggygagtatttygtatattttaattatgtygaygtggtagyggyggtygttgtagtygyggyggttaagagygyggggttgggygtagtaggggttaattttttgggttttttttattataatggygtgggtattgtgtagaaggggyggtygaggaaaygtaagagttygggtttyggtgyggatttggyggtttataaygttggtgagtgygyggygtaygaagygtttttatagggttgggggaaagtgtgyggtttygayggtygggagttggattgaatttttgtgtgttgggtaaatagygagttttaagtatyggayggtttygtagaagggatattagttttttgggtttttagattgtgygttttyggttggagygggaggagagggtgtagtggttttttgttgtttygggtgtagggttttgtttttgataaattgtttttttggagatggttttttggtttgggtttttgttttattttgttaggtaggaagtggtagggatggagaaagtaaggyggygttgaygttaaataggttttgggttggygyggttgagggtygggaattggggtagygaaggaaygaggtagggyggygagggttttaagagaaagggttggttgtggttyggggygtygagttyggtttggagtgyggtttgatttygtgaaatgttttaagggyggtaggtttggggaattygggtttggggaatttaggaaagtaaaggttgyggttttttttgttyggttygatttttttttaaagataggttttagttttttyggattttttttttygagttttttggygtttgttggggtgagggtygtgattttyggaagygagtttttygggyggggaygagatyggagtaggtttggtttygygttggggtggggtggggtggggtgaggtggggggtttggttyggattttyggtatttttgaattttaggttattttyggagaagttttgttttttttygygtttttttttgtttaggatagttgtagaggttttgagtttyggtaaatgagtygttaatatttgttygaagtttgtaaggttyggaaaggtttatgatttttygggttttygaattagagtttatgtgtaattattttttttttttygtttgtaatagaattagatttggagattttgtgttttttttttttttttttttagtttaatgtataagtagaaaaaagtaaaaataaaaataaatttaagattgtgtagagggtgttayggygggaagaagttagttatttttattttaaagaatttgagttgaatagagagggaaatgaggggygggtgttygttttaaygaaatygtttggaggattatggggygtgtgtttttgtgtgyggaattgggaggaaaaygtagtttttagtttggtaaatggtgaagtagyggtaggtyggtyggtggygyggatttaagatttgttgaaggtattattatagatgtagttttttggaatttttatttttttttttttattattttttaaaaaaagataaaatygagtttagatyggtttttttaatattaagtygtttttatttattaagtgggttaatttttattyggaagtatttygyggggttyggttttagggtatttggtggttggggagttgtattgtttttttgggtayggaggttyggygtyggttttaggattgtgtaaaaagagagtagaaggtatagagatttatttttgttttttgttgtttagtygtygtttgttttagygaggtgggttggaggttgaattttaagttttgtttaatttttataagagatattttttatttagttattttattttttttttggtttttttttttttttttttttttttygtttttttygttttttttttttatttttgtttttgtgtgtgtygtgtttgttttygtgttttttttttygattttggtyggggtttttagttttgagagaaayggygttyggtgygtyggyggtggttatgyggttggttttttyggggttttygggattaggttggggaaagagggtattttttyggtttttyggggtttagtttagtttttttagatttggygttygttttttttttttttttygtattggtaggagagaaatggtygtagtgtgggtygyggggtagttaggattggaaagyggggattttggagggtgygatygyggayggggtgtgygggygygggtygtgtgygtgtgygtgtagggtttygattayggggataygagtttgtttgtggtagtgttttatattttgtggtttagttaygaygattttttgtaaagttttttgttttggggatagttttttygaggygyggyggtattttattgaagggyggygagttgggggtygagtggggagggggygtygtyggggygtygggygttgggtttatagtagagtygygggtygyggggtyggaaagttttttyggggyggggtygtagyggttttttttygtagtttttygggttygggtttyggtggaayggaaatttttttttatttygggaggggttgttagygggttgggggtgygaaaayggyggtaggagygggygaggggttygggtygygtattttgygtttgggtttgygygtygyggtygygggagtttygygyggatyggtyggaygttyggttttttttagttttagttttttgtgtgtgtgtgtttggyggygtaattattgatttgattttaatttattatttagataattgaatttataatttygtttttagtaaaatgaggygaagttagatttgattataggtttagttttagygataagagttygaaattygatgggttaataatagattaygagtaaattatttatgattttaygagttttttagttttattgaatyggtttaattgagaggaaaaaaaaaaaaaaggagagagaaagttygggtttttttttttttttyggtttttygttttttttyggattygattttggggaatttygattygttttygggtattgggggygggagtgagggggttyggggygtyggttaaatttgggttttayggttgtttttttygtygtygttttttgtttttgtttttggtyggtttyggtttygttatttagggtyggtttttttttttttttttttattttttttttttttttttttttttattttttygttaataayggtttyggaaaaggtttttttygtagggatygggtttttyggagtttygggatttagttyggttatyggattttygttataagttgygtttgttttygggattygttttttttttyg

SEQ ID NO: 6117 - DNA, 3969 bp, synthetic construct
  misc_feature 1..3969: note = Description of Artificial Sequence: Synthetic polynucleotide
  source 1..3969: mol_type = other DNA
tygggagtgtgggtgtttygggggygtgggtgttttaggagtgtgggtgtttygggggygtgggtgtttygggagtgtgggtgtttygggggygtgggtgtttygggagtgtgggtgtttyggaggygagggtgtttygggagtgtgggtgtttygggggagtgggtgtttygggagtgtgggtgtttyggaggygagggtgtttygggagtgtgggtgtttygggggygtgggtgtttygggagtgtgggtgtttygggggagtgggtgtttygggagtgtgggtgtttyggaggygagggtgtttygggagtgtgggtgtttygggggagtgggtgtttygggagtgtgggtgtttyggaggygagggtgtttygggagtgtgggtgtttygggggygtgggtgtttygggagygtgggtgtttygggggygtgggtgtttygggagtgtgggtgtttygggggygtgggtgtttygggagtgtgggtgtttygggggygtgggtgtttygggagtgtgggtgtttygggagtgtgggtgtttyggaggygagggtgtttygggagtgtgygtgtttygggggygtgggtgtttygggggygtgggtgtttygggggygtgggtgtttyggaggygagggtattttagaagtgtgagtgttttaggggygtgggtgtttygggggtgtgggtgtttygggggygtgggtgtttygggagtgtgggtgtttyggaggtgagggtgtttygggagtgtgggtgtttyggaggygagggtgtttygggagtgtgggtgtttygggggygtgggtgtttygggagtgtgggtgtttyggaggtgagggtgtttygggagtgtgggtgtttyggaggygagggtgtttygggagtgtgggtgttttaggggygtgggtgtttygggagtgtgggtgtttyggaggygagggtgtttygggagtgtgggtgtttyggaggygagggtgtttygggagtgtgggtgtttygggggygtgggtgtttygggggttgtgggtgtttygggagtgtgggtgtttyggaggygagggtgtttygggagtgtgggtgtttyggaggygagggtgtttygggagtgtgggtgtttygggggtgtgggtgtttygggggtgtgggtgtttygggagtgtgggtgtttygggggagtgggtgtttygggagtgtgggtgtttyggaggygagggtgttttaggagygtgggtgtttyggaggygagggtgtttygggagygtgggtgtttygggggygtgggtgtttygggagtgtgggtgtttygggggagtgggtgtttygggagtgtgggtgtttyggaggygagggtgttttaggagtgtgggtgtttygggggygtgggtgtttygggagtgtgggtgttttagaggygagggtattttagaagtgtgagtgtttygggggtgtgggtgtttygggggtygtgggtgtttygggagtgtgggtgttttagaggygagggtgtttygggagtgtgggtgttttaggggtgtgggtgtttygggggygtgggtgtttygggagtgtgggtgtttygggggagtgggtgtttygggagtgtgggtgtttyggaggygagggtgtttygggagtgtgggtgtttyggaggygagggtgtttygggagygtgggtgtttygggggygtgggtgtttygggagygtgggtgttttaggggtgtgggtgtttygggggygtgggtgtttygggagtgtgggtgtttygggggagtggatgtttygggagtgtgggtgtttyggaggygagggtgtttygggagtgtgggtgtttyggaggygagggtgtttygggagtgtgggtgtttygggggygtgggtgtttygggagtgtgggtgtttygggggygtgggtattttagaagtgtgagtgttttaggggygtgggtgttyggggggygtgggtgtttygggggtgtgggtgtttygggggtygtgggtgtttygggagygtgggtgtyggggattgtagggatatgggtttttttttttatttttgtygtttagggtattttttgtgaggattyggagttygtgagtttttatttttttgagttygattttttggtgttttygtttgtatttttagtttttttttaaattagattagttttttaggggygtygaygtgtgaaattgattttaaagaaaataggtagtggtttttttttyggttttaygtggtttagtagygtttatttttygttttttttttygygtttagtaattaatttaggtygtttttgtagaattygggtttttgtttatyggtttatagygtttatttgaggtttygtttttttagtaaaggtygttttttyggaaygygttttttgyggtttttttagagtttttttygygygtttttttagtttygttygttttttttyggggtttttttttttygtttgtttttaggttygttttttttygygggttgaggtaggttygggtagtayggtygtttyggggygggggttattttttattatygygtggtgtttatagtttayggygttttygggtgayggttttttyggttgtagggygttttgaagagyggtttgttyggagttgagygtayggggttgtttygttttgggygtttttggtttttattagtttygtttttttatgggtaaaayggyggttttgtttgtttataagtaatygtyggggttayggaggggttaggagttgyggyggggggttgtgtttttaggatyggttttaggaggattygygygaggtttggagtttttaggggtygygggggatagaggggttttaagyggaggyggggaaggyggtagaagtttaggatygttaagagttggygaggaagttyggggttygttgtygggggagtygggtaggggtygygtttyggattaggayggaggtttggggaaggyggatttggtygtyggagaygyggtgygggtggagaygagggatttggattttygygggyggttgtayggatttttaygygyggtttaygtgggttttagggggttgttyggtattyggggtygygtygtttttttttygtyggtatygattygtagttttaygtttaygyggyggygttygtagtttttttyggttyggttttygygygtgttttygagygygttttygggattagttttyggaagtagagaggttaggtygggaaggatgggygaygggggtggttgattygggagtayggtagggaggatatttagttaggttygygagtagygtygttttttttttttaggaygggygggaatttgygatgttttygtygygtgggtygtggggyggttttygaggtattgggyggggtaygyggtgggygttttayggaattygtattttttagttttygtaatttaggaggaagtttayggygttttgtatyggygtyggygygttaaygygtttttggaggagttgyggtygggttttttggagagggagtgtaaggaggagtagtgttttttygaggaggttygggagatttttaaggaygyggagaggayggtgagtttagtttyggggygtttygygtygyggatattgtaggyggyggtgaattaggtygygtggggtygtttgygtttttttggttgyggttgtgggyggygaataygtagyggygttygygyggygttttttgygggggtygtttttygttyggggtgatttygtttttttgggygatgttttttatttttaggtaygygtttttttygtgyggtygtatygygtatgtyggtttttatattagaaaataygatttgtaaagtatatttagggtgttttttttaattttttaagggagtttttttagttttygaagggtttagggtagtttgygtatygtagaygygygyggttygtagaagggayg

SEQ ID NO: 6118 - DNA, 2490 bp, synthetic construct
  misc_feature 1..2490: note = Description of Artificial Sequence: Synthetic polynucleotide
  source 1..2490: mol_type = other DNA
gygtttttttttygttygaggtttatttagygttagygttyggtttttttgtagygattgggttttaatgtygtaygaggggttttygygaaggttaatggtattatttttttagttttttttttatttttattttttatttttttaggttgtggggggttaggggtygaggttygygyggygygtattttttaggygtatttttatygttaggtatttttggaagyggtagaagggatagygtttgygttgygttttgtygattttgtagttttggttttyggtgtaygtgtagtgtttgttgttttgtatygtgygtttgaagaagttttgygggagttgagagttagygaggtttygtagygttygtttgtygtatttttgtygygygttygtygtttattttgtagtttttataygtgagtagttygtagtggtagtyggatattttgttttygtatayggggtatagttygtttaggttttygtygtaygaatagtttatgttygyggygttygtttgyggagggatagygggttagggagggtyggyggagatyggtagtttggggttttygyggtygtygttttagtygttgtygtyggttygtygygtaattttttttttgtgtttaggygttgtygtyggtatttatygagygtttygygtagygtttyggggtgggttyggtgtagttttygygttyggtttttttttgttaggttttaygttttygtttygttyggggggtttttttygygyggatttygtygygttygatttggggttttygggttygatgygtttygattgggattygtttgtttgagaataaaatttygattttgagaaaaagagatgggtttagtygyggggaagaygttaggggatttaggagygttggggygttyggttygggtgttttgggaattygatagagaygaaggaggtagagatagagttygggggagttagagatgggaagaaattttggygagagataaygatygaygttatygggygtagataygaggttagttygagagtgttagagatatagatattgagaygtttagttagagagaattyggyggggaygagatatagggagggatggagagagatagggagatagagagagagagagagagagagagagaygagagagagagagagagagagaaaygaggggtgggggattggattagagattyggagagatagyggaggttygaagagaaaatttaagagagattgaygtagagttagagatataaygatagaygatagatagagaygtygagaygagaggagtttyggagagaygaggtyggggagttatagaaatayggagagaaaatttggaggyggaagygtttagttygagggtyggggataggggaygygyggaaatttgtygggtaggagtttaagygttaaggygaggtttygtagggtyggatttagaygggggttygggtygtaggaggyggaaaaygayggygtygggatygagagttygaaaaygtagagtygtygggatttttttttygggggagataaagtygtagtagygayggtaaygggaggygtagttygagtygtygttgttatygggaygtygggyggggagatttygggygggggtyggygggtttygggaagtygagttygaggygagggagygatttygggyggagaggygaagttyggaggagggaagygygaagagttagggttygggaygygagagggggygygayggyggttgyggtyggttyggygtttatttggtygtttttgygagtagygtttygygtttygttygygyggagttygtatttttyggtygygtygtygtygtyggygaggagtygtattygggygtagygtygttygttygygatgayggtygttygggtyggggayggggaggygggggygyggggttggyggygygggggtttyggtttttttttttygttttttygttttttattttgtttttttgttttttttygtatygtygtyggggtygtttygaggygtatttgggattygggttttttagtygttatttygttttgygttaattygtygygttggggtygggggtyggtttttttatatyggygygtgyggtattygggggyggaggttyggtygtgttttttttttaagttyggttygygtyggtatttttttygtagtttagttygagttttygtttttattttttaggttttttagtygtagttyggtttttyggatttygagygyggttagagagttgyggagttygagtgtttygygatttgggtaggtatagggtagtgggggttttgggttattygtttgtagtgggaggaggtagtttttgtttgtgaatttagttgggtygtggygaatgttaygygggtggttggtygtattatagygtggaagtgggtaagggygagtggygatygtggtygaggttyggatttayg

SEQ ID NO: 6119 - DNA, 5370 bp, synthetic construct
  misc_feature 1..5370: note = Description of Artificial Sequence: Synthetic polynucleotide
  source 1..5370: mol_type = other DNA
tygtgttygagggaggygggtagygtagaggagagggtgtaaggttttaagaagaggagyggggggattagggyggggtttaatggagttggggygttygtagattggaaggagtygggattttygttttagagtttttttttttattttygttttttttagtgatttygagttttygatttagttttttttttaggtagagagaattygaggttgtttttgtygttgaaatttgagygggagagtatttygaagtygtttgygtggagygagtagttttygygttatgggttagaggygttygggagaatttgygggttayggattatattygtaggggtttggyggagtaaggtgtygttygtygtttgygggtaggagtyggttttgggtttyggtttttgttgtgtygtttagtyggtygttttttygttttttyggtaagggaagyggtggagaggygygggagtttygattgtgttggagagatttgggatttttgygygtttgygtgygaaggattygagatyggttaatttagttgggagtaygggataygaggagtgaggataaagggtaaggaayggggtttatagggagggtgtgtgtgtgtgtgtgtgtgtgtgtgtgtgtgtgtgtgtgtgtgtgtgtgtgtgtgtgtgtagggggaatgaatggatagyggggaaggtatgtagaggggtttaaggggtgtggatttagtagttttattttagattagagaaggtagttaggttttggygtttatygagttagygtttttatttgggygygggtygtatggyggtagattattttatattygttttggtggygtgggatatgattggtaggagygyggaagaggygttgagaatgtatgygtattyggatagattagaygyggtayggagggggtattttttataagtttttttgttttgagattaggttttygagtggttyggggaatgygtttttgggtatagttagyggttttagatyggtattggaygttaattygagttagagaagtttgggagattggatygtaggggtttttatttagttaaggagggggaaaggagagttgtagggtaggagaggttaggtatagggaaggtggggaggggatggagttttgygttaggagttgggggtgtagggtttgtgaygagagagtattattatgtgtattttgaaggagagggagagggtttgggtttggaaygaggattttygtttgtaggtagtygtttagtttyggttgtagggatggatygygattagtagagggtagaaagtgtttggttygttygtyggtttygagtygygtttygygtttygggattttggttttgtgygtygaagttttgttygttyggtttttttttgtagtagtygygttttygttttagatgttyggagaaggyggtttaggtttagtttaatttygygggtttaggtttggggtttttaggttaagtaaagaggggatygagatgtgggagagaaattttatattgattgtttatttttttygatttagttatataaaggygtttagaaatataygaaggtataaagttttttattatatataaatatatatatatatatatatgttaggagataygygagtatatagaagtatttagaatttyggagataagtatagataygtaaagttgatagagatatttatatagaaaaggatygtagatataatatagaggttgagataygtataaagatttaggttttygtatgaaatgatgyggatatatattttagatataggtaygaaggatttatatatttatatatataygggtgtaggggatttagatatagatttatagatttatttttgggagtttggaaggttgtagggatatatatatygtgtgtgtagagttaaggagtatayggaggtaagagtygtagaggygggggttygataygtatagatatatatagatatttatygatatataygtaggtagggtagggygggagtttttaattttttataaagtygggttttttygyggggtttygyggygtagggggttatttttgattaagtttttygtaggttttaaattygattygttttttygtttttagygaggttaggggattygttttttatgtttttygttttygttyggtttygygtygttgtttygtttygggaggggtyggggtygtttygtagyggatygyggggggttagttygtygttatttygggtygtaatygtttttttgtttttyggtgagtygygygtyggtggggattaygggtygtagatagtyggttygaygttgtggtttttygtatyggaygygggtgttaggttyggttggygyggaagtyggtagttttatttygttagttttygygtttygttgtygaggtttattttgtttaggttggttagagtattgtttttgattygygygttttagygatttttggtygggtattygattygttaaaggatttygattttggtagttaatttaatttttttagagtygttattttggggttattatttttttttagygttttttattgtaaattttaggaggttygggttttgtttattgtttttgtttttgttyggggattttttttttagttttagttgttttttaaattttyggtygtttgaatttaggtttgattttttttgtygttttagtgttttttattttygatttyggggttttaattttttatyggtttagtttttygtttaatttttgttaggttyggagtttttttagattttttatttatattttaggtttatttttygtttttgggtttgggttttttttgtaygagtttagggttagtygttttygttttttgttygttttygtttttygtttttgggagtyggtttttttygyggattaagyggtttygagtaggygtygtygttygggggatttygatttagttttygygatttatttyggtygatagtygggggtttttaagyggttattttyggtyggygtygttttttggyggagtygtygygttttttgtygttygygtagtttggtttygttyggggttatttttygtagygttggagttttataaaatattaataataaagaaggtagaggagaaaaaagaaagttttygttttttaatttttaaattaattttttaagggggtggagtagagggatttgtttygaagaygattaaaatttttgygaggggttygyggggyggtygggtyggggagtyggggtttgagttyggggttaggygyggygyggggygygggttaggggygyggagtttyggggygygygggggggygggayggtattatttgaygtggagtyggyggygtatttyggygtagggatatyggtygyggggtttaaatgttaggaagtttygggaggtgaggyggttygtattttttygtygttagttttagttttaaattyggyggtttagygggygtattatggtattggagtagygyggggagygygttyggagtttygyggttygttgygtttygttygggatttygttgygtygygygtttttttygyggttygyggggtygtttttgtatttttattttttttttygtttgtygtygtygttatygttatygtygtygtygtttttttttygyggtttygtttgtagtagtygtygtygtygggtttygggattgataagtaggtgatagaggagtyggygygygtggttgtaagtgttygggagagygyggygygggttgtagtygtttyggttygttygtaygaygtyggggttyggggttagygygtygtygttttaygatygtygggggtyggygtaatttttgttttgygggggtygygttttttyggttttagggtygyggtggyggagagygggtggaygggtyggygggygagtagttyggtyggyggggttygtagygygtttygygttttatggatatagtaataggtttygagtygttggagaggtgtttttttygygggtagayggattgygttaagatgttggayggtattaagatggaggagtaygttttgygtttygggttygttattttgggggtgttgttgggtgagtgyggggtyggaaygttygagtggtttygggygtgggatggggygtygttyggttgtggataygggygttggggttaayggataaaggaaatgggtttgtaggatatggggaggaggtagagataggatttttggagtgatygttagagggtygtaagtaygttttyggtaggygttttgaggggataggatagttttagtygttatttattattttttttaggtttaggttttagagttgttatttygatgtggtaggtggygggtggtaggggtgatggaggatttagtaattattttggygagtttgggagaggygtaaggttatttggggtgggggagattttaagagaaaaaygtttttttggttatttaaattatagattttggggagatyggggatagaagattaygaaygttatygtggggygtgttagttagygagygttttagttttatttygtttgttttggttttagtyggttattttgygtygtgttygttgttatttgttttaatayggagygyggatttttyggagaaggggagagtatagygtygagttaaggttygaggttygyggtttttttaygtyggagttygaggattgggayggattagtyggggtygttyggtttttggygyggyggttyggggagygtaggyggtaggyggtgatttygggyggttygagttttyggggtygagggttgtgggttyggtgygatygggaygtyggggttgggtygggyggygttgayggtygggttttygttttgtgygttataggtttygattgttygtatttygtygtttgygagggttgttagyggtttattttygatygttttttgatgygagttaaygagtygttttggtaygaggagtgtttgtagtgygyggygtgttagtaagtttttattattagttgttattttygggatyggaaattgtattgtaaataagattattaatagtaagygtttttygtttttttttttygttatygttyggtattygagttyggttagttttttgtygggttyggttygygttygttttgtygtyggttttgtgygyggttgggtygggtagttttaagggtttygagagttgygygttttggggttggggyggattagtttagtttagygggtattgatggggttttgggagttttyggayggtttttagttgttattygttgtttyggaattttgygttgggtyggtyg

SEQ ID NO: 6120 - DNA, 3120 bp, synthetic construct
  misc_feature 1..3120: note = Description of Artificial Sequence: Synthetic polynucleotide
  source 1..3120: mol_type = other DNA
gygggagagtttttttygaygttyggataygyggatggggyggtttttagyggtttttattygygtatttttttaggtttatttttyggyggttygtgtagtatgttttttattgggagtgggatgatattatgtataggtttttgggtttygtagtygagtygygggtattagyggyggttgatgaatttyggtgttattaggggtttagttyggatttgggaatygygygttttaataygygtatayggttttgttttttttaaagygtagtttttttatttagtagttgatttatggaggaattygattttgggaygygttaggttgaagttyggagtttagggttttgtagtagttttygggttttttagygtttyggggatttttggtggttygggggtttttttgggttggggtyggggtgtttygttaggtggggttttaygyggtttagaaagagttagtgattttttttggagttattgtaggttttygttggagggagtaagattggyggggagagttggtatttttattttttgttgagtatagttttygtttttttttaagtttttttgtygattttttygggttggttaaaagtagtaagttygggaggtttgtttattgagagaatagaaaattaggggttgygggggagaatttaagatttttttttygtttgagaaaygtgygaagttttttagtttttggaggtaattaggyggttygaaagtygagttttyggygyggatgttagggtygattttagtttttttttttttgygttttagttygagggyggygagtggtaggtttttttttattttgtttttttttttttggatttggtttgtaggggggaaatgtggttgtattaatttataaatatttatttttaatagatttgtatttgtggagatttygaataaagatagtttagggggattataaaaattttaaatttygtttttttttyggatttggtgttttaaatgttaattataggygagttatatttaatagtaayggggaaaggygagtaggtttyggggagggaggtggggggagagttyggttattaaatgtaattttttattatgaaaaggatttygtyggttttattttttaataagattatgttaygaatataagtatttaggatggtgttgagtgatagggttttgtygtttaattagaggttgtgtygtttaaatygyggggttttttgttttayggagtgaaygayggaaatttgttattttaatttttttatttatgttaagtatagaaaagaagtygagtattttataatygtgttttttttatttttttygaggayggygggaagagggggtttyggttttgtagttttttgaygtttttygttttygagygygtttgggttttaggagtyggagygttgtygtgggggygggggaaggggtggttttgygggtgttttaattggtagygtttggaaaatggggatagtgattttaygattagaggatgaatggggggagggttagtgggatgtgtttgttttttttgatygagagtaygggttttgttttgttttttttttttaggaaaggtggtatttygggtgtatatttattatttttattaaagygggattgattagaagagagaggtygaatggagatgttaggttggggttttyggyggggtagatttygttggatttttgggattaatgtygtagygttygtatttttgtaggtttttagggttggttattttyggttgtatgttyggtttttttttttygagggtgaatttttttgttttatttttayggaaattttttttttygttaggttygtggygtttttttygttattttygtygtygtygtygttattttygttttatygtttgtagggtttttttgyggygttttggtygtagagatttagttttgtttgtygattggtttttygaygtygtygtygtgtttgagtttygttgtttgttyggataagtagaatttyggtaggygtagygggygtygaggtttgggttttagtygtggygttygtttyggygtagtggggagtygygggygtyggagaagyggtygygttgtttygggttattgtatyggttgaaaaaattaaaagtaaaattaatatttagaaaygaagtttgygtgttttygggggtttygttttgttttttttatggatatgggggtggggagttygtggggttttagtttaaaggttttagttagtggaatyggagggggatttyggaggaatttgtttttgatgtttyggttttttggttttttattagaattygtagaggattygttttggagttttygtgygttttggtagaggtyggggaygttagagtgtaygtagttttttgygygtygagtttaggtttygggygtagggaggatygggttgagagtagggtgttatttygtaaaagygataggtaaggattgttttatggggagggagaaggagtaggaagtgatgtttttatttttgatagtatagggatygggagtttygatggaggaaatttttttygggtaggaygagtagagggataggatatggtyggggattatgggattygttgttattaagtatgggaygggtaggygagagyggggaaggggatygatggagttagaagttttgagtttatttttygttygtttttttttggagttttttttgtaatttyggtttagtyggtaatyggtttttttttttaggttaggggtgggggagagattttttttttygaaatatttgatattaattttgtttttttggtaagaaaaataagttttgtttggaaaggggtgggtggggggygtygagygagygagggaaggagtaaggaggyggyggyggagtaaattttgyggattaggttttagygttttygttttatttttagtttygyggyggtgatttgtgtgygggggtttgtgattttgtaagtattaaayggttygygggaatyggtygagtttagagggatagtgggtygaagggyggtttaagataaygtagatggtttttattagttyggtygggttygtagygttygtyggttygttyg

SEQ ID NO: 6121 - DNA, 3120 bp, synthetic construct; identical to SEQ ID NO: 6120
  misc_feature 1..3120: note = Description of Artificial Sequence: Synthetic polynucleotide
  source 1..3120: mol_type = other DNA

SEQ ID NO: 6122 - DNA, 7861 bp, synthetic construct
  misc_feature 1..7861: note = Description of Artificial Sequence: Synthetic polynucleotide
  source 1..7861: mol_type = other DNA
tygttttttyggaagtygtgtttttttttttttgttttttttattttygagtttttgtatttttgygttttygattyggttttttatttgttttttttatttyggtatygttttgttttagtttttttygatttttgtttygttttttttgtttttagaagtttgygtttttgttttttttatygttyggttttttggtgttttyggygtttttttygtygttttygtygttttgattagtttgggttgtggygttggtatygttggtttggggatyggggtgtgggygatggaagggggttygagaggygtaggggaggggttttttttttttygtttttgggygtttggggagattygygtgttagttatttgtyggtyggggygtygatttygygtttaygtattttaygtgggygtttyggggygygtttttgtttttttygagttttgaaagttaattatattgggaggggataggggtggggtgggagagggggtygttgtttttatttattgagtygaggtygttatttygtyggtagtttygygtaggtttggtttygagttaygtttgttgaaatygtttttttyggtttygtttttattygttttggtagttagtygygtttttgtaygygtyggygggggygttttggaattttgaatygttttayggggaaygggggtggggggaggggagyggygygggttttaygygaggaaggaattttttgggttattgygaaagattgaggtttagaaagttagagagagaygtgygaggaggaagyggagagggtgtgygaagttggagagggagtyggagygttagygaaagaggggagygttggggaaggaggaagagaaggagagggggagaagagagaygyggatgttgggygygygayggtagygggyggaggaggggagyggtygggaatttgygygtaggggaagttaggayggagygtagtatyggtaggggagggttgtygaggggttgtgtygaggagttygggtgggggyggttggatygygggtygygggatttatagatagtgygaggyggygygggggtttttttttttatgyggggttggggygtaggggttgggyggggygggtgggygtttgagygyggygygggygtatttttygttttttttttttygggtttatttyggtygatygatatttgygygggatttgttttygtygttaatatttttttaatgagttygttaggtttaaagygagygygatttgttttttagggtggattttttttyggtagatgtttygggaggaggaggygygyggagttttygggaggggggataaattttttttttygaggggygagaataggagatttttttttaaagtttaaaagaaagaygggtttttattyggtttttaaaaatgtatttttyggyggataatgggtttttttttgygtttttgagggtyggyggggygggtagggyggggattygtgygttttggtttygtttgatygattygtatttttttttttygtatttaggttygggttttagagygagggygtaggagtygygaagtyggtygttttttygagygtttttttgaagygtattgtygggatttggttttttyggagttaagtttyggygtatyggygagaaygaaagygtygtgyggggttttgggttgttttataygttttygtttttataggtgttttagtygggtygaagggaygygygttggtgttttaaggggaggaygaayggattttygggtttgggtygyggttttttttttttyggygtttygttttgagyggggtaataattagaaattagttaatttygggyggttgtygggttttgagattgttttgttygtttyggtttagttattttttygggtygtttttgttttttttttttattttttttttaatgttttttygtggggtygtyggtttgtygyggyggttttttttttattttygtgggtttaggggaagagggtattygggyggygaggatgattttygaagagtygyggtaaattgattygtttygttyggagtyggggtygygtgaatgggggttygggyggyggyggtagyggagaagaggataaagatgttttttttgaaagggggagggggygyggagygggaagyggggttatttatttttggttyggtttttygggaagtygygtygaagaaagggggtygaggtttatttaagttttaygagtygtttataatggatygatatattgagggtttttttattaaygtttatgaatattaaagagatygttaagtggyggttagygggygaggggggygayggagtttgagagtttyggttyggtygaggggagggggtttttgygygagtatatttygygtttgggtttygyggaaaatgataaaataataygggttattygttgggaaagttyggaatgttttttttygaaattttttttyggggagatgtgagtatagggttttgttttttattttaatgtattttgagattgggygttatttaygggttttttttttttygggygggggtttaggtgggttttgtygttagattagaagtataaaatgtgagygyggtggagatttgggygtattagttgggaggaygttttgygtttygtttttgttyggtttttagtattgtttttygggtttgygggttyggaggagaggaatgggattttttggtygtagttygagttygtggttattgygttagyggaatttaagtttttaattttaagtyggggtttaggatttaaaygttgtattttagtayggaggatgtatagatttgagggtttttygtagtgggaygtggttttggagagggtaaaattttyggggttgtygtggggtaaagtgattttatttaaagagagattaagtaaagaaattttagtttataaagtttaatttaaattattgtatagatagggatatygaggtttagagaggaaaggggtagtttataggatatatagtagtttttatttttttttggtgttttggaggaattgaggtygttttyggggtttgggagttgtygtagygtttggtttttggtagygtttttygaygtygtttttttygtttttagtattttgttttttttatttaggtttttttagaagttaagaagtaggtttyggtgaggtttttttgtaggagttatyggattttataygtttttttagattygagttttggttagggagtygatgygatttataagttgygtygaaaaatgagtggagggttyggygattttaatttatttttttttttagtagygttgttttttgttggygttttgtttaayggttttgttttttgttaggtgtgtttttttttgggttttagtttygggyggattyggaygtagggtttgaaggttagttatygtygtttttttttttttgygttttaayggggaygggggatgtyggagattattggtaggaattggggattaggggtttggagtttggaygttaggtgtgagatttttttagttaaggygygttygggtggtggaggggygtttatgttaataggygtttggatagggtttygtttatgggaggttagttygttgtttttttatttaagtttttygygttgaggagaaggtttagggagtttatatagtttagyggagattaattygtgagtttgatttaygtygagagggtttaggtatttttgttagyggtatttgaaattgtaggttggtgatgggagttagaagtgyggtaggtggggtgagtttttttatttagtatgttagggtttggggttygaggtttgaggttgatattggggagtygygaagtttgtaggaagyggggtttttygttgggtttagtagttatttgtttygggagaggggatygttgggtttygaggtgtttygaaatygtygtaaagtaagtttgtttttgggatgatgggtaggaggaatagaggagaggaagggaaagaagagagaggtagaggagaaagaaagaattaggaggtaagaaggaaggggygtygtaaygttatyggtttttygaggttgtagtttagtaaggagtyggaaagtygggtygtaagtygaattygtattgaggtttttygyggagttgtttgtagtttttgagggatttygtttttaggtaygtttgtttttatttaggaagggtttygggattttttttaatttttttatatttygtaggaaattttttttttagagataggttgttagggygatttttgttygtttatttygattttygatttggtttygtaagggtygggagtttggttttttatgaagttgttttaggtygggattagttttagtttygayggtygttgyggtttygtttyggtagtttygtgagttygyggaggagtttygtattygatygtgtatagygatygagttggygyggttygtatgaagygaagygtyggttttagtagygtagtttgagtaggggattygygtggtaattagggttgygygygagttyggggygattgtggyggttyggggagtgtagggtyggagagggaagaggaygygggttttggtyggggagggagagyggtgtagggttgggtyggttagtyggggtagtaaagtaaaggtgaaygtygggttgggttaggtyggtgaatatagattaggtttgaggggagygyggggttygaagttaggygtttttttttgtttagtttggtttttggagttttagagagtttygtygtatttttttttttttttygtttttttttttttttagagtyggttgagtttttttttttgttttgygttttttayggggagagaaggaaaaataggaggggggaggaaggattaggaaggggagagaggagtggaggggtattgtttggagyggttygygygttttygtttttygygttttygygaygaaggtttttygagtttagtygggtataataagtttgtttttygaygttagggggttattaataattaattaggagggttattgyggtttttataaaggygttgagattttgttaaggggaagayggtttyggtygagtgtgygagaggttagygygygtttgagttttttgttgtygtttttttgtaattattygttttttatttattttgtatttttygtattygttttygtttttattygygtttttttatttttygygtygtttttgttatttttatagattttattatttttttttttttttttttttygttygttttttttttagtygtttttttatttttygtttttttttgygtttttttttttttygttttttttttgttttggttttttttttatygtagygtttttttttygttttttgggtttttttttygttygtttatttttttygtyggttyggtygtttttyggygtyggggagtttygggtygtttatgatgggtttygtgttttyggttgaggttttggtgtttaagatygggttgaaggygtygggattggygttggtygaggttattattttygatattttgtatagttttttgtayggtygttggygtaaygtgttyggggagtagtttttygaggataagagttattaygttagttttaagatagtttttatygtygaggtgttggygtagttttttttyggyggtgagtttagtygtyggagttyggygtaattttttttttyggygatttttattttygttttggygatgygygagaygyggttgggatattyggtttygttgttattygygttaatttgggttttttyggygttyggtgtattttagtttttttatgggttaaattaggaygygagttattaagtagtttygtagtttattyggtttaaggatygatttyggygatttygtygttyggtttygaygttttygtyggttttttttttttttttttgygtttgagttggygggttttyggtatttatagttttattaggygtgtaatagtagttgatttaaaaagaaggggttttaaatttatttagttaatttgggtttgatttaygaaagtttttatttaaattaagaattttaaaaggtagtyggggttggggagggggtggagggagggygggyggggagaaaaagtygyggggagagygagggagagaaagagagagygagaaaagttttttttttttaagatgttttaagtttttattttttatttattaattygtaaataatatttttttttggttttggtatttttgygygtygtttttttttttttttttaygatttttgttttttttttaatttatygtgaagattaattttatttttatttaygttatgttaattatttaattttttttttttgtaaggggaatttttyggttttttttaaataagtttttttygtattgagttataatttattgttatagtatttttttagggttaatgaatttagaattagtaatttttttygaatggagtygaatgaatgygattattttaatagygtgataaattgttygtygygtygtaatggatatygtttaattttttttttttagtyggttygttygtygggtatttttttaggtagtttagaggggaattttgtaagatatggaggtygtttttgtgygtttygtygtttttagttttgtygtagatgttygataggggaattttyggggagttgggggtygtygyggttttttttygtttagagagatgatatyggggtttgtttgagttygggygtygttttttttggtattttagggtttgggagtagagagggattygggygygttyggggttatatagygagygtagagtttggttagttgttgtyggtgtttttttggtatttttaatatttgttagttygaggtttgtttttagygttgattayggttyggtttttttgttagtgtttagagtttggatatatagtgggttttyggaagtygattaggygaaagagttttyggttggtttttatttttttgtaggatttggttttagtttttttgtgtataaaatygttygttgtygttggtttattaatttttaaatttattyggggtagaggatggaagaagttgygaatgttttgagaattygyggagagattaaaaatttatttttaaaaatgatttttaaygtattattygttttttagggtayggagggtttttaggttgtaaatagaggagaggtygttgagttttygtatattygattttttttatattygggtggtttttttggatttggggtygatttgggtttggttggtttgggtaggatygaagtyggggtttyggyggggaaggaagggtygggtttyggttgtttygggttttgatyggtttttttggtttygtygtygtagaagtgtagaagttgtttagtttggtgttgtttgyggaggtgattatygtttagagttttatttttggygagggtttyggtattttttttaagaygtggattaaggygggaatygagatgggtttttttatyggtygygtgatygtttyggagtaygtggatatttgtaagaataataattttatgtgggaggtaygygygggttggggtagaggggygtaagggtyggygaggggygttggtygygggtaggattygggygttyggtygtygtygtttttattygggttgagagyggyggatatttttggtttggaygttttttgagtygggattttaagtygttygagtttggagtttatttygtttttaggttttttttaattygtgtygaaaattyg

SEQ ID NO: 6123 - DNA, 1434 bp, synthetic construct
  misc_feature 1..1434: note = Description of Artificial Sequence: Synthetic polynucleotide
  source 1..1434: mol_type = other DNA
tygggtgtgygtttttttagggtttttattgygtatygygggttayggtagattattttagttttygttttgttgtgtaggtgttaggagtgtyggttggtttttttttttttaagtaaggttttagggtatygyggttgttttgggatygtaggggygtttttagttttttatygatgtttygaygtttttttggygttggaggttttygygagtttggttgtttttyggagtttgttttgtttgttgggttttaggygayggtttaggttggttgggattttygaattatygyggaaaagggttttagtaggtaggayggygtygtttttttgtyggtaatttttgttttaaagyggattttttgyggggatyggagagggatgtttyggygtgaggatgggagaagtttygggaygggagggtygygggtygtgtttttagttggagttttygygtygtygtygggtattttatgatttgggggtggtggtgtgttygtttttttatgttattttgattttaatttttgggyggattggagtttgtagatttygttgttagtagttagggggyggyggggagtygagygagaggaaaaatttatttattttttgggyggattgygtyggtttygttyggtygagtttygtttttyggtygyggttttygygygtagttygygtagygtttagagtyggayggygtttttyggtggyggyggaggagttyggagggaygtagtygggtaaggtagggygtagggygggyggygygaggygtagggygyggygggtagaggttatttggttattttttttggygttyggggaaggtgyggygatggtyggggygygyggggyggyggyggyggygggygggyggyggygggtygagggggygyggggatatagttaggygtttttgttygtygyggtgttygtygtttgaaggtygtttgggygygggagtyggtgttagttyggagygggygttggaggtagttygaggygygatgtyggtgtygttgtttaagatyggggtygtgttgagtattatggttatgattattaattggatgttttagaygttgttttygttggtgggttttaatattattaagttttyggyggtyggyggygggaygttggatygtagtatyggygtaagtgygttygtyggtygttttggygyggttttttttttttttttttttttttttttttggttyggagtttygggttgggygggygtygygygggattygagtygtttagggaggyggyggggagtagggygggtaagggtaggygtygygggtyggygtagyggtggygattttgtttttygtttttttagtttgggttattttattttygttygygygtttttggggyggygtttttttygtttgggtttttygtygyggggtyg

SEQ ID NO: 6124 - DNA, 5053 bp, synthetic construct
  misc_feature 1..5053: note = Description of Artificial Sequence: Synthetic polynucleotide
  source 1..5053: mol_type = other DNA
tygygggttttttgggatttttgygatttygtygaygygygttygttttttttygagtttygygattttttygtttatyggggaaggagattttagygtygttgttttgttttttttgaaygttgtttttgttygatttggagtygtygygggagygttttatgttgyggaaatattgtttttagygttgtyggtyggygtttttttttagttttttttttttggttyggyggttttggaattaaatttgggggyggggyggggtgagyggtygttyggttttgygggggtttttaaggtygygggygggagggaagtaggggygagygttgatttgtattaygygtatgtttaggttygtttyggaygagagttgttygygtaygtggygygtyggtttgggygaggtgttgtaagygttttttagygtttttagttgtttggyggtgatggtygtgygyggtygtttggtygtggtttyggtttttgygyggygggygagyggtgaggygyggtagttttttyggtttyggtyggatttttagtttttttatttyggtyggygyggggaygtyggggttttaggtgtttatttttatttygttttataggtttttyggaaggygygggygttgggagygattggtaaaaaygggtagtattygggttggggtggagggggygtyggyggagggygggttttgtygygggggygggggyggygttttttttaaaatygtatttttayggygttttygtttttagttttggtttttttttttaagtattttgattttttygygggtttttttttattttaagggtgtgggtatggtttagttttygyggttaagaatttagggygataatttygattaggggygaaaagtygtatatttyggatygaaygaagyggttygggaygygggtttgttygtgatttygtygttttyggtttyggttttttgttgtttatatygttttagtttaggtttttttagtgagygtttggggagagaattttttyggaygtttttttgggygtggttttagttttattttttttagattaggaaaggtgggagygtygttttttyggttgatttygttgtttggyggtttygtagttygttttgtataygagtyggttgttttttatgaggtagaattygtygttygtggttagttgtygtttgtataygaygtaggtaaagtagtgtaggtggtataygaagttttgggygyggygtattatttgygtgggygggatgtttagttggtaygyggygtatttggtttygaagygtttgygggaygtatagggtygggtttagygyggaagygygaggtttatttygtttygagygggttggagagaggtaagyggttgtttgggaaggyggtttyggaggaaggttttgttyggttttgtagggtggtygttagtttggtygtyggggtagagttgtttatttttattgagaagggaattttaattttagaaagatttyggggagtttagtygttattgtttgtaggatttatgttggatttgggaaggtgaattyggagggagaggatttatttggggttagttttttatattttatagttggagttatgaaggttattgggttagagtygttgggtgttagtattaggaattaaaatattattaatttyggaggaattaagtttagtagaattttataaataggggtgtattttttttaatgattgtttttgtgatttaggtaataaattgtttttttttttaaataatatttgttgatgttttagttaggtttagttatttagggagtatttatggagaggttttatttttaatttggttaggttatagggtgttttgtttgggtgataggagtgggttgggattgygagagaygtaggtttygagggtttggttttggtgattgtgaggggaggagtttttggggtaggygtgtttttygtttttatattgaggtgaggtttyggggtttatttgaaaaagtygtttttgtagtaaaygtttttttttyggttgaagtagygttyggttagtggygtgtggtagtygttgtatttgagatatttgttgtgttagtggyggtttagagttttgaggatgaagyggtttaggatgtgttggttatagttagygtatagygggatttttgtgggtaygaggaagttttgggttatttygtagattaggaggtagtgaagttatttttttattttaaygygagttagtttttttttyggtttataggatttagggttgtygaggggtttttttttttttatatatttttttttttagttagtttaagtggtttygtaagtttygggagtgtgtaggtatygtattttatgttaggagttaaggggaaattgatatyggtttaaaaatgtgtgtgagtaagaaagtagtttaggttattttaygaggttgaatatttaattataaaatgttgttagtgttaagaagggtgtatgtggagtttaaatgaaaattttattttagggggatttgttttttgaagttyggtaggaaatatagggaaaygggtttttattattatttggagttggggtattttatygggttttttttatgttaagygttatggttattttttttagggatttttygtaaatgtggttgttttgtttggtggttttgtttgtaggttttyggggtaaatattaatgttttttttattattgggtagtygtaaaattatttatgagtggattggataagtygatttattgtttttgtgttaggygtgggtgtttttaatatygttagagttatttaaaygtttggtttttygttgtttttgttttttatattttatttyggtattgtaggttttttggaggaattatattggggaggtttaagggtgttttgtgggagtttygagtttgtgagygggttttttaggtgttaagggttgaggattttttttttatttagaaaaagtttttggaagagaggagtgttygttgaagggatygggatttattgatatattgtattygtttttttggttgtggatttygtyggttttagtttattttttagtgggtgagagatattaggaaggggttttttygattttyggyggaaaaaattgggttgygtttttttaygtagtggygggaaatyggygatgaatgygtttygtattyggtaaaatygtagtttygggtgyggagygtygaggattygttgygygttyggggtttttatygtgggtagygatygtaggygaggattyggttyggagyggggyggttygataggtygatatagygyggatttagtatygyggatyggatagygtttyggtygtagttygtygtyggygttygygtygggtaaaagtygttttagtttatttygygtygygttygygattttagttttaygttgtatggygattttagttttggygggggtttttgtgttagggatggyggggtyggyggagtttggaygttagttygttygtttyggttagttttttygagygygggygygtagttttttttttttttttttttttttygttttttagttttygyggttaattttttttaggaatygtygaaaaataaataaataagtagggaatygygagtttttatagtttggatgtaatttttttttygtyggtyggttttttttattttttattggtttyggggtttttttttttattttgyggttttagttggttygggagtygaggagaattgtttaggttttttaagaattaaagtgttgggagttagagtggtgttattaggaagttggggggtttggagaagagaggtttttttttatagaygggttttgagyggggataaatygagygggtgtttgtgggygtagaygttgaaatttgatttyggggagatygayggtyggagtttagttygattttggtttttgtatttgattttgtttygttggaaygtggaaagagttyggttggggyggtttttttggggatttttttgtttygtggttattgtttygttattgttttttgygttttttttagtttagggagttggtttygggttgtagaggttttttaagtttattttggattttygagagttttttggtyggagtagygtagtgttataattttatttattttttgataatttaggttaggggttttgtaataaatataggttgaggygtttaggygyggaygtttyggggttttygygtttattttygtttagattttttagtttttgttagttttygyggttaggttyggaaaggtttgaggattttttggttttttyggtgtagttattyggttygggtatttatttyggygtaggttygtttttygygttagtagtgttagtagtaggtygtttttygtygattttygggtygggtttagtttttygygygtttttatgggtttygtygttyggygtygttattttttagtttygaattttttygggtttagygaygttatttygtaatagtttygaatyggygtttaagygatttygggtgttgttgggygttgygttygygggtygttttggggttyggagtttttggtygagyggagggyggagyggtyggggggyggggtygyggggyggggyggggtygggggtygyggagattagttygggttattgyggattttgagygtttttgygtygggatttgyggtgtttagaggtygtttygygtgttyggttygagggygggtatyggtaagggagggtttaggttagggtttttygttagygttygtttyggtttygtagttttttgygtyggagyggtttagaggtagaggtttgagttggagtataygttaggagggttaaggttttygggagaggggtygagaaggtagtagggttttttygtygttgaggtttggtttygggagtagtagatggtyggygggagtttaattygaaaygtagaaggggtgagtgtggygtygagggttgygtatyggaatygtaaggtgtyggatyg

SEQ ID NO: 6125 - DNA, 6343 bp, synthetic construct
  misc_feature 1..6343: note = Description of Artificial Sequence: Synthetic polynucleotide
  source 1..6343: mol_type = other DNA
tygttttttattgtgygygatyggaggggtygttttgtagtgggygttgtgaygggggygtagttattgaygttttttggggtaatatttataaataaggtttaaatgyggttygtttttttaattgyggatattagagggygtagttttaggattaygtttttatttttttattttattyggaaaggggtttattygagtygatttygtygttattagtygggggaggggaggttttggagttttaygygggagttttygtygygggaattataattayggttaagtttttttggttygttygttttatygtagggagaggayggggggaygggtaggaygggygtttggatagttgggtttttttygtaggtgtttttgatttyggtatggaggaagygttygygttttyggtttaggttygtagttagggttgtttygttygttgygttttaggtaagtygggttagygtgggggagtagyggggtttgggttgyggagggggtygttttgattygygtttttttttagggtaaaagtttygtaaggtagtgtgagttggagtygttagtttggggattttttttaagatgattygtayggatttttyggatttgttggtgtygatygtgtattaggatattaaggtggygatttygggattygygtttaagtgttygttatgtgagygattygtggttyggtttgttgagttygygttttttaataagygttattgtygtagtttygattttttggaggygttggaygggtyggttatggagattttgtyggagttatygtygtyggagttygttgtgtygygygttyggattygygaagtygagttaygtygtygygttygttttaagagtgygtttygygygttttygggtttgaygttygygttygtttygtygtyggtgttgtttygtygagggygggaggtttagygtgyggygygggtygaggtatygtygygtygggagttygygtattyggygtttygygtttttgttaaygagttgtattttattaagttgtagtygtagyggggyggtttyggtygygtygygtttttgtgygtygtygygggtygttgygtatygttygagttattygygggtttygttttttaygtgygttgtygtttggatattaagttagaygaygtagtgttttagtaygttattyggggttygyggttttgygggtttatygaggtygygtattgggttygtttygtttygtagttttayggttttayggtgttygggtttygttatatggygttgtygygtatttygaygtttagygatttatattgtgyggattttygggygttttattgygaygggtttttgtttgggtttygggattaygtygagygtygtagtttgttttttattatttygtygggttttatttagtttttttatatagaggagttttaaggttttyggggtagttttgtagttagtttyggtttaattttygaygtttattattttaggttttattygttygaggagttttyggggtttagtttaaggygtatgggyggttattaygtaggagaggtgygtatttttttaatttaggaatygttttttygtttttattatggggaggttttaygagtttayggtttgttttaygggtttygttatgttttygaggagtttygggtttattttatygttygttttttttatayggaggatttyggaaggtatygygagygtgaygttttggttyggaygtattygtattygygtagtagttyggtttgggyggattggggttygygatygtatygtattttgtaagtggtgtygttttttgatttygattygttgttygttttttggtayggyggtatyggtattagttygtttyggttggttatygatagtygttattattygygtttttgggataatattttggtttyggggtygygtygagaagattygttgggtygyggtygtagttaygagaatttgttggggygygaggtgygggagtygygaggygtgtttttygaaggtyggygttygttygtygtygtgaatttgtttattttttttagaygttaygtygtattgtttttgttygagaygtygttgayggagaagggtygygygggygagggtttgggtygtaattggtaygtgaygttygagattattattattgataatgatttgygygttatygagygttygagygttagggtttgggagttgttygggggtygtaygyggttatttttttaygyggttttygayggttttatttttggtygttagyggagtttagagtagttggaygagtttattayggatttggttatygattygygatttatygtyggttaggttttagagttygyggtygattgtttgggtttttaattgygtygattgttggattygyggttygygggtttyggggttttygygttggygtygttaygttygtttttygtttyggtyggtagygtygaggagttygyggtttygggagaggyggtygaygygtttttygaatttagygtygaygaggaygatttgatgatttgttttaatgygygttgtyggygtatygagattatgtttaaygtttgtttttattttaagttttgttatagttgttatatttattattgttygygtttgtgtygtygygaggattgggaygtttataaggygygttgygtgtayggtygygtgggtagygtgtgtygttaygtattgtagttttgtygygatagyggttyggtgtatygygttttttygygtatygygygtgtyggttttttgtygygyggtygyggygtgttttttttgggttttttaagtttaggttyggtygataattttttgygttttggtttggaggggttgttgttattttttatttatttatygttgygtgagttggttatataygyggygtttttgggtagttaygygygygagttggyggtygttgggygtttttaygaatyggtagagtgttttttgtttagygtgttygtggtygtgggattyggtatygygttatyggggatatyggttttgttygygttygygttaygtagttaygggttaatagtgygtaagttygttaaggtagygttggyggtyggtagtttygygyggtygttttyggygyggagtygygagttygatatggagaygttgattttgaygttatygtygggtayggygggtttggattaggayggygaggygggtyggygygygygygaggtggtttttatttatatttagygygagttgyggttgygyggygtttttttgygttaygagttttygygygtttaygagtagttttgygagttygtygaggttaataggygttttaygtttattattatttattttayggatyggygtatyggtygtttttttatgtgtatgattatggtygttttygagtygygygygttygattgggtggttagygttaatttgttggaygatattatgtgaggygtygggtttattaggtttagtttaggygttggttygaattttgttttgtttatttaggtttygttyggtttatttagggtygttttygagtttygttagggttttatttygattttttttaggtttygtttttaattttttagttttttaagtttygtttagttyggtttttagtttygtttaggtttttatttttyggtttttygttttygtagtgttttttataggtttttygtttttttatttttagtaatttttttttttttttygggtttttttttttttttagttygttttygaggatttttagaagaagtyggttttygttttyggtgtttttygttgggaggyggggtgggtttgaggatygtygagttttgtttttattyggaggggttattattgtatagattttattygtagagattyggttttygtyggttygyggggttttygttggagttttttygatttyggttttttttygtttagaagttygaygtaattaaagtttagtttgttattttaaataygtttygtttygtttttygyggttgtgttgttttttygttggagaatattttggtygatttttgtgygttygtgtgygygagygygtttygtygaggyggtgggtagggyggayggtgygtagtgygttttygttggtyggagttagtatattaattaygttaygygttttgtygttttttygtttttagtygttgtagtttgggttttgtaggagttgggaaaaatygtagggaggtttttaggtygatatgtaagttttttagtygaaggggtaggggatttgaataggggaagtagagtatttgggtttggttagagttgatatttggttaggagaggaaggattaagggayggggygtttttaggtgggagtttggagggtaaagygtggtgygagtaggtgagggagagagttagttggtaagygtggaagtttattygagggggtttgatttgtttygagaggttttygtatattygttttggtygtaygtygtattgygggygtggaggygtaagttyggyggttyggtttttatttgttttttaagtgtattttggttygygtttagagttttttggagggtggggtatgygggagaggggtggaggttaaaygtaagggtttttttggagtttttagttttatttyggagttaggggagggggtattaagtgagagaaattgggtattttygttttygtttttgttttygtattyggtaygtttatttygttttygygygtttgtatyggttaggygtttygtttgtttattygtygtygygtttygygttttttattttagggtttttgtattyggttttatttttgagggtyggtygggaaygtttttggatyggaataatttttagggggtaagagttttygaattaagtaaaatagaatttgaatgtagyggttgtygttgtttttttgtatyggtagyggggttggggayggaagttttyggtyggtggagaggagaaagggagaggttttygggyggtggayggggaagagagggagtttttygggyggtggagggggtggagagygaggttttygggyggtggagagyggggaggggggaggttttygggyggtgggagggggagagagggaggtttttgggyggtgggggttayggggagggtggttttyggattaygtgygggataggaggttagggttggtaagttttttaggtttttttygttgttttagtttygygggtygtttaattgtttygttttaagggtgttatyggatttygttggagaggaattttttygttggttggattttattattatttattttygattttaygttttttttaagyggggttggyggagtygtaaggyggtaaggaattggattgygattggttagtaygtgtttyggtyggyggtataattggttgaggygttgggttttgggaagtatttttygaygggattggtygtygttttygtagagttygtttttygtagtataagyggttttygggtygggtgggaggaggggatttygggaggaggaatatggyggtggyggatttygtttttatttttgatgtggatatygatttygayggygtttttaagtatgtgttgattygagtttattyggtttttygtttyggggtttyggttgtagagagtaaggagatygtgygyggttataagtgggttgagtattatggtgagggygggatttgygggtatgttaggggtaygtttggygaggygggggyggggttggygggayggagayggggttgaygaggtaggggyggggttggyggggygggggyggggttgygggtygtagyggattgygttttgtttygagttttgtttttgttaggtttgatttaggttgaggttttgggygggaagggygtgatayggtttgatattttttttagtagttttttagttttygygtttttttyggttttattttttttygtttatttatttttgttttagttttaaggggtttygttttttttggggaaggggttgtttagagttgggattttagattttttyggttgggagtttttttygyggtttttaagggyggttagggtaygttttgaggtygtttttttattttagyggatatttaygataaagtgtygggygatatgtagaagtaaggttgygattgtgagtgtttgggyggygggygtattttttattagagttaggataagaagatttaygtgtayggttattttatggtgagtygtagtttygtttygttttgtyg

SEQ ID NO: 6126 - DNA, 1089 bp, synthetic construct
  misc_feature 1..1089: note = Description of Artificial Sequence: Synthetic polynucleotide
  source 1..1089: mol_type = other DNA
gygggaaaygtygttttttttggygtttgagatttggggttttttttttatttggttttttygttttygttttagtttygtgygttttaggagggtatygtygagygtygggttttygtagggttygggagatttygyggatyggaggagggataggattttygagttttgggggygggaagggagggtggaaggaggaggggagyggggttggggaaagttggagtttyggtatttttttttygggttaggtygttttyggggttttgygttgygtttttaagtgttgggaagatttygyggggaaaggtttgaggaygyggtyggttggtataggtgtggyggttttagagggtyggggagaatttatggtttygaggttgtggattagaaatgtttttgattagaagttgagaatttttggttagggaggtggggyggyggggaggggtygttaagtyggtttagagygygtttatttgygttataagggagaagaggtgtttttygttttttttygtttatygtygttaygatgygtygyggatttyggygatttagttygggtagaagygygygttttttttttttagtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttygagtyggagtyggtagaggggygygggygyggaygyggygtttggyggggttttgggaggttyggayggggttttggygttgagttyggtyggttyggagygyggatttagtygtaggggyggygatgggtatygagggattttygttttyggtygtttttygyggaygttagggttgtttgttggtatttgygygggtgagtgyggttttttagyg

SEQ ID NO: 6127 - DNA, 1020 bp, synthetic construct
  misc_feature 1..1020: note = Description of Artificial Sequence: Synthetic polynucleotide
  source 1..1020: mol_type = other DNA
gygggygtgaggtttygttttygtygttttttgttygtttttagattygyggttygtttggtygttttatttggtygatggygttggtggtgagtataggaaggttattatagttttaatttttgaggtaatggttgaagttyggyggggygaagtygttgtaygaggggtyggtattggtggygatayggttggyggygttggttgttagggtagygttggygaygttgaygtygttggtattgggaggttgtttttagttagaggtattaggggggaaggtttygtagtggtaatgtagygggggygttagygtgaagatggggttygaggttatgtttagagttaygaagagtatyggtaggtagtagaggtygagttgtagttgttggtygtygtttagygtttttatttgggygagtagygttttaaagttgagggggtttgggggtayggttagygataggttgttgtttagttygtygtygttygygtttttttttttttttygttygygttttygtttattttgtagttgtttygtgggtatygtattttygagggtttygatttgttgttggggggtagggggtggtaggagaagggtgaagyggaggaaatygtagagtaagggtagggggtaggtgggagggagggttaggaaggtagttaggggygagggatgygtaggaggaaaatgttagaygtttygygggggygggggtgttgggagaggatggygtygttatttggggttygggtatttatttygttggaggtgggggtgatttttatagtgttgtygattttgtygtygttttygttattgggttygggggtttyggtggttattyggggagttagtttgtygatygtaggggttttgtyggttygygtygaaaggatgygttgttttttggtttagttgygygtyggttgttyggatatagatagttygaagagatttygttttgtagttttgtagtygygggygtttttttggtttttgygatttttgyg

SEQ ID NO: 6128 - DNA, 6343 bp, synthetic construct; identical to SEQ ID NO: 6125
  misc_feature 1..6343: note = Description of Artificial Sequence: Synthetic polynucleotide
  source 1..6343: mol_type = other DNA

SEQ ID NO: 6129 - DNA, 1109 bp, synthetic construct
  misc_feature 1..1109: note = Description of Artificial Sequence: Synthetic polynucleotide
  source 1..1109: mol_type = other DNA
gygaagttatagtygtatagttaggggttttygtttagaygtagggagygtagygygggtagygyggttagggyggttaygttgaggttgygtaggttgttgtygttgagttttagtatttgtagygattttagggtttygaaggygttttygtgtaygtttattaggttgttgttagttaggttaagttttattagtttttyggtygagyggaaggygtyggygtttagttgggttaagttgttgtagttgaggtygaggaataygagtttggtygagtygttgaaygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyggtygyggtagtttayggtgtgygggtyggtgtaggygtagttygyggggtaygygtgttygggygygagtagtagtagaaggttgtagagttygagygtygyggyggygtaggttggggttygggggygtatggtyggggggttygygtyggtygyggygagaaggaagyggttttyggagygagttttggygygggayggygyggtgaggtattggttgtygggygyggggagttagagggyggttygggyggggagggygtgygttygggygtgygggggygatggagygyggygyggayggattggggagtygggatagtagggatggagaggggaggggyggggagggaggggygagggatttattaaagggtttattyggataggaaattaattygttagaaaaattttttgggagaggygggagyggtaggggtggtygagtggtygtygttaaaaygyggttttattttggtagttgattttygagatttggtagtaagaygtygygygtatygggygggttgtattygaygtttaagtttagttattaagtttaggagyggtttttttaaggygtgtttygggygtgygttttgttttttygygttygtttggtgttaaagtaygttttttgtaygttattttatgtyg

SEQ ID NO: 6130 - DNA, 1109 bp, synthetic construct; identical to SEQ ID NO: 6129
  misc_feature 1..1109: note = Description of Artificial Sequence: Synthetic polynucleotide
  source 1..1109: mol_type = other DNA

SEQ ID NO: 6131 - DNA, 1384 bp, synthetic construct
  misc_feature 1..1384: note = Description of Artificial Sequence: Synthetic polynucleotide
  source 1..1384: mol_type = other DNA
gygggagtattagyggtttaygtygaggaagataggygtttttttttggggtgggtagygtaggtttggtttgygggtggggggtggagagtgagaggtaygyggggtattagtttagtttttttttggggatttygtattygtagtttaaggaatyggtggagtaygaattttatttttgagttggygtaagygttttttttttatggagatttatttyggtttttttttgaggttttttttttaagtattttttttttygagtatttagtatttttttaattttagtayggttyggggtattagttttttagggygggggttgttttatygtttaagggaggggatagagggtyggtttyggtttaggygatttttgtttttygttaggggygttattttggttttttttygattgtygttygtygttttygttttttyggggggtgtgttttygaagtaygggggygygggaggttaagggtgtttttagttttygatygagattttttttygagtyggyggygaatggtaggttttatttaaagagtgtttggtggygygyggtgttttttttggagtagttttyggygttygttygtyggggtttyggygatygttgttttttttttttttttttttttttttttttttttttygtttttttttttygtygtttygttatygtygyggttagggttggaggygtygttgttatttttgtgtyggaggaatyggygttgtyggtgtttgggggtyggggygygggygaagtygggtygyggaggatataataggtagagtygggggtgttyggtygygygtttttygygtattatgtagttttttgttatttttttygtttttaggttaaaattttgagtatgatggaagataataagtagttygygtttygtatygatggggyggtttagtyggttagttaggaggtgattaatttgygagtygaatttayggttattaatyggagattggyggaattgagyggyggyggyggtttyggttygggttygggagtygyggttagygtttyggyggygggggattyggyggygaygaatatggagaatttttagtttggagygtaaggtaggatygtttyggygtttagggyggaggaaggygagtagagtaygttyggtttyggaggtggtyggggattyggggttttttatattyggggygaaatygttttgtattttggtttgtaatttttttygttyggyggtggttatygttgtttttyggttgggagttgtaggttgttgttatttaygaaaattygagygtagtgtgtayggggttatayggttatatyggtttyggttagtttgagygaggygtagtyggygggtttttttyg

SEQ ID NO: 6132 - DNA, 1384 bp, synthetic construct; identical to SEQ ID NO: 6131
  misc_feature 1..1384: note = Description of Artificial Sequence: Synthetic polynucleotide
  source 1..1384: mol_type = other DNA

SEQ ID NO: 6133 - DNA, 835 bp, synthetic construct
  misc_feature 1..835: note = Description of Artificial Sequence: Synthetic polynucleotide
  source 1..835: mol_type = other DNA
tygtgaggtygtgtgtgagtttttgygtgggtygtgagtgyggtagggagygyggtgttygggggtygtttgtyggtgtgtttgtgygtgtttgtgygttagtttttgtttttgygagtgygtatttttaggatygagtttgtttatatgagtttgtgtttgtgtgtgtgygttttyggttttgygtgtgtttgtgagygtttgtyggggygygtgtgtgttyggaatttygyggtggtgtgygggtgtgttygtgtgtttgtgtaygtgtaggygagygtttttatttgtgtgtgtgtatttgagtttgggttatgtgtgatttagggattagtttatgagtttgtttgtgtttttgagtygatatttgtgtgtgatttagggaygagtttatgagtygatatttgtgtgtgtttgggtgtttgtgtygtggtgtgtttttgtaagygtttgtgtttgtaggtgttggagtgtgtagttgtgggaatgagtgygtgtgagtgtgyggaaggggtatygygygagggagygtyggtgyggaaggttaagygagttygygttttttayggayggtgtygttatttttttttttygtttygygttatgtgtttttgtgtgttygygtygtyggggtygtttttgggtttygggagggggttgagygagyggttttttttttttagggatttygggttygtygttagttttgggtatattygtttttttttttagyggtttygttygttgatttaygggtattygatgggtattygggaggtaatggtyggagaggatgggtagttagygggagggattgagtggygtyggttttayg

SEQ ID NO: 6134 - DNA, 2248 bp, synthetic construct
  misc_feature 1..2248: note = Description of Artificial Sequence: Synthetic polynucleotide
  source 1..2248: mol_type = other DNA
tyggttttygggyggtygtttaggaggagatttattygttgggtttttgatygttttttaggaaaattttaagtayggaaattaagttygatatyggtttyggtattttttttaygtygttggtagtttaaggttygttttgaagaagagttgtagaggaggaaggtggttttggttyggyggagttyggttygtttggtgttaggygttggtgttggygtygagtgaatttaggyggtttaggtgttyggtttggtggygggygtagggtttgyggtgatggaggtttygttttagttyggttaggtttagttttgtyggtygtyggttygggatatgygyggygtttaggtttgtagggtgttttgggyggttataataaagttaaagatyggagtaagagttttyggygagaagagaygyggagaagtyggagtttyggaaagtygygygtagtttygttagtygtygttagttgyggaggaattygggttaattttaaaaatygttggygtttttgggtygtttgttygggtygtattgggyggtttttatygttttttttttttatttgtattgttttaggygggagagaggttttggtttygagggattagttgtagygggtagyggggttttgtttttttaattttygttttatggtayggggttgaatyggtattatygaggttaagggygattattaggagagaagatyggttgttttygttatgygaatttgtgttttgygatttygttgyggttgttygagttatgttagaggtggggaygaagggttygyggggagtgaggtgggtagaggagagaagttggygttttttttagggtttttattttgyggagaagttygatygtagaattyggtyggttgyggtttatgttggtagttatygygaaatgygttttygattygggatygtattggaaattttygttatattgtgttaggtttgattttttaggagygygttaagggtttttygtttattgyggttyggyggttttttttttaataagtaaggttygtgatttygattttggaattttgtttttatagggaggagtttttggtggttatygatyggtttagtagttyggagagaggttaggaaaattttttyggaaygygttgggaggtttttttattttygttttttttygggygtayggagattttyggttttagggagygtttatygattyggatgaygtggggtatttygygygagttygggatttagaaggygtataygaggagttyggtttagtatttttaaattagatttyggaggygtygttagggagyggttatygttgggygtygtygagygtgttyggggygyggtygtggygggttttttggggyggtagttttaggygygggygygtagtagtttygaaggygtygtttggtttagtygttyggttttygagygtygttgtaagtggggggygtttygyggygtygygtatattttattggggggtygtttygtyggygttygtttygtttggttgtygtttaygggttgttygygagygaggtttttgggtttygttyggatttygttyggattyggtttyggtttygattygygtyggttyggttttygygygggtttttatttgtttyggttgtygggttttggygggygggttgtaygygttttyggtygttttttttttagtygtygtygatgttatygttygggttygtataaagtttyggagtggagttgtaygygygtatatttttttttttagtttttttttttgygttttgtttttygtttttygygtygttygtygttygygtttttttygygtattttttygtgtatatatattttatatttatatttgtygaggygtatattygygygtttatatttgygyggggggyggggaaggggattttggttttattgtagggggaygttyggagaaygaggatttttttygttttttagaygtttttattygtttygtyggttttagttttttttattgygagggtayggagttygggagttaggygtggagygygagagttggtatygygagttgggagayggyggtagtttagyggtyggattagttggaggagaygygttygtygggagtagygagatygggagttygtygtttgyggagtttggtttygyggtttttaygyggygggygttggttggayggyggtggtagygggagattgattygggaatyg

SEQ ID NO: 6135 - DNA, 3541 bp, synthetic construct
  misc_feature 1..3541: note = Description of Artificial Sequence: Synthetic polynucleotide
  source 1..3541: mol_type = other DNA
tygyggggagtaggggtygygttatgyggyggtyggtttgtagtagggtagaagttttttttygtttgggtgtgtgggagygtagattttttyggygtggtygggaattaagtyggggttyggatgaaaygaaaygaaaaatgaatattygaattttttttgttagttttttttttttttttttgtttttttttggggggagggtagggtagggaaatataaggggaaaaataaattaggttagattaaagttttggttattttttgtttttatatatagaygyggttttygygatttttttttyggggtttygataaatatagtatattgygatttaaattaagggygygggyggagttagaaggattttaggagtygagaggttttaygaataaataaaaatygtaaaaaattaagttyggagaaaggggaaagyggggtggggygtatttttataggagagaagaggygtgtagygaataaagtgatagttttttattttggattygtaggtttaggagtttaygyggggagaggggatggagaatttttttygtttygttttttttttyggggaatttttaatttygtattgygttatttgtygttttggggaggtygttgtygggattyggtttygaatagttygggggggtaggggygggggtygtygaggggatgggggtagagagtaggyggygggtaggatgttyggggtgagttggygagtttyggattttygtttttttttttyggggttygggygaygtagtttatygggttgttttygtygtttatyggagagggtygttygggtgtttggttttgttygaaagtttttgggtttttttttttttttgtaaaatttaaagtaatygaataaaaagagtttaggtygygygggygggttgygygttygygttttgtagygygtyggygggggttyggttygyggggttattgtattgagtygggtagtgtgtggtggtggtggtggtgtagygtygtyggygggggyggtgggggygyggagggtggygatgygtygttttygttaggttttagttttttaggygygtatatatygtttatgggygggtggttygygtyggtygtaggggttatgygtttttttttttgtygtyggttgtagaattagaygygtattatttttttttttagttgtaggttgtttgttaagtyggtgatttygtgygtygagggtttggggtatttgagaaagtggttttygagygygtttttgatttttatttygatggaygtgygttttttgygtttgyggttttgygtygygattttgtttaggttggtggggttgtygttggaygagtyggttttttttagttatttgttgagtagyggtttgagtttgtatatgtttttgaagtttagttgtagggtttygaagyggtagatggtggtttgygagaataygttatygtagagygtgtttagygttagttttaygtyggtttgygtaaagtttagtttgatgygtygttgtttgaattgtttggygaattgttttaggtygttygagttgggygtattttygttygagtgttygtttatygatgagtygtygtygttygygttygggtgtaggtgygtygtygtygygtgtaggtygttygygtgtgtatgttygtgtgygtgttygtgggygtttagatgyggyggyggygayggttttagttgygtttygtggttattttygtgtagygygtggtgtaggttyggtttygygtygttatygttygtygttagtatttyggttaggtygtygtygtygtttttygggtaggtygtttgygygtatagttygagyggttggggttggtggttttygttggtttygggygagggygatatggtygggtttaagtggtgygttgtgttgttttgygtttatgtygygttygygtgggtygttttttggtgtattaggygygygtggaaattttygtygtygtygtygtygtyggttyggtyggtgtygtygtygtttgttttgtygtgttttaggtgygggtygtyggtttaatygtygtygtygttttttttygtgggtagttattgggggtgygttaggtttayggggtggttygygttygygtttagttattygtggtgtattagtttttgtatttygyggtaygyggtttttgtatgtaatygtttygyggtygtygtygtygtygtygtygtygtggygttygggtgtataagyggttyggtgttttyggtttygttatyggggtttygyggtaggtattgygyggtggtggttatgtygtttygygttttgygtygygtygtygtygtygtttygtttygtttgygggtttygtygtttygtttygtyggtttaaagtttygattygttyggygtttyggagttttatttygttygtygtttattggttgttygyggagttgtttttygttttttttgttyggttttygtttygygygttygttygttattttgttyggttgtttagagttttttattgggygtygttttyggggtttygygygtyggtygtgttgattggtygttggggttttatttayggtttttttatygttygygtatatatttaygtttygggggygyggtygttaygtggggagtggygygggggtggttttgggatygtattttttttygttttggttgtgtgggtttygtttttttttagygttggagatttygagttyggtyggttttatattttaygygagttgaattttygttygtatttygttygggtagtagggattgtyggtttygggaggygttygggtttygagaagyggtttagtttygygtttttttttttttagtatygttgtyggyggattaggattttygygggttttggyggttgygagygygaggyggygyggattygyggttyggtttyggygygattgtttatygygttygtttygtttttygyggttgttagygtgtattgggygtttttyggygygtttgttyggttygtttyggtttttttttttttttttttagttttagygttataatttygtygattttttttgttttgagagygygttyggtgygggyggagtyggayggattttggttttaygtttygygygggtatattttttttygggtattgaggtttaggtgagtatygygygggtagttggggttgggayggygggyggtagyggttttatagttttaygygagtttttggtattyggtygygtttyggggttttagaaggagaagatttygaggtggagattgtggtttyggggaaaaygttgttggtaagggygttagttgggggtggaygttgggtttaggggtatttgatttgygtygttgtagttttttygtttttttttttagtttgaayggtttatyggttgtggtygtggtgggattaygtttygggagaggagaaggatgggtttagggaaggggttygggttttttagaaattyggygtgtaggtygggagttgtttagtttyg

SEQ ID NO: 6136 - DNA, 1513 bp, synthetic construct
  misc_feature 1..1513: note = Description of Artificial Sequence: Synthetic polynucleotide
  source 1..1513: mol_type = other DNA
gyggggygggtyggggygtygttgygggayggtatttaagggygygygttgygtgttgttttygyggtttttygggygttatyggttyggttaggtttygggagttgttygttttaggtygygggggygtttygggttygtaggattygaaaatttttttttygggtyggggygggtgagtaggygggygttgggttgygttygaygtttttttaggtygtttaggagagtttygagggttgggagaagtygtyggggyggttgggttggaygagygagtttaggggttaatygtttttattygtyggtygygttgtagagyggtgtttttagggttggggtttgyggygatttygttgggaggaagggagagygagaattgagaygtttgttttaagttgtttggagttaaaggttttygagagygtggtygtggggttgggtygttggagtggtygtttyggtttagatattygtattttyggyggtgyggyggtttttaygygygtatttatttagygygttygggggtttgaggtygtygttayggygtttygtttygggtagtagtaattagtaygtaggtatttttggaataggygggattgttttttygaygygyggtttgygtttaggyggyggaggggtttagtttttttttagttttyggttttagggygtagggttaygagttttygtttttattttyggtttttggtattyggygtyggtttygtygtttttttttataygtatttttggtagggtttygyggggygttttaaagtttgggggtagtttttaggtgtttttgggaagggaaagaaaggttataaagtaaaagaaggagtaaagagaaggygagggaggagtaggggttygggttttgtggattygtttgggttgggagtggggatattgagagggttgygaaggtttygggggtygygygtggttygtaggtttatttttggttygyggttgttttttttttttttttttgggtttttggttttttttagtgttgttttttttttttttttttaggtttttttttttttygygtagggtttygttttggggattaagagaaaggagggaggggaaaggggaggggaagggaaggggyggaggagaaagagggaygatttttttaaaggygggtgttgagttttagtttaggattttygggtttaattgtttgtggtattttttatattttttattttygtttygttttggttttgttttagttttyggygtttttttttttyggatttygttgtatgtttygtttgyggtggttygatyggtttttttygggagttttttttttttygttaygttttygttttttyggtygttttygygtttttyggttttttttttattagttttatatttgttttttttatgggagggagygygygtttttygtttagyggggtttttagtagagtttttttaattttyggygttttttttatatagggttygttgggtygtttttgyg

SEQ ID NO: 6137 - DNA, 3541 bp, synthetic construct; identical to SEQ ID NO: 6135
  misc_feature 1..3541: note = Description of Artificial Sequence: Synthetic polynucleotide
  source 1..3541: mol_type = other DNA

SEQ ID NO: 6138 - DNA, 558 bp, synthetic construct
  misc_feature 1..558: note = Description of Artificial Sequence: Synthetic polynucleotide
  source 1..558: mol_type = other DNA
tygagagygtaggattattaagagaggtygggttatttttttygtygttygttgatttttaggggttgggtyggygtatagtaagggggttggaggtggggtygtttttttttaygyggttgggtttttaggyggtgttttgggtygagtygtttggagattttagattagtatgtgggtgggaaagggygtttygttttgggttttttygtttttgygygtagagtagagaygygtagattygtttttatttygtttggtttttttggagtagtttyggyggyggtagygatgggttgggaggggtyggtaygttggtttgygygggtttttagtygtttttygttattyggaattttttttttttaagygttgatygtygatttatagtttttttttaattyggggygagyggggtttttattatatatttttttttttygttyggttttatttttttttygtttttttttaggttttayggtttgtaagtatttttgtaaataatttttagtttatttatatygtttygttygtatttttygagagttaggtayg

SEQ ID NO: 6139 - DNA, 7244 bp, synthetic construct
  misc_feature 1..7244: note = Description of Artificial Sequence: Synthetic polynucleotide
  source 1..7244: mol_type = other DNA
aygtttagttagggygtagagagagygttgggygaagaggggtygatggttygygggaatagggttggggtttttgtttggggatyggtyggttgttaggtttttygttttattgttttttyggagygtygttgattataggttygtataggtygtygtygtaggtyggttttttgtgtatygtygtagtagyggyggtygagyggttaygtatgagatygttaaaggygtagtttatgggtgggyggaagtygagygtgggtattaagtyggtagtggagtagggygttatgaaggttagatygyggttgtgygtygtygtygyggagtaggttaggygtagggggttgaggtygagyggygygtttagygggtaggygttygygtyggtatygaagtgattggygttgggttgtagyggygagaaggtygagyggttgtttagygagtttagygttttaggygttatggygtyggttagtaagggtttgtggtgyggaggtgyggygggtttygtttgtagyggygtaggtagtttaggtttttyggyggyggyggyggyggyggyggyggygtygaygyggttgggttaygygtygtttgtagttgttgtagtatttayggyggttttatttgggggygtygtagggtttaggtyggtygttaggtttttayggtggtggtttagtatttgttygatggtttgtattaygtygtygtygtagttttgtaatattagttttaggaygtttygtyggtggtttgggaataygygtgttaagatatttagyggygttygttgtygtggattygagttttygtttagttttggygtyggygyggttttatttttttttttgttagtttttgaatyggatttagagtttagagggttagyggagttygggttgtttttttygtygtygtygttagggttagygttgtttgggtagttgttatttgtttttttggaggttygagttaggggygaattagaaaaggattygttatygtygtttttygagtttgagtygggtygtatttttggggaygaygtttygggtttygagtttgygtygtygggtgataagggttttatyggyggyggtagygggttgttygggyggtttgtttgtagtagygttttaggaaataggttaaatttttgtaatttggtttttgggaggggagaaaaygtgtygtgaggagyggttagttagaagatagtagttatagtatttyggttttttggattttagtttttttttttttagttttatagtttttatttattaggttttagtgtttttttttttttttgttttagtatttttttygttttgagtttttatagttttgattttagggttttttttttttttgtattttttagaattttaattatttgtgttttgtaaattygatgtttagtgttgttttttttaygtttgtgttttaatatttttatttttaattgtttttttagttttgttttgtygtggagaagtggttaggtttagggtttaaataagagataatataatttttgtttaattaygttgtatagaagagtttattgtatagaaaatgtttgttttggtagtgtagtttgtaaggaaaggygttttggttatttaggaggttttaagtttttttataggtagaagtatagtttttgtttttaatttattttttttaaaattgagatttgagaagttttttttttttaagtttagagyggatttttttttttttttaayggttttggtttaattttttttttttttataaaaagttaygggggtttagaaaaagagggtggtgttaggtaggtagtaggaagygaagaggaaaagatataggaaagtagatttgagaaattagggagggtgyggaagaaattagaaggagggagggygtagtaagyggttgtttagagggygttaggaaygygagaaggggaaaagaaattagggygttttagaatttagggygttttaaaatttagggtgttagttaaagggggggggattttttaagggagttgggaaggagtagagggaaagggtttgtggagaagygtagagygaaygaagatgygtaggtttttatttggggagaagaygaagtaaagaagtagggatttgtttgygtttgggtagaggygagtaaaaaaattaaagygtgtatatttyggttygatgtaggagaaaggggtaaagtgtaaatgttttagaagygggagaaaggagagtttttgtatttaygttttatattygaggttgggygagyggtgaattttagtagtygyggygattggataygggggttttattttttttgaatygagataagtttttgggtttygtgttttagagttaygattttgttgtttttatttgyggtttggtygygtttttatttgagttttttgygttagttgtttygttttyggttttygygggygttttygttttaggtttttygtygtyggyggygtatattgaatygaagatttygtaggygggtttyggggggatgatgtygttggyggyggttagygttagtttttyggtagtgtygtagagtagttgtagttygygygtttygttttttttttgygtttgttgtttgygtagygttatttgygtygttatgataygttggygtttygygatgagygtgtatttggygtataggtagtttttttagygatagtagygtttgtggtttttgagggtygatattaygttatggttgygatagygygygtatttgggggttygygggtatttttyggttgttygtagtaatagtggyggttttygtagtaagtygtttgttaygtttatyggtagygatgtagyggtygtygyggttgtygttatygaygttatygaygttataggyggtttygtygttgttgtygtygtygtygtygtygtgtygggtaygttgggtagtttygagygtagttttatgataggatttgaygggaaagaaggtgggagaggggagagatttggtgaggagtatatygygygttaggttaaagygtygttttgaggaatttaagttggagagggaaatttgggtygyggaggttgggttagaggggttagaattgttgggaggaggtgtagtyggaatttttttgtgagttttagtatttttattttagtttggttatggttgtttttagatttgatatataygttaggggtaagattttgtttgaattagtgatttygttggaaaaaataaagagatatgtaaagtgtgaaagttattgatttagatggttgtaatgagaatttggaaaagttaagatgatattttaaagtttagtttaattggggtgagaygggtgagagaaatgttygtttgaygggattgggattagagygatagttttggtttagaagttaggttgatgttaagggtaaaataggaaaattyggagtaaaayggttagtttggtggaagggtgaagaggagagagatgtgaaggygtagatgtgaaggtyggttgggtyggagttttgtttttttttgtttgtttatttttaatgtagtttggggtagaagttttggagagaaaaattaataatagaaagaatagttttaggaagtagagtgaggaygaggaaataatttgggtaaagttaggtttagtggttttgggattygtaaaaatgtgagygttaaaagttttayggtgagggtttttagagagtgagagataaaatgtatgtggaatttagtttaggattgggaagtattaaagagaaaaattyggttaaagaaattttttgtataggtaaatttagtttaaagatgagttttatgggtaaggaaaatagtgaaaagtagttgatttgggtgttygggatttaggggtygygtttgggagaggggaatgtgtaagaaaaaattttataggtaaatgttgggggaggggattgggtaaaatttgtggtgtagttttttagtttygtagtttggagtagtagtyggggyggaagaygtattttgygaaaagttaggtatttygggagggggatttttttygaagattattttatattgtttttttttttttttygggtttagggatagagtygttagataygtttttttygttttggggttttaggggatttttttygagygtaggtttttgygttttgattttagagttggggttttaggatayggatggtttagtaggtygtattaagttaggggagtygttttygtaattggttataaayggatattagagttttttttaygtygtagttttataaggtttaagtaggtttagtttttygtttttgtygyggttttttttgtttttygygtttttygtttttgttagagttygygatagagtttttgtgttttygttygagagttttagattttttttttatgagygttgtttttttttttagatttttygggygtttttaaggtttayggggtttaggtttttttaataggggtygtagattaggtttttatttattgttttttttgyggtttttaattatttgttttgggtttygggatttttttttttygttggygttgtaygygtttttyggttttattggygaygttggagtttttggtygtttttttttgttttyggttttttatttgattaygttatttttttttagttattatgttygaattttyggattttttagaaygtagygtagtttaattttttttttagaaattygggtyggaggttygtttgygggtygygtggttggaattygygatttgattttygtygtgtygggttttttygyggtgygygtyggaygttgygygtagtyggggtttagttgttyggygttgttagatttttaatgagtygttygttygttttattgttggtttttagggttttattagatagaattggataataatgtggygtttgttattggttaggggaggtagayggygttttgattggtygggttygygttyggggagtttygtattttgtagtgttygaaagattygaaattttaaaagttttattgygtgtttttgggaggggagggggygygttaggaaaggagtggaaaaaagtgggygaggaggagygttgaaaattttttgataagtagttttygtgygttygagagygtgtgaattgtttttaattatygtgttyggtgygtttttttgygtagatttgtgtaatttttyggtttttggggygtyggttyggttgtatygtttttattggtttggggygtttggtaaagtygagttttttaagtggttttggagttttgaggygggatggggggtaggtgataatttaattattgyggtyggggtaggggygggataagggtgygggggtggggaagggagggtgtttaaggtataaatgttaggaygattttttttgttttttttttgttatgtttyggygygtttttaaattygaygagtttggggtagttgggggttgttttggttttttttttttgtttttttaaagtttagttattttattttaaaagttttgataygatagttattttggagggtaagtgtggtttatgaagattttygtgtttaaagagaagtttagygaagagaaatgagattgtattttttgtyggtgttygttaygtttttygygttttgagtttttttttttttygttttttttttygygttttttagttttttttgagtttttttttttttattttttagtatttygatttttttttygtggtggtgggattttttttgtygttattgtaaatgaataaatagttttttttttttttttttttttttttaaaygaaagtaaaaagtggtttttgtgttttygtagatttttttaaatttaggaygygtatyggtttgttygattttttyggtaagagataaagttattgttgggaggttttttyggatagtttttagttttaattttygttttattttygttttgttttgatgttayggttttgaggaatagttygttttgtagaagaggtaataggttttagattttgttttttttttgaaaggttgttgttttttaaatatttggaattaatgtygyggttttygggygagtygttttyggtttttgtagttttgattttatttttgtgtttttttttttttaatttttaaagttttgtttttttttttaattttgtttttttttttaatttttaatgttttgttattttygtttttgttttttattttttttttttttttttagaataaagaaaattygtttaaataatgaggaaaatgagygtttttgtygttttttttttatttttgatygtgygtttttgygttgttttttygaatttttaggtyggygggaatttgggygygtagattyggttygggtygtygyggttttaggaygtagtttatttygtttggtaygattattgggtygygttttgttagtttattagtttttgagtttaggaatgggggtgggggaaggayggtgygattaaygggtttttattygaagatygtagaatttggygtttyggaagagttttggaagatgtttatygggaggttgaggttggagggaggagtgggtgggggtgattygttggaggatygggyggagagtttttagaaagtttattaggtttyggygygagggygtttygatayggataaggtttatgatagygataaaaagttggttattygtttttagaaaatgttatttgttggagtttgtgaatgggtttaggagagagaagggtgttagttttygygagggtttttygygtgaagtgaggataagggagtgttttagggataatatgttttttaggagygtaggatttagattttattttttaatatttggaggtttygaggttaagtatgtttagtttyggttgtatttgggtaggtgagttatggggtygggggaagagygtygataatygtyggatttygygtaggggtygttaggygtttgtttttagagtttttttggataaagttttygggaaattttattaaatygaaaaygaaataaattatataaatttgtttagtttttgagggggyggtggtttaggtatttttttygtttgaggttaggttatygtgagatttttttatttyggatyggggatttygtagaagttaagggtgtagttaygaggattygggaattygaggyggtttagtagatgyg

SEQ ID NO: 6140 - DNA, 824 bp, synthetic construct
  misc_feature 1..824: note = Description of Artificial Sequence: Synthetic polynucleotide
  source 1..824: mol_type = other DNA
aygyggattgagygaggaaatgtttaagattataggattgaatttttyggaagtttygaygttgtttagttagttagagtttagtygtygaygyggatgaagttgttttttygggataggaagggttaaatggttgygygttaattyggtttygattggggtgttagggagtaagagtygtttgtttygggggatttygtttggggggtttttaggggtygttttggygtttyggttataatttgggyggttttgtgyggyggttttygtttgygtttttgygygttatttaaaattttgygtatattgtagtygtygttttttygtttttygyggtgagaygygygtygttaagtgtygtaggtagttttttatagtygtygyggtagtygttgtttggtttttggttttagattttttttttattgtttttagtttttatttaggaggttttttygyggtygygagagttyggygttygatttatagtaggtagtgygggtatagtgttgtagattattatttygttaggttygggtagygtttattagayggataggygttygyggtygtttttatttyggygygtttatttygagttttttaygtygyggygggygggygtaatatatttttttatttttagtygtygaggattatatttttygtttagttttttygatttatttttyggttgtagtagagggygagygggtttygtttttgttttttggggttggtaggttygtgtggggttagggygygygggagaygtygyggagttgggtatttyggagaggggatgtttatttttagyggtttyg

SEQ ID NO: 6141 - DNA, 824 bp, synthetic construct; identical to SEQ ID NO: 6140
  misc_feature 1..824: note = Description of Artificial Sequence: Synthetic polynucleotide
  source 1..824: mol_type = other DNA

SEQ ID NO: 6142 - DNA, 1415 bp, synthetic construct
  misc_feature 1..1415: note = Description of Artificial Sequence: Synthetic polynucleotide
  source 1..1415: mol_type = other DNA
tygygttgttagaagtygaygttagygagggaggtgtgaagagttggttagaatgattaattttttttttatatttattttttttattatyggtggttygttgttgttgttttgygaggaagaggagtygtgggygggtyggygtatttyggtgttatttttgtattygggtttggttatygggggtaygttggttaayggtatggttatttatttygtgtygttttttygaaagttgtagattattagtaaygtttttatygtgaayggttgygtygtygattttagygtttgygttttttggatgtygtaggaggyggtgttygggtttttgtttatyggttttgyggagtttttygtagattgggayggygttgggggtagttatygtttgttayggggtgggttgttgggtttyggatttayggtgtttttttttttttattgtttygtggttttgaatygttatttgtttattattygggygttygttatttattaggygttgtattagaggygttatayggygggtatgttggygttgttttgggygttygttttgggtttygtgttgttgttttygttttgggtatygyggttyggygtygygttatygygagtttattattyggygttgttggtygtygyggygttgttggygtagatagttttgttgttgtattgttatttgggtatygtgygtygygtgygtgttagygttaagygggttagygtgtttaatttttatttgttgtattagttgttyggttgygtygtygtygtygtygttttttygggygtttagtaygygtygggtttyggtggygtygygtattyggygtaggtttagtttttgtygttygygttgtattygyggygggtatagyggygttttagyggtttgtyggtgttgttgttttgttgygtttttttgttggttaygtagttattggtgtgggtgagtttggttagyggtttttygttgtyggtgttttggggagtgtaggyggttagttggtttttgtgttgygttttgttygygtttaattygttgttttataygtggaggaaygaggagtttygtygtttygtgygtttagttttgtygggygtyggygaygyggyggtygttgtygttgtygttatagtygtgttygtagtgttttaggygtaattgggtattygygtygygggttagtattggtaatttagtyggggttygagggaagyggagattttyggttttygaygtttttgggtatygtygttttttttttttttagggtattttttgtttgaaygaagattttygtygygaagttygatagatygggggaaaatggggttttygattttagygggttatttgaattaaggygtttttttaagtggggygttygaagttattttggayg

SEQ ID NO: 6143 - DNA, 1415 bp, synthetic construct; identical to SEQ ID NO: 6142
  misc_feature 1..1415: note = Description of Artificial Sequence: Synthetic polynucleotide
  source 1..1415: mol_type = other DNA

SEQ ID NO: 6144 - DNA, 3039 bp, synthetic construct
  misc_feature 1..3039: note = Description of Artificial Sequence: Synthetic polynucleotide
  source 1..3039: mol_type = other DNA
tygygggattagttttggtttttatatttygttgtagttttgtttygygtygtattgtttttttyggttattgtggggttattaagygatttgtagaattygttgaggtttaggtttttgtagttttygtygaagatttaaagttagagtggatataaaygtygtgggtaggatttyggtgaggtttyggtgttttttttgggggtttttagygttggtttagaagttttagttygggtttaagaatttgggatttttttygattttggygatyggtygggttattyggtttagggttttagyggtagygggtaaaattttagtaggagttttttgtygagggygtgtttygaygttagagttaaattygggatagattagttaagygyggayggygygagagtggttggtagygttagtaygtagtttgggtttagagtaaggttgggygtttttagtaaagggyggtttggggttgygygggyggyggattgtaggygggagaagagygaggtgygttaggttttggggygygtaattgtttagtttygtgaaagatygygtygtagatggggygtagttgygygtttattygtgtggattggaaaygtttygagtyggttattttaaaaatygggaaataaggygggtttttttttygttygttattttttattaagtaggttgtgyggttttgggggttgattgtttttaagtagttaggttttatygygygtygygttgygtygaggttygttttgtygtagggaygttggtagttygttgaatatyggtaagagygttagaggttagyggtygttaggatttttattaggttttgttygtattygtttgtttttttttygtttggtttgtttttygtttaattgaaatygttaatttttttatttttttgtttttattttgatatattttaygttttaaatatgtttygtttttttttgtttagtttgttttttttttttttgtttttttttttttttttagttattygtttygttygattttgtttttgttttttttattygttygttttttatttatttattttagtttattttagttygtygattgttatttattttttygttttygtygygtttttygttgttttgtttaatttttttttttttttttttggttgtygttygttttttttggttttttttttyggtatttygttgttaaggttatttttgtygtyggatttyggggtgttgggtttttttyggtygttygtttygtattagygttttttgtagttygygyggtatyggtgtggttygggggttygagttgtyggtgtyggatgyggygygtttagtagggaygygggtttgggggggtggtttttgttygaygyggagygttgagttaggtygggtatttgtttttggyggtgtttatygtattgygyggtttttgtygtttggttgggattagaggagttaggttaattgttttttattaagttttaattgtggtttttattaggaaagttttttttaaagggtatagataygaagtttygyggattygtttatttttttygttgatttatatatattttttygtttttttttatatatttttatygtttyggttgggygaaagtyggagatgttyggttatttygtggaggttygygaggygttagtygggyggyggtagggggttgaggyggattttggaggatttagttttgggtttaggttgygggatatggtagygtagataaggtgggtgtagtgyggaagtygagaygttttataggttatagggtgyggyggayggtygtagagttgtygattagtttgttaggtttttgtttttaggygtattttyggatgtyggygyggtttagtyggttttagtatagggtatyggttygtgagttygyggygttagggggttaggttgtttagggttgtttttgattgtttagyggtgatgatttagygyggggaagttaagattgttagaagggyggttattatagtgtataayggtagggaggttagtttagtatgagaaataagaatatagttatttygttttgaggatagttttggtattgtaygattagtygyggttagattgtgttagtttgtygtataggtagtattttttttgtgaaggttaggttyggggaggagagaygggttaagattaggtygtagtttttagtygatttygatttgattattttaggttgaggtttagttttagggtttttaaagggygttagatataaaagtygygttttttygttaggttttagtgtggttttatagttttyggtygggtttgggttttagggtaggtggtagttttagtttaatttyggtagagtatgtttttttttttttaggtttaattgttttygggtttygattggatttygggtygtygttattgtattttttttygatttttygttttttattttygtygtygaggaayggtggtttattttttygttttatattggtttttgtttggttygggttagygttaattyggttttygtggaagtygtggygaaaggygagaggggtaaaaagttgagaaataggygagygggagagataagtaggaaggttygggtgggttygggtaaggaagaagaagagagggtygggttgygygttaygtttygygtygygygttatttttygyggggttttygtagaagtggtygtygttgagggtygggtygggttygaggttttgtaggtatttggygggyggtttggtyggttttgggaggtagggttttaggggttygtaggtyggaaagygggttagtygygggtygyggggyggygyggggtgtaggtgaggygtagyggygggggttttttgygggttyggaggttygtttttygaggttatataggggtygggtgtaggttttaygyggaaaggygygtagtgttyggggtttatgtyggtttagggygtataggttttyggggtttyggggttygygttgttygygtygtttgtgagygttyg

SEQ ID NO: 6145 - DNA, 1277 bp, synthetic construct
  misc_feature 1..1277: note = Description of Artificial Sequence: Synthetic polynucleotide
  source 1..1277: mol_type = other DNA
tygttttaygtttatttttttygtttaygtyggttattagagtttygttygttgttygagagtttygtattgaygtyggttygygygtgagttaagtttgygttayggygtttygtygttagggtggtttttyggaaagygagggaatagtgygygtagygtttygtttagtttygttttgtttygtagagtyggygttgttagggygtagggagggyggtattyggttttagttttygtaatttygygygtttttttygtygtgggatttgggttttygygtygtttttttgagtttygagygygyggygggygggagttaggttgggattggtggtgaggtagggagtgaggagygagyggagtygygtgygtyggygygtagtttygggtygttttagttttagtygggggtttgtggttygggggaggagttgtgygttygygattygtyggggatygtagttgttyggtyggagtgtaygggtygagtttgygygattatttaygygtgataggtgagtygttggtygygtttygtttggttttatygggtyggttattgtaattttttttgttttggtttygttttagttagggagggttgaggattaaggtgtgaggyggygttgttttygtattygttygattttgygttygtttygggtttttttygtygttttagtygtygttgtttggygayggagtttyggggttygttttttttygygtatyggggtttttagyggygtaygtaygggttggatatygggttttagtttttggtgtttagaagggtttaagaatttyggaggaaattgggtttagttgyggaggtaagygttygyggagaatyggagggggtttgttyggtttattygyggtttgaaattgygygtttagggygtagttttattgggagttttttaygtagttggagattttagttttagtygttyggttttaggtttgtgattttgatagtaatattggtaagygaagtagaattgttaygttygagatgaatatttaatttttagttttggggttggttttygttggattyggagttagtagagagttttttttttttygtgggaagygtatttggggaayggaatggttgagataggggaygtgygtgtggtgtttatttggagggggygtygttttggygggtygagaggtttttgttgtatttatgtttgtgtgygtygtgttttgaagygatgttggatgttygtagtattatgggtgggtygttttttaggggygyg

SEQ ID NO: 6146 - DNA, 2394 bp, synthetic construct
  misc_feature 1..2394: note = Description of Artificial Sequence: Synthetic polynucleotide
  source 1..2394: mol_type = other DNA
gyggttyggtttgggttgtttyggtgtagygygtttygtatttggtttygtyggtttattttyggagaaattttttttgttttgtygtggtttatagggttgatttttyggtattygaaaygttagtagttttgggagtttagyggagagtyggagttattttggggttagtgaygtttttygttgataagaattttaaagttgttttagttttttttttttttttttttttygygtttaattttgatattattatttttttattttttaggtatttttttaaagtygtgtygggattgtaattygtttttygatttagttggggtygggttttatttagttagttaaggggygagttagygatgygaatatyggtttggggggtaygattttygtttaygtttttygtaggygygtaggggatttaattttatatattttattttygaattaygaggaaaaatattttattttttaaaaaaataatttgttttttatataaatygttatttaaaaatatataaataaggtttaagtataaaatttaattttggggttggyggtggagggaaggtgagggagggggttttggtataygtttttygtgtgtgtttgygygayggttgatgagggygygttagggattttggygtttaaggagatggggttgtagggaggyggayggagagygttttaggygttyggtttyggttttgttttaatygtagagygygttttaaagtygagggtagttttaggtgtygttttgyggttttattagttttaggagattagggygggggatgttaagtgttggtaggyggggaagaggttaagygtygagtygggatygaaggtagggtagttyggtagagggtaggyggyggttggaggggygtygtattttttttgggtygyggyggtttttatttygttatygtygtygtygtygtayggttgttygtygygaataagtatyggtattattaygygaygtagtaggtygggygyggygtgtagttyggyggatgttgttaggttaggygatttygtygtttttggagygygagygygttttagtttgtagygatgattttggaattagattttgatttgygtgggygtgaggygaagtaggttygttagttgttygygttygggygtagataggtatygttgttgtyggaagygtygttttaattttagygtttgygttttggagaatagtattygtygttttttttttttttyggygttygagttyggagaygygggtttagyggayggtygttgygaygagtttggygggttggtttttaggttgttttygttygaggttagggatagtaaaggagataygggtgggtgagaygtyggattttaygagggtttgttgtttttttggygygggygtggaggtattggttagagggtaygtttattagttygagattttygggatgaggttattttttgagtttatatttggatatttattttttygaatgyggtgattttatttatattatagyggttattagygggtttgagatygtgtttygaaaaaatttatttyggggtttttttaatatgttygtatyggtagttgygttggtygattagtttattataagttgggttattagygtyggttttttttaggtygattgtattgtagtgtgtygaggtttgyggagttttgagtgggaayggggtgggggtaaattygttaatattggttattttagayggaggtttggagatygtggtygtgtttttaggtatggagagggggyggggggtggggtgggggyggtaggtggyggygygttttaaattttaattatttygatttttagaaatygttagatatagaaattttaaatttyggagtattagtgttaggtagggatttgtttttaggatgtgtygatygggatgaatgygttaggggttygaggatagggttttygtttttaagattgaggaaatttagattttgggttgggatttyggtttttyggtttttygtgggttgggtttttgattttgttgttttaygttttttattttttatttygtatygtaatttattaygtatttataagggtagtggtygygtttygaatttagttaggyggygtaggggtygggttggggggygygtggttttggttttygtttyggtaggtgttgygygttttgttygggtaaatttagaaggttgygtayggtgaagtttaggygtttagaggtggttatggtygaggaggggaaggaggygggggtagggtaggttgggaayggaggggyggtygggaygtygtttttayggatgggygtgggaggygttygttatgygttggtagtygggatattagygtatttatagyg

SEQ ID NO: 6147 - DNA, 1627 bp, synthetic construct
  misc_feature 1..1627: note = Description of Artificial Sequence: Synthetic polynucleotide
  source 1..1627: mol_type = other DNA
tygtggggttayggttaygttgttttgygttttgggtattaygttttttagttataaggtgygttggagtaaggtggagtttggggagtttygggaaaygttgatttttattattaayggattgtaygttygggggtatgggtttttgggagggygygttaggatgyggagggggtatygattagaygtttttttggttatygygggygtgygtttggaggaygagggtyggtatygttgygagtttattaayggtatygaggaygagagygtggygttgattttgagtttggagggtgaggttttttygttttygttttatttttgtgtagtagygggttygtttygtttgggttttttagggtttttttttagtatttttttygtatttttggggattttagtttttttttttaggtygygtygtttttttttttttttygtttttattygttggttttttttaggattttygttattttttaggtgtggtgttttygtattaatttagtyggggtyggtattagtttaattattaygaggygaagtaggygtgygaggagtaggayggaygtttggttatttatttttagttttattagggtgagyggtygaatttagtattttttaagtttygyggagttgttttaggggttygagagagggygttaggygagtttagtttggtttttgtttatgaygttttttattttygattttygtygtttttygttagtttggatygagggtttggattggtgtaaygygggttggttgttygagggtttygtgygttattttgtgtttatygtaygygtttygtgyggyggtygaggtyggttygggattygtagttayggatttygygatyggatgygygatygttaygaygttttttgttttattttygygttggygggtgaggygygggaygaaggtagggttttggggaggggtttgaaaaatgtgggggaygaggagtggattttagtttgagattagggtagggttttygggtttttttaaggtatygtttttttattagttygttygttygtttaggttttagtttatttttttaaattttttttgtatttttgtttygattttttaattttttttatttaagttygatttagtatttttgyggtttygtattttaatttygttttttgggtgttagtygttttttttygtttattttgttttyggtyggtgattygttgtggtttttaggttaagtgtttttygtgttygggyggttgaygttgtttgaagtttaygyggygtgtyggygaygyggygtygtggtggttaaggttgggtatttttaygtygtttggaagttttyggggttagattagtgygayggyggttggttggttgayggtagtgtgygttttttaattattaygtygaggtygygttgyggggggttttyggatttyggagtgygtagtttyggtttttttaggttttaataggtagtttatgggatttattgttaygtygagaattaggygtttatygtgttttttttagygygygygaagaagtttgggagtygtggygggggtttttygttattttttttyggagagttttttttttttttagattyggagyg

SEQ ID NO: 6148 - DNA, 271 bp, synthetic construct
  misc_feature 1..271: note = Description of Artificial Sequence: Synthetic polynucleotide
  source 1..271: mol_type = other DNA
tygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtaygggyggggagttggtagygaaggatgygttyggygtttttyggyggtygttyggagttygaggtyggygygggaggagygttgatttygygggtyg

SEQ ID NO: 6149 - DNA, 884 bp, synthetic construct
  misc_feature 1..884: note = Description of Artificial Sequence: Synthetic polynucleotide
  source 1..884: mol_type = other DNA
aygtyggttgtgaaatttattgaagtgagyggyggygttaggatttttgggatttygatttttttgtagttygtatagttaagggygagggygtttttyggtagaagtagtaaatygtyggtaagtttagygaggagggttgtyggggtttgggtttgggaattggttggtatttagyggaaagggaygtgagttgagyggygggggagaagagtgygtaggttagagggyggygygtagyggygtttygygaggtttttaygtygggygatatggggtgtttgttgtttttgttgttttgggygtttttttaggtttggggaagygttgaaggtgggtggaaygagggygtttgagtgtattygygggagggyggagagagggagttgggtagggayggggagggtaaygtttgatggggattggtgagattygggaygtattggygygatttaggtagaaaattygttgttttttggtttyggggagaggtagygyggtatagagttygttggtattagtygttttttgaagtttatttttttttgttttttttttttttttttttatgttggttgttttttyggttatttgttataygtttttaatttttatttttttttagtttygtaaaggttttttttttttygttgtttttagatttygtttttygttaatagtagttggaygygtatygayggtttggygtggttgggggagttgtagaygtatagttggagtaaygattyggatatygttygttttttgaagttttggttttagggtaygtttagygattagtagtgggagaygttgtagtatatatttygggtttatygaagtagttttattagggaygtgaaggaattygttaaaatgttayg

SEQ ID NO: 6150 - DNA, 1007 bp, synthetic construct
  misc_feature 1..1007: note = Description of Artificial Sequence: Synthetic polynucleotide
  source 1..1007: mol_type = other DNA
gygayggtgttygtgygtttttttattagtgtatgtgygaggagggttggaggtatgagygaaagagggaaggtaatttyggtttttaaaaaatttaggggatttttttttttagtataagygtttataygtgygttygygyggatatatatatatatatttatatttatatataaataaatttttagtatttgtttyggaaagttttttttygtaggttggttygaaggygyggtttygttagyggagagtttttggatttatygtggtattatttttaattaattttgyggygyggygyggggagygtagggtgggttttaatttygggttygtttgaygttatttgggaaygygyggyggygyggggyggygyggattygggaygatttygtygygatttggtttygttttygttygygyggggttttgtttygygggaattaaaggaaggagaaatgttagtatatttttaattggaaatygagttttttttttagagyggtttgtttatttaggattgggtattagaatttaggggaggttttaattgaagtgayggttttggagattatggggaatatatggttttatygtygggttttttatttgtatttttttataaaattgtygttygtgtgtgtttttgygtttggttttttgtatttttaaggggtttttgaagatagggtygaatgygygygggggttttaggtattttgygttttayggygggtttygtagttyggttygagtyggttttggaagtttygttttggattagattggtatygaygtygtttttagtttgagygttgagagggaaaaygagagttagaaaggaaagaaatyggattggtgattgtttggtaggggtgtaatttaaattgttgtgagtagayggtaggagggagttgttaaggtaaygggtgatttttattygtygttttttygttaaggttggggagagggaagttttygygtgttgggttagggttaagttygyg

SEQ ID NO: 6151 - DNA, 2191 bp, synthetic construct
  misc_feature 1..2191: note = Description of Artificial Sequence: Synthetic polynucleotide
  source 1..2191: mol_type = other DNA
tyggaygygatygttygtagtttgyggtttttggyggttgaggagtygyggygatttttggtttttatygtagtagttaagttyggygygtattaatyggygttgttgaaagttggagagtttttagttygtygatagaattyggyggtgggygttaggggaattttttttagtgtygtaattaggaaagttttaaaaagtaaggattttagatagataagagatttatttttttttttagtataagaaatatttygygtygygttagtygaaygttgttygtataaggttattygttttttttggtygggaygtattyggtgttttttagttttttattagaattggtttagggggygyggaaatagagaggtaattgtgttyggtttgtggttttagayggaaaygttttygggttttttggttygggggataagggttygaaattttaatagtygygagggtaaggatagaattattaattttygttyggatgttygggatttgtttttttaagttygtttyggtttttttaaaggaygygyggtatagtttatgygttttyggtattttattttatttttttatggttttttttaaatttttttyggggagttttataaagtatagayggygttttgaaattygttaggtattygttagttatttttattttygtttttygaattttttttgtygygtttttttygtttygtattttttttttygygtttttgggaagttagaagtaaattaygagaaaatgttttygtaaggagtttttttatattygttttgttattgaaataaaagygtagggaggagggaggtgggagaggaggygggaggaaggtttagaaagaygatggggatagtagtaggaaggagttggggaggggggttaaggtggtaagtagagttgggggtttagagttygttttygtgtygygyggygagtygtttatatgtttaggtygttgtaggtgttgaagaattttatttgattgtaygtttgaatttagtttattatttaggtttygtggygggggatggggggtatgattaygygggyggaggttttgaagtagggggttttgtagygtaggaygatgggygaggttttttygatgygygtggggtattggtygatggtggygtatatatygtatattaygatgttttygygtyggattygygttttgtaggtgatgttttggatatagtttattttgtagttyggtgtyggtayggygyggygtggggtagygygggggttygygygggtagtygggggygttygttaygtyggtatggygaygygtygttygttttyggttagatttagttygtatttaggagyggggagtygtygggtatttttggggaagttttttttttttgtagtygygyggggttttygttgtttygaygttygtttaygttygttttttygtttyggtagggygygyggagggtgtatttttaggaggyggygggtgttttygtyggttttagygttygggyggagggtagggaggggagyggygttgygaggaatggtgtttatttygggtyggagtttttygtttttygtyggagaggaggaggyggtagyggyggyggtatggagtygggggagggyggyggtggtagygttyggtttgtttgttttygyggyggtagtagtagtagtygtygtygtygtygtygttgtatgaatttttgtattayggttgtttttygygtgtagygtatttagyggygggygagygggyggtttaagaggtaggyggaggtagtagyggyggyggyggygatyggagttttygtyggtttygtttygtagtyggattatatygatatttttyggttyggttgtttyggttyggggggygttaggaggttgtggttyggggtggagagttttaayggttggagtagtataggaygtgtttygyggaggaaattggttgtaygttatgagttttgtttttattyggttgtygttygggtggggggggggtaatgtgtaagggtgggggtgtttaaagggtygttagygtyggggtggggtttygtaygtggggttgaggyggggyggggttttggtaggtggtgttttggggtgggggtgggggattagggygggtttaagygttatygggtgggtgaggtygagtagggygyggyg

SEQ ID NO: 6152 - DNA, 859 bp, synthetic construct
  misc_feature 1..859: note = Description of Artificial Sequence: Synthetic polynucleotide
  source 1..859: mol_type = other DNA
aygtagaggtygtggtatttggtygtagttgggttgtagtgygtgygygtttggtttggtggttygatgggaagttyggggyggggtagtygyggggygggggyggggygtygyggagataggttaygtttttgttygttygygtaggygygttgygggtygttagttgttagagttaagyggygggttggyggygggtttygaygtttgygttaggatttggttggttgagttyggygtagtagtagtagttagggtagygyggtttttattttttgttaggtygtagaggygagtagggattagttggtygtyggtttttygggtaagatggggaatygggagatggaggagttgatttygttggtgaatygtttgtaggaygygttttyggygttgggatagagttgtttgttggagttgtygtagatygtygtggtgggyggttagagygtyggtaagagttyggtgttygagaatttygtgggtaggtaagygygtagggygyggagtaaggatgyggtagtggggygatttygttgygggtygttggaaygtggaygggtagygggagttagagggtggatggattaggygttgyggtggaatggggggtagagtggaatggggggtagagtggyggtgttygtggggygggyggggttttttagttttgggtatttttygttttttgttatttttygtttggtggtttttttgtttgttttttatygtgygatataaagttattttttttttgttttttagtyggggagtygggggaggggttygtttygggttygatttttattttttyggtgygygttagtttygggtagtttttttgygtagygygtyg

SEQ ID NO: 6153 - DNA, 791 bp, synthetic construct
  misc_feature 1..791: note = Description of Artificial Sequence: Synthetic polynucleotide
  source 1..791: mol_type = other DNA
tyggggtattygtgtgygygygaggattttttttgtagagaatgaaattatygttttttttygttygtggtttatttyggggtttttattttaygtaagtgttgtggaatttyggggtgatgagtttygggggaagttagtattttttgttttttagtgtyggygttyggtagagtttygggatttttagtttttgtygtygttgaggaygyggygygggttgttggtygygtygtygagggagggttyggatagttttgtagygygttttagyggagttttgggggtygygtygtttttttaaatatgatttagaatygttygttagttttggttttagygtttggygygagygaatygggtttggttgtttyggtttygtttgaattttgygggtygygggttagggygygtygggattygttgygttaggattttgtagattyggtygyggtygggtygagtgtttttygtyggggttttaygtttayggtttaygtttgtaatattagggttgtayggygggttygtagttgggtttgygtttgggattyggggttttttgygtttttygtgtygtattttttgttttaattttaagyggaygggttttggggttttatyggttaggtyggagttttagttttataatttttttttttttatygtattgttttttttgygttgtggygggagttggggattggggtyggagaaaggagaygygtyggtttttaagttttttgagttatttyggtttygggygygttttttagggttgtagtygygyg

SEQ ID NO: 6154 - DNA, 586 bp, synthetic construct
  misc_feature 1..586: note = Description of Artificial Sequence: Synthetic polynucleotide
  source 1..586: mol_type = other DNA
gygaagaggagggagtttygaaaggagggaaaygagtyggtaaggggygataggagygagtygggaagggagagtagyggagggttgtagagttgygggygttyggatygtgttatatatttttygyggggtayggagggtattgyggggggagatatataaagatatgygaagaggggttgaaygaggttygygtataaagaygtyggggygtayggtagttggggttgtatttatygttttygygtygygtygtgtyggggtygggttagygagtagttyggggttgagygygtggyggyggyggyggyggyggyggyggygggtaggygygggattygggtygttygygtttttygggtgattygggttyggtagtaggygygygygggggyggyggygtttaagtttaatttggttttygtttygttttttgtttagttygtyggtgttttttttttttygygatttygtttttttttaygttttttttttygttttttttygygtttagtttygttttttttattttgtaaaataaagtyggggaaaatgtttgttygtgtagttyggagygygtagttyg

SEQ ID NO: 6155 - DNA, 1678 bp, synthetic construct
  misc_feature 1..1678: note = Description of Artificial Sequence: Synthetic polynucleotide
  source 1..1678: mol_type = other DNA
tygataggygaaattgtaagaatygggaggggyggttgyggygtttaggygygaggtatatattatattttttygtagttttttattttttttagaygtaygtgtttaaagagtttttgttttaatyggtttygttttattttygttyggtttttagttttgtttgtattgttggttttaagtttttttygagaggygggygtgtatagttgtagtggyggyggtagyggttattaagygttyggyggygtttygttatttatttttttttagttttyggygttgtagttttygttygtyggggagggygygtttagyggaataggagtygagggtggggygtygagaggagggaatttygggtygtatygttatagttttygtagtggtaaaggyggyggyggyggyggyggtagyggtagtagtaggtggagygagttatagygtttggtttgaaatttattgttgtagttattygggttggagttggttygttgggtggagttagtgttygtttyggttygattttyggttttygggatatttgggttgyggaggtyggttggtyggagttayggttggggaygggygygtttyggagygtayggttgygttggaagtygygtttggggygtaggattaaygggatttattttttttyggttatttaaagattttttttttygggaaagagygttgttyggttttgggatttgggaggagttyggaggtygttygggtatttygttggatattattygtttgygtttyggtggygygggagggttyggagyggagygttygtttttttttagyggtttagtggagaaaagtagagagttttttttggggygaatgggattttttttttyggtttttygtggagtygtygtatygtttgtygtgttggtttygaggggtttatagtttggtattaatttgtaggtgttygttgttgatttggtttttttttygatttgyggayggttttttttagygattttygatataygtttttttgttttygtyggagggtygggtttggggtygtyggagtttgygggaatttagygtttattygttgattttygagtygtttygttagttgtgygtttttttgggtattagtttggagaggagygtgtagaygyggttttttggagggagtgyggttttttagggaggtatygggtttttaggggttttttggygtgtgtggtgggattggggttygtyggttatggtttttattttygttgygttttgttatatgttgtttttggtgttgtgygttgygtttatttttttygttatttggtaygtgagtaataygttttggttttttttttttygttttaatttygttaaattttttygattttattttattttttttattttgygggygtgggygaatyggaaggttggattttttgtygttttattgtttyggggtaggaggtagttygttgtatttygtygggygygttttyggtgttttggttggaggygaggggtygttggtgtttaggtaggatattttttgtagggttygattgggygtttygggtttygggygtyggggagtggyggttataattataattaatttttttttttttygtttygtttttttttgtyggygggaggygaaggagaagygtygtygtyggtttyg

SEQ ID NO: 6156 - DNA, 1600 bp, synthetic construct
  misc_feature 1..1600: note = Description of Artificial Sequence: Synthetic polynucleotide
  source 1..1600: mol_type = other DNA
tygaygatattgttattggaaaagtgttggttayggttttygttttattttttttatttaygggttyggagtttttaggagtagttagatygattatygtttttgtagttttatttgttttyggagagatatttataagttagtttayggagagtttggattygttygttttagtatttaygtttttttygygttyggttttagygtygttttygatatttattygygggtagttttttatygtyggtattttygaagygygggggygggyggtttygtagygttgygttttagttygygtyggtttygttttttttyggtttttgtgygttyggggygyggggyggtggyggggyggtttttgggggtttygggggttygygttygtygttygaggaggyggtygaggaggagygygaggyggtygaggtgttgtagaaggggttttygtygttgttygggtyggattygtygaataygtygttygagatgtgtaggttttygtagygygygygggtagtttygagtagygtyggygttttttttygygygttttygtygttttyggttatggtttyggtygtygttygygygttygtttttatagtgttttttagtygtataygtygggttttgggttygygtygyggttygtygttttttattagygtagttygtagtatagygttygtygtttygtgttyggtyggttygtygttttggtygtttygggtttagygttyggggaagygttttyggagttygggygtygtaggttgygggtygyggygggaggygagtygygygyggggttggtaggggygatttagagygggygggaygtagaggttgyggtygagattaggygtygtygtygttatygtygttattatygttattatygtygtygttgtgttttttyggygttygtygtttttttgttygttttttttayggttttyggygttyggttgtygattttttygggygygagtygttagaggygggttttgtygttttttatttttygttygtyggttaatggggagttyggttyggatagtygygggggagttgggygggttyggygyggggaaygtttttattttttttygyggggyggggyggggygygyggtyggggttggyggttagggggagggtygtyggyggtagtgtyggtttttttttatagggaygygtagttygggatygttaygygtagygygggagggggagggygggatyggggaataggaggggagggggattygggtgtttttagyggttygggttygyggayggagtgygggtygatttygtttattgttttttttygtagttygygtgtagttttagggagttgttygtttyggtggttttgaattaggygtygtygaaaygttttaggtaggyggygggttygaggttattatattygyggyggyggttgttgtygaggttttttgggggttattgttagttgygtygtatgtttttataaatataggggttgtttagtttttgggaatttygttttaattaggagttygtttygtyggtttattgttggtygttggttagatgttaatttygtttyg

SEQ ID NO: 6157 - DNA, 2394 bp, synthetic construct; identical to SEQ ID NO: 6146
  misc_feature 1..2394: note = Description of Artificial Sequence: Synthetic polynucleotide
  source 1..2394: mol_type = other DNA

SEQ ID NO: 6158 - DNA, 1160 bp, synthetic construct
  misc_feature 1..1160: note = Description of Artificial Sequence: Synthetic polynucleotide
  source 1..1160: mol_type = other DNA
gygygttyggtgttttaaggtttttaggyggagygygggygygaggtgygggtttyggggyggagygtaygttygggaggygggaagtgggtagtagygttttygtttggtttttgtgygtttygattygaygttttttygttygattaggtgtttygagagygtatagttgggagggttttttyggtygyggygagatttaygtttgyggtgtgttagggyggyggygayggtgaygggygtggggygyggygttgtttyggttgtygggtygttgyggygagygygygggtyggtttggagttatygggttgaatygtygygtttgtatygtgtygtaygtygyggaggygttygggtatagatygygygggygygtataaagyggttyggggyggtyggygyggygtagattttyggtgggtagygtattttagtttttttaggttagyggttgtagggagtttyggttygyggttttttygttttaagtttgggagttgtyggttttattttgtttttgtttatggggattygagagttttttagyggygtatttaggggtaagagtattgtygtgtgagtagygtttygggygtgggtgagygagtyggygggygggaggtyggagygtyggggtagttttttgtagttgggatattgggtagtttgaggttyggggaagggyggygygygyggtggagttgttygggaagttttagttattttttttttygttattygttttaattygtattgtttygagaygtttaggatagggtattggggatagttgttyggggaagtgggtgagtggyggygggaagggaggagygygggttttgtygyggygttygttttyggagggtttyggtygygtttttgttttygttttgggatttgttttttaygaatttttttttttttgtttatgttttttttgtttatttatttgttygtggygtttgygatygtagtggtatgaggaggttatyggaygttagttttyggagattgttygatattagtttttagtttyggtagtttaagtatttggtggtggaygaggygattaaggaggatttgaaatggtygygtttygtggaggattttattagygggtyggtggggtttaygtttatygaggagyggattttgyg

SEQ ID NO: 6159 - DNA, 588 bp, synthetic construct
  misc_feature 1..588: note = Description of Artificial Sequence: Synthetic polynucleotide
  source 1..588: mol_type = other DNA
gyggggttgggygtttyggggaggagggyggagtaggtgagttgyggggtgggagtagggagtgtatttgtaygtgaygttggagtttgtagtaatttttaagtaggaggttgtgygygygtgtgtgtggagtggttgygyggtyggggaggatgtgygttgtagggyggtygtygtagtgagtaaygyggtaatyggagttyggygggtagtyggggaggtygggattgagaggggygagtygttggtgtttttyggyggtagagggtygygtyggttaygggttygggagagaygygttttagtyggttttaggatgtaggygatyggyggtagygtttttgtaggyggtyggtttattatgaagaagtattyggttygggtggtttygtttagygtttgtaatagttyggttttgatttttattaaagtggaaggtaatgygyggtygtttygtttygggggtttttgtattttagtyggggaatgttgttattttgaggggggttgtttggttgyggggygtyggggttgggggtattgtttttttaggaygyggtttygtagtgtagagygtygtygtttgyg

SEQ ID NO: 6160 - DNA, 878 bp, synthetic construct
  misc_feature 1..878: note = Description of Artificial Sequence: Synthetic polynucleotide
  source 1..878: mol_type = other DNA
gygattygygattgtagtygttttttaaggttagtttttygttygtagtttgtttygggyggtagtygtgttagtttttygttaggattygtttagggggaygtgggtatygggtaggaygygygttttgggygttggggaygttygggatattyggggtttygttttgygttttagtttygggtygyggtatttyggttttygtttygygtttttggagggaggtatygagggaygygtagygaaggggttttgttaattgttaaagtaggaagtgagttygtggaagaagygaaggaggagaagaagaagggaggggaaggyggaggagggtaggggygygtagagttayggtttgttttaggygygtyggaatygtaggattttttattttygtggttttayggttttttygygtttyggaggtttgttagtttygttyggaygttygtttgtttttaattygtygttatggttttatyggaygattttttgygygtaggtaaagggatatagygtygygttygtttttggagygagtatygyggggygggagttygggaggygttygtagtagtygtagggttatygaggtygggtttyggygattttygagggaggttygggaattattttygatttaggygttagattyggagtygtayggggtttttagtttagtttygygagyggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttygtttttyg

SEQ ID NO: 6161 - DNA, 561 bp, synthetic construct
  misc_feature 1..561: note = Description of Artificial Sequence: Synthetic polynucleotide
  source 1..561: mol_type = other DNA
gygygggtttaygttggtygttagyggygttaattttatttattygttaatttgttagtttttggattgagtaaaatagtttttaaagaygygggtaaaygtygttttaaagtttattattatgtaaygttaggttgttyggagttaygttggtggtatttttttttygtgtttattttgtataggtatttttagaatttygtgtaaatgaattttatygggagaygtaggtgggtaggtygggtyggtagggattaagagtttgaaagggaatttgttttttttttttygtagttyggttattaaggtaagaaattgtaggtagagaagttttygaattygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgaygttgttgtagaagttygygtttattyg

SEQ ID NO: 6162 - DNA, 1235 bp, synthetic construct
  misc_feature 1..1235: note = Description of Artificial Sequence: Synthetic polynucleotide
  source 1..1235: mol_type = other DNA
gygatygtagggtttygtttattttttttttygggatagtttggatgggagtagttggygygagggttygttttttygtttttgggtaatttttttggtattgggagaygagatggttttyggagggtggaaggtagtgttagttyggtyggttattggggattgyggggttyggagaygygyggggttttyggggagtttttygtygttttygttttatttygttygggttttttaaatatgtygtagygtggttgtttattgttttttttgggtaagaggaggttttagatatttttaygggatttgaattttygagygttttgtayggagtagttatttygttagtattttaaagtgaagttgtttataayggataagttyggagattttatgagaggtyggggtggagaagtygggggtgaaggggggtaggggtyggygygttaygyggtttttattttttygtttggattttygtttttttttttttttggatttgtatttgagttgattgtttagttttttagattttttgtygttttttaggatygaggttatggtygagatttaggygyggagtttagagtygttttttttttgtatttgtatttgtttttttttyggtagtygtygtygtygttgttgygaagtttgaggttgtaaattygggagyggtttattttttaggattgagtaggaaagygygtttygtttttttgtttttygaattgttttttatgatttgtttttattgggttgggggtttyggttgggygtttggagygagttgttttttggttagggagggyggggaagggygygyggygttttgagtgtttygagtttttygygggttttgttttttgttttgggtttttagygtagggaggttatttttgygtttttgttagttgtttggtattagttattttgaagttaattaygtagggagtttgtttatttgttgtagtagygtttaattagatttaattataattgttttttggttttgatattagtagtagtattagtygtatygtygtttggtygtttgtaaatttagttttygtttggayggtgaagtttttaggatyggyggttggagggaggttgttttyggggaataaggaygyggygygggtgygtttgggagagatygggggagtttttaggagggattttgttygggaggaygaggttttttgtygtagtttygyggatagtttagttyg

SEQ ID NO: 6163 - DNA, 5964 bp, synthetic construct
  misc_feature 1..5964: note = Description of Artificial Sequence: Synthetic polynucleotide
  source 1..5964: mol_type = other DNA
gyggtaatygagttagatttaagaggggtyggtttygtttaaattggttttttattaatggtttyggattagtygyggttgtgttgygggagtttttaggaygyggttggggttggtgygyggggtttyggaattttaaattyggttyggttyggtaaggtttagggagataaggtagagaaggttggggtgagygagaagtygggyggtygatygttagggttaygagtttygttttgtttttttggaattttatttaattttaaaggtttaaagattttgaaaatttygaaagygaaattgygagttggtttttagaagtttgagaayggttttttaggttttttagygtygtttygggattttyggatattataaaygttattaattaygagtatyggtgttygtggttattgtttygaatggtttttattygygttttygggaattttttyggtttttygygtatttaggtttttagttttagttattggtgygtttygagtttttaggtgttagagyggtggtyggtygggtttttgtttagtttyggttttttttttttttttattagaaggaaaaatttgggtttttygagaattttgtggaatgttttttgtaattaattgtatattygtttttayggtayggtttygtgtaaaatygygggtttyggggttttggagtaaattgygtttgttagyggygaygttaggaggataaggggaggggttygyggttgaaattgtagtttygtagtatagagttattttaggttgttttttatttygyggggtttatgggaaagtyggtttygggagggygygtttaaaygtaggttggaggagttayggaygygttttggtyggygtgtygttatygtttagtttygttgtttaggtgggaggggttatttgtygyggggtttttaagttagtgtygtttgttttyggtttttatttattgatagtayggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygygtttgttggttttttttttggtttttttgtttgatttygattttgttttygaattttatttttagatttttttygttttggaaygtygatttttttttygtatttygtygtttatttatatttttyggygattgttyggtttttatgttygttaagataagaagatgttttttttygatgygtygagagggtttttaagtygagtaagggataattttttttttaaaygttgtttttattttttattttttttagagygygaaatttaaaagtaaggaaggtaatttttygtttygattttaygtgtttgttttttagagtygygygttttygtttttttgttttattttattattattattattattttggttttttttaagtttyggtttyggttttttattttttattttagagyggygtggaggaaagtaggagtttattattaagtgtagygygttttttgtatataygaaattyggttggygtttgtagttygattgtatttaatattygggatagttagtttttttaataagtattttttygttttatttattyggggatttattygygtaggatttagtatatataaggygagagttagttygttttttagaaagataaaataaattattttttttgtttttatgtattttatattaygtgttygtagtttgttaygttaaattatggtagggtttggttttaagaygtatatatatattyggggtggttttttttgatatatatatttaaaaaaattgygtataygtaggtttgtatattaatttataggtatataygatagttgygtttyggtgttttggttygggttaggggtatttttttattttttttttttttagtaatggatttgatatatagattttaattayggaaaaaaaaaatyggatagtttattttttttttttttttttatttaattygttaaagygttttttggggtagttaaagagagtygaaattaaggggtggaaattttagttgggtttttttttattttaaaatttttatttttagtttttaaaagttattttagttygttatattgaaattggtayggtttttaaagatttttttttygtagttgtggygtttttaagaaaataygagtayggattaggttttggatgagtgttyggttatygagaattagttattttttattttttaggattttttagttttttttagtttttttttatygtttttggttaaaattaataaatatatttygtagtttttatagttgtattttggyggatttttgtaaaatatatatatatatatatatatttaygtaygtatattaaaaaataaattttagaattagtttaagttagtaattttgaaagggggtygaataagaggagataatyggaaagtttttaagtgataggatattattttaaagagaaaataatgaataaaaagattattttygttggagtaygttttaaaattattattgttaattttattttagttgtttaggtaaatgtttttaagggagygatttygaatgtttgtaygatttttatttttatgtyggttttygatttttygtttttattattttttttttttatttaaattaaaagaaaggggagattttagygyggaggagaygygggagygyggggtaggtagtagyggyggttgygtygttaaaatgagtgtagaaaygaggaaggtgggyggygggaggggataggttgygttyggggaaggaggatattttgtaatttyggayggattttygtayggttyggttttttygagttyggagaygtaggygaaggggattygggaagtaaaaatgataatttggagygtatagaggagtttgaagtttygtttaagtgtagtygttttttttttttgtttttttttttygtttttttgtattttttttagtttttttttattygttatttttaattttagtttttttaggtttttttttttttttttttttttttttttttttttaggttggaaaaagtttttgattagygtatttaatttgygggtygaagggttgtttttyggttagtttgggygtyggggatagtagtyggygyggygttttatttggtgaagttygttttgttttyggygtggatttaggtttyggtygtygttygggagggtatyggtttygttygtttgttygttygttygtttttgttygttygtttttygttygtygtttttttygygygttygtttyggtttttyggtttttattatagtttattttaatatggtattttttttgtgygtatgttyggygtttttttttttttttttttttttttttttttaagattttgtgtgtgtgtgtatgtgtgtgygtgygygtgtagygaatttttttaaygattttttttagygtttgtaaaattttttaagttaattagtttgygggaygtgatyggttttttttttagttagtttygygttattttttgygtttaagtaggygggtatttttaggattttgggattttttaygtttaygyggttttttttttatygygttttttttttttttttttgtgagttttttttatatatgatttgtagaaagtttttatygygggygttttygtatattttttygtaaggataattgggtaaattttygtttttttggttgyggttygtgagttgggtttttaatggtttagtygatygtgtgtataaatttgygttttattygtyggggatygttgggagyggagataaatttaatttttagggtaattttggtttygttygttttattttattttgtgtttaaatagagttttttttgaagttgygaatatttttaggttttttgggtagggttggaggggtygaggagagttattygagggaaaggtgtttygaggggtaggaaattaagttggggttgttygggygagttgttaggtagtygtgttygttayggygttttatggggtatttagttagtggygggttttatagggygggaaaagaatygtygtttatattttagtaaaaygtggttttygayggttygttggagagtttyggyggtygtgagtttygggtagggttggaygtttgyggagttttygggtattttgtttygggygtttggggaggaaygyggagtttttagggttttaggtgtaayggttgygtagagtttaaaygaaatgtttttagtgyggaaaagtyggtgaygttttggtagtaagattaagagttttygaagaaygttgygtttttaattagggggtttygtagagatgtttgtgtgggtttgtattgtatatttttgygaaatagygaatggataygtttgtttagggtttttatggttgttaaagggggtaaaattatttagttttttaaatttgtgttttatgaattttttttatagtatttttttttagggggttaagaggttttttaggttttygtgggttygtagttttattygttttttttygttttgtatttttaaggagaggtgttygttttgaagggttaggggttagttatggagtgaggggatyggggttgattaygygyggtatagatagaggtttttaggygggtttttttttggayggtggggtyggagttgatttagaagaaatayggagggaygtgtygagaagtygttttttttygtygygattttggagagygtttttttatttaaaggatttgtygagttgagagatttagggygggygttygtagtygtgaggttttttgygtygttagtatgggaagattttgtttttttatattttggagaaygttgggygaygattaaagygtttttygtyggtttgttattttatgtgatataggagttaygtgagatttagaagagtttagygattygtygygyggygtattttaaattttagtttgagtttgygatttttttagttttttagtttttagttgttggggatattaagtyggagttttgggttttttgttttgtgggtygttgaaagtagagattttttaaattaatygaatygggygtattaattttttygtttgtatttygttgtttttyggttgagtttygaggyggttttaggtagaatttgttggattgattgyggygtttagaaatttggagtgtgggttttagatattttttayggtttggtttygggttttaatatttaagtygttttttttggtttttttattatatagyggggtttgtggaaagggaggggtygagagattygtyggygtattattgttttygaggggtttttattttgtgtattgttgaagygtagggygygtygyggtaggaatggtttygagtgyggattttttgttttgagttttttatttttggttygygttgygtttatttagtggttttggtttygtagggygatagyggttgtttttttttatttgygttttagatygygyggtttygtttagttttygggagtygataggygtttgttttggtgttagygtagggtttttygggggtttggggtaggggtaggggtgygggggggaaggggagaaygtaatttttttttgtaggagtygtggagaygtgagttgtaattagttatygyg

SEQ ID NO: 6164 - DNA, 5964 bp, synthetic construct; identical to SEQ ID NO: 6163
  misc_feature 1..5964: note = Description of Artificial Sequence: Synthetic polynucleotide
  source 1..5964: mol_type = other DNA

SEQ ID NO: 6165 - DNA, 5964 bp, synthetic construct; identical to SEQ ID NO: 6163
  misc_feature 1..5964: note = Description of Artificial Sequence: Synthetic polynucleotide
  source 1..5964: mol_type = other DNA

SEQ ID NO: 6166 - DNA, 703 bp, synthetic construct
  misc_feature 1..703: note = Description of Artificial Sequence: Synthetic polynucleotide
  source 1..703: mol_type = other DNA
aygygaaataaaygattttaggtttttagtaaagaagtagyggygygtttttttttttyggtttagygtgaaaatayggaaggygaagggttgtygttagtygtttttttgttatygygatygggaaataaagatatattattttttattttttgygtttttaagggattygaggaatttttggttgtaagyggttggtatttyggaaygggygttttattygttygggygaaggtttttggtttattaggyggttttggygttygtagttggygagttttygtttygttttygtygtygttttygtygtgggttttyggygttagtttatagttygttygygtttttygygtygagtttggttyggygttagtgagtttygtygtyggttygtttttygttygygttyggttygtygtatggtgygtttagygygtttygagttagttttyggygygttgttaggtygggtgttaggyggttatygygygttatygtygtygttatygttygtygttygattttggataataatgygygttttygtttttttagaaagttagggaygtttttagtygtygttagagttggttyggttttttagttttttttygtggtattygtaggygagataaagttygttttyggtgaggttgygygygtttaaagygtgygggatgtttagtayggaggtttttaagyg

SEQ ID NO: 6167 - DNA, 1315 bp, synthetic construct
  misc_feature 1..1315: note = Description of Artificial Sequence: Synthetic polynucleotide
  source 1..1315: mol_type = other DNA
tygygttttttttaaatataygtatatttttatatttattygygtygttttagtttgtttatttttaaygagtttaagtyggtgtagtygygttttatgttyggttygtagttttygagttttagttygttygygttgggygtygttgtatttgttagtggygygyggtatygyggtygtygggtttyggagygtttttagygttgygggggtgtygtgggtggtttttttgtttttttttattagaattttgtatagtyggggagaaaatttaagttgttatatttygtygggagttgttggttgaaaggttgggagtygygttttttgtttggtagggagatttygtatttttyggtttttaggttaggtttttagttttagagttggaagagttttagggygggaaggaagagatagtaaggattagaatggggagtatgagattttgatgyggaattygayggtaggtttygttttatagttgtttygtttatagygatgygygttagagttttygtagttttgatyggtttttttgttttttagtygtygtttatyggtyggagggtygtttttttgygatttttttttttattttatttttaggtygtygtygttygtgggttgtttttygtygyggttaaaagttttygygttygaggggaagygatgggyggtttgggggttygggggygttaggyggggygygyggygyggggygyggtyggygggtgggtgggttatttggygyggtygggygygtttgtygggtattagagtaggtgtagtagtagtagtagtagtaggttggygagtagggygagtagtgygtttttyggtygtattttgagttataggygtygtygttatygttgttgtyggggygaagtatagttygggyggtttygattygyggttttygtygtygtygttatygtygtygtggtygtagtttygygtatttatagygtttataggyggtagygaggggygttygtagtttattyggtagagttttygyggygggyggagaagaagtygygttygggttygtttygggttttyggtttyggttygyggagygtygygatyggttggtagatgaygattygtygagttygtygtttgttttttyggaggygttyggagttgttgygggtttyggtygtygttgttattgttgttgtygtygtygtygtgyggggttatttgaaggttggggygyggaagtttaatttygtgttgattgggttttaagttttttgygttttygtttygtttygagtgttygygaatttttyggaygtttayg

SEQ ID NO: 6168 - DNA, 1316 bp, synthetic construct
  misc_feature 1..1316: note = Description of Artificial Sequence: Synthetic polynucleotide
  source 1..1316: mol_type = other DNA
gyggtygtyggtttttagttttgggattattttggtttygatayggagtgataggggatttttaygygttttygtatttagggygtttttttagttgyggyggaggtatagagaggttttggyggygttgtggtttyggtyggtatygggtttygygtagtygggttttttattttgagtggagttgttttttaagtatttagtttttgttaattattgtgtttaatattaagttttyggggygttttgttttgygttatygygygttygttygttygttygtttaatttatttgttgaagattaggtagtttaggtggttgattttgtggtyggagyggtggyggttgtagtttttttataggtttttgaaggtygtgatggttaggatgaagagtatyggygttagtgttaggtygggttggaaggygtttatygtyggtaygaagttgagtagygygatgaagataaagtataygttggtygggyggtggaattgttygaataggtttttgggtaggaaggatagtagygtgtatttggtagttttgagtyggttgtyggttaggtgttgggtatattygygtygtygtygtygttygtttttggtygygttagtygtagggttttyggygttygggggyggtagtaggttggagygtatygtgygygttttgttttttyggygttttygtygtttyggaggttygggtttttyggttttygtyggttttygttttatggtygygtgtygtygygttyggttttttygtygtttaygttygttygygtyggttttttaggttattattattygyggttygggygyggyggtgygagtttttygtttgygggaygtayggagatygyggttagygygtygtttggtyggtttagygygtttagttygygtttagtttygtttattttygtttagtttygtygttyggtygtagtttttagggygtaagttgggygggtgtygtatagagtttttttgttttygtygttygttttyggttygggtygttttygtygyggtggttayggtttygttttygtttygygttyggattgggttaygtyggatagygggaaataaaaaaagttygagttggaaattttagagaggtttagtttygttttttagaagtattagttyggttttaaaaygttgtaaaygygygttgtttgtagtaggagagaggaaatygygaagygygagaaaaggygttttygtttttaagtagttygygygtttttttaggggttagatttgttttattttggayggygaaaygatttygggagatttyg

SEQ ID NO: 6169 - DNA, 1110 bp, synthetic construct
  misc_feature 1..1110: note = Description of Artificial Sequence: Synthetic polynucleotide
  source 1..1110: mol_type = other DNA
gygtygggtttggtttttgtggtttygtaaattttttagtttgtgtgttayggygaygygtagyggttgagtyggagtttaygyggygygygtttttygygaggaatttttyggtttgtaggttgtttgttattttygtttttygaygygtttttttttggttygygttttyggagttttttttttttttggygaggatttttttyggygttygyggtttygattttygtygygttgygttygttttttyggtttyggttgtttygttgagggttttttttttttaggtatygtagtygygttttygygtttygtttttygagyggttygtttygttygatgtttyggtttygtttygygtattgagygtttggtagtagggygtygagtttyggggygttgyggggygttgygtygagaayggtygggtttgagttttgggyggtttttagagtygattagagygyggggaggygggggygaggaggaggggattygtygtygggggttggttgtttygtttygagtygatttttygttaatggtttaaagggatatgtttaagtygttttttatagyggyggyggyggtggygtaggagatttagatggaattgttagagaaygtggttttygygggggygttyggagtygtygtataggtagygagagygyggygtttttttttttttttgtgagtygtygggtagggtatygatttygggttttttyggygtttttattgtagggatttttagtttygtatttttttttttygtygtttgtttattttttgttttttttttggygtyggggattttgtttttttgygtttttttttggttttgtttyggtttttatttttttttgttttygaaaagttagtggggaagggygggggagatttgttagtttttttagatttttttygggttgttttagttggtttttttygttttttttygggagaggtatatggagagatatgaattaggggagtggattggatttgttgaagatygtgagttygggtgggygggagggggttygtttttygtagygttttttaygatgtygatttttttggttaygtttygagtyggggtgggyg

SEQ ID NO: 6170 - DNA, 1655 bp, synthetic construct
  misc_feature 1..1655: note = Description of Artificial Sequence: Synthetic polynucleotide
  source 1..1655: mol_type = other DNA
tygttttygttttygttgatattttgtaaagtygyggyggtagyggyggggattaygttgyggtgtattatttttygttattttttygygttgggttggggtygagggggtttygtagagtyggtaatygaatyggttttggtttgttttttttattttttagttattattagaattagttttygygaaggggygagttgtggttaattttttygtgtttagggagatttygttagggtyggggyggggygygatygtttttygtagtygggygygaaggyggttygggagttaggtgggtgtggggygtagttggyggagttgtttagggygtgygagtaggttgygaggatggygtttyggyggygyggaggtatygtttygygttttttygatagtttttyggtttgtttttttttttygygttttggggtagtyggttgtttggggygtayggggttggagtggttttttttttttttttygttaggttttttyggtttaatttgttggtygygattttttagttagtttygaggaaagtgtagttattggataggtttgtgygggttgtyggttttagggaggaaggtgggagaagtttggaggagygaaggggagggyggagggaggagggaggagggtgyggyggtagatttggtaaattgygagttgttttttttttttaaagtgtggagaaggagygygggggagygtggygayggtagygtttttttygttattaaatttttggggtttygygggggtttggggttatttttttttgagttyggaggaattttttttygataggttttagygtgatttttttttattttattttttttttttttttttttttttttttttttttttttttaaatatattttttttttggtttyggattttagattgttgtagttttaatttttttagggtttagttttttggagttgtttattttttyggttgygagaaaggaygygygttttgygtygggygaagaaaagaagtaaaatttgtygggagggtttygttattaatttttttttygtaaatttaaattttttgtyggggttatttttagatagaggaaagtttttgtagagtygattagttttagtggatttggggtaggtagyggygttggttgtggaattagatttgttttgaatttagtggagygtatygttggggttyggaagttatygttygygggtatygggttggygttgttygagtggaatygatagtttgygagtttyggttgtaagtggtttttttttttygyggttgttgtttagtgtygggtgagggttgygagtgtggtaagttgtaaagagagttttagaggttygaagagygttgygtttttattygygttygttttttttttttttyggttttttattgtgaaatygtagygatatttataaaggttttygggttttatygagatygattygtagygtttggttyggtygtgtttattgtatygggagttttygagtatyggygaaggattggygggtggggtagggaggtggyggyggyggtatggygaggttttygaaggtygatttggtygttgtaggagttatgttattttgttatttttttayggattagttttagttygtygatgggaaattyg

SEQ ID NO: 6171 - DNA, 1655 bp, synthetic construct; identical to SEQ ID NO: 6170
  misc_feature 1..1655: note = Description of Artificial Sequence: Synthetic polynucleotide
  source 1..1655: mol_type = other DNA

SEQ ID NO: 6172 - DNA, 304 bp, synthetic construct
  misc_feature 1..304: note = Description of Artificial Sequence: Synthetic polynucleotide
  source 1..304: mol_type = other DNA
gygggygttggaaggggggyggggtaaatgyggtyggygtagaggtggggagtaggtgggaaaggtggaggygggttygtttttggagatttatttttgtttttattgtttttygtttgttagttttatagataggtttgaaygygtagagagttttttggagtgttttgattttgttttygagagggtttttaattttygtatttttttagtggttgttttggtaggtgygygttttgyggggagttgygtttygggggttatygtygagygggagttgttttttggaattttgtttatygyg

SEQ ID NO: 6173 - DNA, 1666 bp, synthetic construct
  misc_feature 1..1666: note = Description of Artificial Sequence: Synthetic polynucleotide
  source 1..1666: mol_type = other DNA
gygtattttttttygatygttagtagtataagtggygatatttttatggagyggtygygtygtagtttgtygtatttagygyggayggtttggtygygygttttttygttyggaygatygggygygtttgatattaatagttygyggtttaggtaygagygggygtygtatttgatttaatttaatttataatyggtygygtttgtaggtgtygttttttgaaatygttatttaggyggtygttgtttatttttygttgygtygygggttttgtagaagygtaagaatggggttgattatttyggtgtttatatgtygtttttataygtttttattttygttyggygtaagattttttttggttaaaagaggygtttaattagttttggggtygyggagagttagygtggtygataaagttyggttttttaggtaattygggttttttgyggattygggagggggygygyggggtyggagtatyggttttgggttgygygtttttttyggygatattgtygtttttttggttttyggttyggtttttygtaggttaaaggtttatttgtygggtttgggtggttygggttagygtygtttgyggttttygagtgyggttggttttaaggtyggygtttttttttyggtttttagtgtttagagttaggttagygggaaagaaggtagtatggttygtaaaagataggtggtagtggtagttttgtatgatatttgttttttttttttgttttttattttggggaaatattggaaatatttttttttttatgygtattygygttttagtatygagtgttttaagttttgygygtagygtygggtttggaaggyggygaatggttgtttagtygtygtttttattagtgatattyggtygttagttttygtttaggatgtgtatatttgttggtagtattggttygggtggtagttatygggttatttattttataggtataatygtatttaatttaatttggaattyggagggttgtgygygtygagttgggatygygttttagygagtygggtttttggttgygttagggtttaggtygagttatttygtygttygygtygtygygaggygggatatygtgtgatatttttgtygtgggttgggygtyggtygyggggyggagagygggtgttttatttygttttattatttgattttygttagygtttgaggayggygtatttaattygttttattygttgygttttgtgaattagyggygggtagggygggggaggtygggttgggggagggtagggtggttttaatttttygttttygtttygtyggtttygyggagtataagtgttgggatttttaygggtaggygtgttttgyggttggaggttygagygtttagggtttaggagaygtggyggatatagaggggtttgtaggtayggtgattttygtgtttttgttttgaaagggtttgaaaggagyggtttatggtgtattattagttaagggtttaggtattagygttttgtgtygggaattygggyggtygttygtgttgtaggtgtttgttatataaaygtttygggagggggagggtaggtygtyggattgggggtyggggaggggttttyggtttggtttgtttttgttattygygyggtttyg

SEQ ID NO: 6174 - DNA, 5030 bp, synthetic construct
  misc_feature 1..5030: note = Description of Artificial Sequence: Synthetic polynucleotide
  source 1..5030: mol_type = other DNA
gygttaygtggagagttataygaattttaagygttttygttttttagtttttygygggaaaayggattagggtgttaatgggttttgattatttgtattagygttatttgygagtygagggttaagagtattttttyggttttggtggggtaygggttgttayggtgtttgtaaagttattgtttgaggggtygygttatgttttgtagggtttgtygtttgtgttttattttttygttattttgtygggygttgggatatggggagaggaggyggttttggtgagygaygygtttgttygttyggaygttttaygtttyggttaagttygggtttygtatttaaattgygtatttttgttttgygtttttgttttgygygygtttagagtgtttgggagaggtaggaagtgggagttatatagtttttggatggggagattatttygataggtttattttgaatagggggatattttgaatttaatattttaaggttagaggtttagaagaygaaggttaagtgatttgaagaatattgttattttagtygygtatttgggtagyggggttaattgttattttttttttattygttggygtygtattttygagtggttttggtttggtaggtttggtagggtatgyggttggttttygaaatttttttyggggattttttgtttgtttttagaggtttttygtygtttgtggttaggggaaaggtygtygattggatatagggaataaagtaaaggagtattgtygtttyggttttttttaagttattttttttgattttttaggaaaagggggaaattttttaaaggagttggtggtttgtggaggaaagttgtagaatttaaaaatatygtygggtygtttttygattaagggagggttaaaagtayggtaagttttgttttattatgtaaggtaaaaagattttaggaaaagtatatttaaagggggaggaggtagaggtagttaggagtttggagygtggtttggggygttgygtttttttaygggttygggaggtgtygygygyggtygttagygagtttagtygtttttygaggtttgygygtttgygtyggagttttttgggtttttgtttttttaaatattttgaaatgtaattttattygaaaygattggtagtaatattttgaygaaatygaatttttgttttattaagtagygaygtygtagaataagtagttgatgtaatygtttaggtggaggyggttaggayggtygttttttttyggyggggygttyggggagtygtyggatygggttaggtagagtttgttttttatttatyggtagtttgagtagttggtttattygtaagttatygttttttttagtatattttttatttygttaaatttaaattyggtttygtaggttyggggttttttttttygggttygtygygggtttagtygagtygygtttaygttygggattttttggygggaggygattttttygattttttgggttaggygagtygyggggttttggygaggggttygagtgatygaagagaagttygyggagtttgagtttggatttttygattgttyggtttygtttgtttttttgtatygagtttagtttttttttttygtttttagtygygtatyggtatttatagttyggagaggggtaaataatttttaatttygaggtttaggtagyggagggtygaggggtagtttttggygtttttagtttttattaagttttttggagttgtttygaygaattgattttttatgttttaagataggagttttttaatatgagaatgygygagttttggaggggtagatttgtatttttagggaatttygggttttttttygtttattygttygygttgttaygggatttygttatagtttattatttttattttttygggtygtaggygggtagggtttttaggggagtgygtatattyggtttttyggtgttttaggtygaggttgtttttgaggggygggtygtygggaatgtttatttyggggygggygtgaggattgtttaggatatygttgtagggtyggttatttygttttygtttygaggygttttygtttttaaatagtatygtatygttgagtttgttgaagaygatggtgtttatggtgtyggttggtagggaygygyggygyggtygtagagtttyggggttgggtygtygggagtttygtagyggggttyggtttttaggagaggaaggtgtatttygttatttattggttgagagtgtttagatttttgtaggtttagggttttgaatttggtygggtygtygggttgyggagtygaggggaggagyggygtygtygtaattggtagggattttgyggttttttttagttggttataygttttygtttttgtaggtttttyggataggtatttgtttttttttttgtttgggygatygatttttttaatttttttattttttagaattataatygggaattatttattygtagaggtaaaggaaaygaatttttaaaygagtttttgggttttagtttgaatttgggagaggtatatttyggattgyggagygygatyggygtgaggtygygygtggttttttaattatagtagaagattaaagtttttaggaattttaattyggggygttaggaggggttggatggaagggaagatttggggtaatgtgttaatygtatttataagattttttagtttatgagttttaggttatatygggatttgggggattttygtgttttttagatygtggatggtttggttgaaattttygtattttttgttygttaaggtttttyggggtgaggttgggtttaaggataggaaaaagttaagtggygttaggaygaaagtattatttttttttttttttttttagaatttttttattattttttaaygygtttygggaagtgtatggttttaaggtttaaggygttaggatttaggtttttagagtttttaattagtgttattttttttygtagygygggtgttagtygygagttygtagtttttygatattygtttttttttggggttttyggggatttttttagaggttgtaaaggtgttagaagtttaaggtaggaggtagtttggtyggygtatttttygggttattgttgttattgtyggggagagttagtagtttatttttggggtygyggaggttttgagtttttgtttgtygygtatyggygttaggagtaagttygygyggtygyggagtygtagagttatagttttaaggygygyggyggatttygttygttttattttttygtttygygtttygggatagttttygtttttttygagyggttttagtttygttgttagygttttttttgttygtttagtygyggtatgggttgttattttattaatataygygygygygtatatatatatatatatatatatatatatatatatattttttgtttygttaagygtttatattygttaaygttttygtttygtttttyggttatygtagtagaggttaygygtgatatttaggattaygygtgattatygygattaaaygayggttayggtttgtgttygtagggaagtgaagttagatttttgttggatgtygtgtgttttttaggattgygttttttygygtagataggtaygtgtttggggtgtgtatatagtttyggtgataagtgttaaagagaattttygtgtttgtagtttttgttttatagttaagattygygttggtgtttttttttaaaattatgtttttagggatgtgtgtttatgttgttttatttgtataagatattttttttyggttyggtttttttygagttattttagygygtttttttagatgygaygaygtgttttttttagygaagttattaygaggttagttatttyggatattttttyggtagttttaagtttaygtagagatygtagatatagatattyggygygttgtaggtttgtaggtagtaggtttagaggtaagygatggtaaaggttygagygttgttttgtygtaaggggttygggggygtgtgaattatatttgttgatttttttaggattttygygygyggttattygygtttttttttaaattatttatttygatttattttagattgtggtyggggaggttattttttgtagaagtgttttttttttttaaygtyggygaataattttaaagtaaaggaggygyggttaggtgggtttttaagtttygygtagatttttgggttagttttggtygttattygagygtttttttattagattttggagggaagttgggggaagggygggagagtatyggygtttagggygtaggggttagagygagtttggygtttygtygtagtyggttgagattyggygaygygggggttgtatttgtggttgyggggtygayggtyggttgtagggyggttggttttttygtttygagattaggygtatttttattttygtygtatgttttttaygygggttttagygygtttattatygttatygtygtygtttyggttttatttatttagttyggygygygtygttygggaataggaatagygaggtttttttatgttttttgattgtyggttttagtyggygaatattttgygggygyggtatttaygttttygggygggtggagaggaagygttygygttygttyggtygygggggttgttgttaatttttagtagaggagtygttgtyggggagtttygggttygtygagtttttyggagtygggygyggtttttagattygtyggttttgtagtygtggagtagayggggttttttttttygtattttaggagagaaattggagaagttgtygggagygttyggtttyggttttagaagttgagaggttgyggtgtaaatttygtgttttagttggttygattgtyggaaattttattgygygtggttaggygggagaggttattgtgaygyg

SEQ ID NO: 6175 - DNA, 2868 bp, synthetic construct
  misc_feature 1..2868: note = Description of Artificial Sequence: Synthetic polynucleotide
  source 1..2868: mol_type = other DNA
ayggttttaygygaggaagagggyggggagygyggatygggtgtgggaggtygaggtgatagtaggtgagggtygggtgyggatggggaagtgagataagtatygtgtgggtattatttatttygttttattaaggaggttgttggtaagyggaatttttagttttttttttaatttagttgaagtttaattttattgaagttattttttatttyggttygtttggggggaaattaggygtttttggaagggaagggaagggagttygggttgygygggttaggtagttttttttyggtygtygygtgttttygtygtttttaaatttgtttttttttttattaagggaatttttyggggagtttagatygygatttttttttttggtttyggggtgyggggggyggataygygaggygtgggattgatggtagttttgtttttaggaagtaggtaggyggggatttttgggygttyggaggggtagtttygagggtatagggtatagggagaattagttagatttttttttgtttygggtagtygyggygggtgtggttagygyggaggtaggaygtygtygagtttttaattttatttttttaatttygatagttygtygtttttttgatygygtttttayggtttttyggtattygtttttttttttttattatatttgaggaaaatttttttttygttttttaatttaaatttagtagtgtttayggttgtygtaaatygttyggtttttagtaataaggtttyggtygtagagygagagtttttaggtgtaaggaaggtgatgtygtaaagtygggagtgtygtaaattaggtgyggtggggaggggggaggggtggaggyggaggggtgggggggaagggggagggagggggaggaggtgattygagtatttagatataagygagaggattatggyggatggttttaggtgtaagygtagaaagtaggygaattygyggygtaataayggtgagtggyggaggggatyggggagyggyggagttagggggagttgggtagtyggggygttttygggggtgaggggggygagtygggttgggggtagtyggggtagggayggtaaagtggagtgggaaagtagaaagtagtgttttttgttttttttygttgtygtygttgtyggagtygygtygyggtygttygttttttttgaatygttatgttttttatttggttttttttygtttagyggttttygtygtttttgtygtttttttggatygttagtyggygtygaygtygtygtattttyggygtagggygggyggtygggaygtattggttatttttttggtttygggtggagyggttgttgttttttttygtatttttttttatttttgtgtttttyggygtttttttttttttttttttttggtttttttagygygatttttttttagygtttaggttttygggagtygyggaataaatttgtgttyggygttgatygtgtaaagtggttttygygygtygyggtttyggtyggygtygtygttgtygttygggtttygygattygggtygggttgtgggygygyggtaggygggttgyggyggyggygggayggggyggtygygggttgygtggggtttgtgygygygtgtgygygggygtyggttgtgygygtygygggyggatagggttyggtyggyggyggtaaagttgggattygygggtygggygygttygygtaayggggattagaggygygggggygygggtttttaagygttttttttttttggygtttttygttgttyggtttagagtttyggtttggggatttygyggygagtttygygagtggggtttaygtttggyggggygyggyggggyggygyggggaataaggtaggaaaggtatttatttaaygtygtygggagtygygyggatgggggygagttgggyggygggtgtgtttgyggagttgttatttgggtttagagatygggaagtattatagatagatttttttttyggggtagaygaggtttttgygtygggatgggtyggtgtgygtgygtttygygtttttttttttyggtttttggggaagttgttatttgggtyggaygtayggagygttgaagtyggataatggggtttggatggygttttgggtttygggtggaaggagggtgggggagggggyggayggatygayggaygygyggggttgttatttgtatygtagttgtagtgtttattgatttgtgttgttgtgttaagggaaatatatatttttttgtttggygtgagagttaaaaaaaaagagagatagttygagggatygagatttgaatatgtggtggtggttgtatagtygttttttttagtttggagagaygttgtaagttgattgtatttttggttatttyggggygatgttatgttttttttttttttygtgtagtagygaaatgtttgttgattgttattgtttggatagtttttgtggygagaggggygagatttgttygttygggggyggygggagygtagggagagtagttttygtttgygtygtttyggtatttgtttgtataataatgggyggtaayggttttgtygtyggtygtagtttaggttatataaggaattataygtatatttyggatygaggggttygttttggtttttgygttatttttaaaaygatttttaagagaggggtaataaatgygtttataatgggatygttgtagygtygagaaaaygaggaaataygtgtttaggagaaaattttttygtgtttttttagttttatttttygygtttgggtttttttttttttttttttttgggatgygaaaygyg

SEQ ID NO: 6176 - DNA, 2678 bp, synthetic construct
  misc_feature 1..2678: note = Description of Artificial Sequence: Synthetic polynucleotide
  source 1..2678: mol_type = other DNA
gyggttggaygygygtttaggttygygtygttgyggatygyggagttgtgtagaagygyggtttggygggtggtataagttygatagttgygtygygtagttygttygygtttggttaagagtttygygagggtgtggggagaggatyggtttygtagggagyggaggttgygyggttgtatyggattttatagttttaagtygyggtatgaggygaattttgtaaagygygttttygttatgtatygttygatttttagtattgtgygtagtaggatttyggagtttattygtttgtggaaatygagttygtagygggaaggtagtgggtggagggtgggtaggtaggggtttggggttygyggttttttattttygygttttttygygttagtttygaaygtttttttggggygtttttgtttagttgtttyggttgatttygttttgtagttagtttgaggttaggyggtygttttttgtaggttataaattttyggygtaaaagtagggttttgaaygygatatygtattagagygtttagttaagygagttgtttttatttttattgtgtygggyggygtaaattgygggygtaggtagaggagtygyggttttgygtygggygggagtygaagtttagagtttygttagggttttttygtygagygtatttatygtygttgaggtagagygyggttagtaygaggattagtaygattaygattttggygtttatggtgygggygggygggygggygggyggaygagygygggtygggggtyggaygtygagygggtaatgyggttgayggagagtgaaagtgyggyggtgggaggygygygtygggygttttagaggggagagttaggyggggyggggyggggygygyggtgaggggygggttyggagtygagtgttggtygtggtyggggtttttgaygygygattttttyggyggtattttttatttatttttttygtttttttttygttttttttgtgttttygaggygtagtgygtttyggtttttgatttttttaggtttygttgggtttygtatygttggttyggtttgtagtgaggttygtagtttgagygaygtyggttggagggtygtttattgtttttgtgatagggttttattggagagattgaggattttaggygtaaagtggggygygygtggaaagttgygggayggggtttttygatggygggaattgaatgagaattaatgaaaagtaaataagttagtttygggyggagggtttgttggyggtggyggtttaaggtagtygagggggttttgttttttgtgygtgggggtttaagttygttatttgttyggtttgyggygtagtygtyggtagagttygatttgygggaatgagattygtttttgtagttagygtggttyggattttaagtttayggygttattagtygagttttagttttttygtttgtataaataaagtagaaggygtyggyggtttttagtaaaagygaatgtagtttttgtattttygattttttaatggtgaaatgagttaattataggtttatttygyggagtgggaygggagatttaatgagattygttttaygtygygaaattttttgtatygtgtttgataagtagatagtatttaataaatggtagttgtaagtaagttttttaaatttaagtatttattgttttatttaagaaaagtttygtgygatttaaagagttgagaatttttttatttygattttygatttttaggatagtattattggygtttgttttttgggtttagaaaattttttttayggagtygtttttyggyggtgtttagtttttyggatattttygagatattttagatggttttagttyggtggygaagggagggtgtaggtyggtatttaggagaygtgggggtgaggagagygtttttttgggtttygttttgtgatygtaggttgttttagttatttttttgtgttttttttagtatagygtttagygaagtggggttagtygtygygtttatttaggggtttgttttggggataygtttttgtttttggggagttttggtygtyggggagtgggyggttagyggttgtattaggygggagyggttaataggaggttgygagggtttyggaatttygttggtgggagtaggtgttttttgtgtattttttttttaaaattattttggtygttagatggttgtgggtyggtattttatttatttatttatttatttatttatttatttatttatttatttatttattttgggtattgggtttggagtygggaattttattgatttggttttgtttttaaagaattgaaggtagtgaggtttagtgaagaaggtagtygtygggygtttttaggtttttgttgggttgggtyggggagtttggtygtttatyggtygtagygttggggtttyggygttttttggtggyggygttttttttttygtttttagagttttggttagttttatttttgygtagttgatgaaattygggagggygaaggggttygygggaaatttatattygggtggaggggygttttggagttyggagattygattttgygggagtygygygtagtttygtttgtttttaaatttggttaaagtaaaygttatygtttttyg

SEQ ID NO: 6177 - DNA, 2756 bp, synthetic construct
  misc_feature 1..2756: note = Description of Artificial Sequence: Synthetic polynucleotide
  source 1..2756: mol_type = other DNA
gygggagggyggtagyggttaggttaatattygygatttygattggggygyggtaatttttgtttttagtttttataagttttyggtygygattygyggtygagaaattttgyggaggggtyggtgggttagagttaggttaggtagttgttgagtttttttttttttttttggygggagtgtgtgtgtaaggggttagggggyggagtyggagaaagggttgggggtgttygtgtttagygttttttyggaygyggttttataatttagttgygagaatagatggaygtagyggyggtttatttygggggttttttgttygttgtgygtygaggtttaggttgaagyggagatygtaagtttttggttttygttttttttaaggggtttygaggaatyggttgtygygtttttttttttaagaggagaagagygggygttgatttygygagttttagaatygygggyggggggtaggtagggggyggggggtagagggttagttatyggygyggaaygtttattttaggggttggtttaagatttttatatygagagttttttttgggtttttagttttggagtatttggagagyggatttttgttyggttaygtttygttttyggttttygtttygtygaygtygtattagtatgagygaygtaagtggttygggtattattygggggttgggattygtygygttatagtttygagtggaagggaaaaaaaaagaggaggyggyggaggaggtaagagtygaygygaggggaggggagygtagyggyggggttaaygggygggtaagygggygggyggtaatagtatgtttttyggttagygygggyggttttttagygyggygggggttgttttgggygygtttygggygaagtgygtttagttttyggtttyggtttttyggygygttygatttttyggtygtttttgagtttagtagtygygggtttygggatyggttaagagtagttgtaaygtttygtyggayggagtttttttttttttygggaygttgggttatgagtttygyggttatttgaggtataggggagtttgttyggttaggatagttttttygaagtttygtgttttygtttttgtattgygggaygttagygttyggttttggyggaggygttttyggaagagtatyggggtgggggtatggaattygyggaatttgygggttaggttygggyggyggttattaagttgtyggaggttgtgggygyggygttgtaggagtttyggyggtagaggygtttggtgtttgttatygtgtgygtggygttgttattggataatatgttgtatatggttatygtgtttatagtgttygattatatygtttatatgygygggggyggygagggttttattyggattttygaggtgtgggagtttattttgtygttgtttatttyggttaatgttagygtttatayggttaatatttyggygttttygatagttgygtggttagygggtttagtttttyggtttygttattttayggagagygaagaygtgaagatyggggtgttgtttgtttttaaggttattttgtagttgttagtgaattttttgagygggttttttatygatygtatgagttaygaygtgtygttgttgatyggtttgggygttatgttygtttttatagttttgttygttttygtygaggattaygttaygttgttygyggygygtagtttgtagggtttgggtttagttttygtygataygtttggtatagttatgatygtygataagtattyggaggagtyggagygtagtygtgtattgggygtggygttggtttttattagtttyggaagtttagtggtttygtttttygggggtattttttatgagttygtyggtaagygygtgttttttttggtgttagttgtygtgtygttttttgaygygttgttgttgttggtagtggttaaatttttttyggyggttgtaygggttygggttaatttgttagtgggtatttttatttatygttttatgttagatttttatattgtygtggtggtyggygygtttattatttgtaatatttttttygtttttttygaatttattattgttaygtggatgaagtataygatggyggttttygagtgggagatgggtatggtttggttgtyggttttygtgttttatgtgttgggygtttattttatygtgygtttggyggygygttatttatatttgtagtggttgtayggygygtttgggttggttgtgatyggygttagttygtgtatygtgttygtttgtygttttttygygtygttagtggttttattatgyggtttttgttttggtatagttttagtygatatagtattgttgtttaygttygtttttttggtggaygtgygttatgttttagtttatggtagygtttaygttatygtygatattttttattyggtggtttaygygttygggtttatagtggtaggttatattgtgtattygttgggttttgagtagtttagttttggtatgggattggttaatttgttttatgttttygttttgttgttgtttygtaaygtgggttttttgaygygttttygtttygagygygatgtgttgtttgatgagttatygtaaggtttgtaygatgyggtgygtttgygtgagygttttgtgtttggttaggayggygagtttygtagttygtttggtttttttgatgygtgygaggayg

SEQ ID NO: 6178 - DNA, 990 bp, synthetic construct; identical to SEQ ID NO: 5948
  misc_feature 1..990: note = Description of Artificial Sequence: Synthetic polynucleotide
  source 1..990: mol_type = other DNA

SEQ ID NO: 6179 - DNA, 829 bp, synthetic construct
  misc_feature 1..829: note = Description of Artificial Sequence: Synthetic polynucleotide
  source 1..829: mol_type = other DNA
gyggtgygaygaggttaggttygygttygttaagttttagggtygttgtygtygayggttatggaggaygagtagttygatagtttggagggttgggygtygtttygggagggttttttygtygatttttagaggtatyggttgygttttttggtggtttggaayggygyggagggtaagtttgttgtgatttgttaygatygtatygygtagtagtygtagyggygygagggggttyggttggggttggagtataagttygaggtygtygtgttttygtttagttgggtyggtyggttttyggtygyggggtttygyggygygygtyggtagttagyggygttgtggtygtttttggaatattgttttttayggttgtygtyggagttggaygtgggyggyggyggggtttgaggtttggggttygggyggtgggygttgttttggtyggygygygtgggtttyggygaggyggygttgtaggagttttgygggtagttggagygttatttgggygyggyggtttayggttgtggyggygttatygtgygygaygtttttttygyggttaagggtygygyggtygattgygagagttygygygagtttygggagygggttttgygygtttgatgggtygaggyggaygygyggttgygttaggtaagygaggtygggtygtyggygtttgatygygtttgggtggtttgggattttgtgggaggttttttyggygtygagagttttggttgayggttgatggggaggagtyggygggyggagaaggttaygggttttttagtatttttatttgygygggatygttgyg

SEQ ID NO: 6180 - DNA, 4119 bp, synthetic construct
  misc_feature 1..4119: note = Description of Artificial Sequence: Synthetic polynucleotide
  source 1..4119: mol_type = other DNA
tygtgatggtgttaaatygagaggagagttygagaagggggtgggtgatttttyggttgttttttattttyggygttttgtgtttttttttttttttttttttygttgygttttagtygagggttgttggagygaatgggggatgtagaggaaggagttygtaggttttygtgtttttttaatttttttygtttttttygatagtygygygttttygttttagtttaaggttagtggttyggtttygaggaaggygygggggtygygagagaygattttttatagtatygttaaggaaatyggygtygtyggtgttttygygggtttttttyggtagttygggggttgtttttygtygttgygygtttttttttattatttattygttgttttygtyggtyggagttttygttttattaatttttttaatttygygggyggygggtaggtgggggygygtttttaggtygtaagaagggagygtttygagattttttyggggtyggttttgtttaggagggagttatygaygtttttttttggygttttttygtygttyggttttttaggygygtagtttttttygagagtttygaattttatygttattttgtttttgtttygggagaggggaggtygaagtgttgtyggttagagggtttaygtaagtttygaaattyggggggaygttttttttatttttatttttgygttygttyggggttgggygygtyggggygtaygtaygtyggtttgttggygatttggygtatttgttygygygttttggttttagttgtygtaggttttttttgtatttatttttagtttttaaagttagtgtagttagtatygtttatttggagttttaatttttttttgygattttygtatatttattgtattttatttattattttygggtygygtaggttygggtttgygaagataygyggtttattttyggttatttygtttatttggttaaaggggttttttagttyggtattgggaaagatggttatygaygtggyggygaggttttttatygggtagatgttgttagatagttggtgtataaaattattgagagttattgggattttgtttayggttttggyggttattatttgtttttygtataatttggagatttaattttttygttatttggagtgttagaaaagtygttttggagaggggttggattgagtttgggatggtatttttttttgttttttatatttaaaaataattattatatatattaagaaaaaaaaattaatagaaataaaagtagtaaataagttgttgttttttaagaaataagaaaaatgtttatttgttattgatttttttttgtttgtgtttyggttgttgggaagttaggagttgttggtgtagtgttattataatagttagtgagttttttygtygagttattaattaattgtttttygtttagttagayggaaagtgttgttttaagtatttatgggtaggtttttaatattygtgaygtygttgtttatatatggattgaggaatagggttgggttaggyggtttttgtygttatatggttgatttgtatataygggttyggtygygyggatttygtygggttygygatttttagttygtaggyggyggggatygttggggtttygggygygyggttttagttgtagtttgggttyggggygtagggatygygggggagagggygygttatggatttagttatagttatagtaggagagygagttgttttaggttgyggtttagtttttyggggyggggaggaatttyggttttttgggattttttaaaaaaggygaagattyggtgtyggyggtttygtttttttagtttttgtttgggagttatttyggaaaattaaatttyggaaagaaatygagyggagtygagatattatagttaaatttttatttatttttttggtagtttaaaatygtaagtaaaaggaggtagygaagaaaaaaaaagttatatgtatttayggaagttgattgtttttttttgaattatttggtggaaagaagtggttggtgataagagtgaatgygtattgtttttttggaaagtttgttttatttatataggagygaaaayggaataggtttgggttgtttgtttgtttaagtattttgggtattttgggattgggagggtaaattttaggaggagtagaattattgtggggagtttygagagaaatttttagtyggagatatttttttttttttgttygygygtttttygtttttttttagttgttgygyggagygggygtttttttyggygygtttgggyggtyggttgygtgggggygtttagatggaagtttggatatttattttgtttttttagatatatatatatatatatttatattygttttattttygttatatattttygttttygttgttttttttatatattygtttatatattttatattatatatttttttgttgattgygttygygygtygtygttgttagtagtgtttyggyggtagagygggtttygggttygttggataggaggttttatgaagatattggtttaatttttattatyggtttttgtagttatagaatttttttgatttttatagtttaggatttaggatygygttttgttygtattygagttagaatataygtattagaataaatattttttttttttttttaaaaaatatttyggtgagtttagygyggtttttagtgayggtygaaagtatttttaattatttttaagaygttatttttattttttaatttattygttttattttgygagatttyggtagaaatttttttgtttygtttttaaagtaatttttaaaaatttttttaaagtttaaatagtagtaggttttggtttgttgggygtaaagtttttattttttagtgygttttagttygtaatggatagtygggtttgttyggggttttataggaggttggtttygggtgtttaagtttagygtatygtygtttgtatgatttatttatggtygtttgtgtaggttgygaattgttttagagttttttttygttttaaagtygyggaggttagggataaygygtagggttagtttygtaggtttgttttgttttttttttatttygggttyggagyggttttagtttagtgtgggtyggggygggygggagttayggygttaygtygtggaggaagygyggygttgtaggygggtttttagtygtttatttgtttygatygttgtagtygtgygttagttttygtygggtttagygtatygyggttagggttttgaggttgtygggagyggtttttttttttgtttttttattgaagygttgtttttttttttttttttaaaatagtyggtatttagyggtyggttatttttttgatttaagttatttagagtatatttgggaaagtttttygttygygttgtgygtttttttttaattggggatgaaaaggatatggaaagaaatygtagtaaggttagtattttagtagatattttattttagtaaaaatgtgtaaagttttattttttaagaaagaaagaaagaaaagaaaagtaagaaaagatagttgygtttttattaygtgygttagtttatttygtttgygttttggygggtttygyggttttygygttgattatgggtaagaygaygtttyggaagggagttygattygtatttygggttttgagttygaaagaaygggggaaagtygaattatgtaaatgyggatttttgygatggggttygggttayggttttygtyggttttttaggtgaggtatttatyggtagtaagygygggygaggygattgttygygtttygtttttttttgygtaygtgggyggatyggtaggygggygagttgttygggtygtttygygattggygttgttgttaaattygtyggyggtygtygygygttatttygagggggagtttttggaygttygagtgttyggttagtagggygyggagggtaggatyggggttgggggyggggyggggtgtttgagygagggaaaatygygaggttttyggttgttatttttttyg

SEQ ID NO: 6181 - DNA, 1575 bp, synthetic construct
  misc_feature 1..1575: note = Description of Artificial Sequence: Synthetic polynucleotide
  source 1..1575: mol_type = other DNA
aygygtttatggaaggtggtgttygttttatygttttygtggaaggttaaaygagttttyggtgtgaattyggagaaagagagggaagtgtagygttagttttattttatattttttttttgtttataaataattttaagtgttattttaaagaggayggggagygyggtagaggggttttygggtyggygggttggggtygtyggatttgtttattaygttttttattttgggygagtttgtataaataaataaatttaagtygtyggtttygygggaggtggaggaggagtgaygaggaggaggaggaggagggaggggggagggagagattagtttgggaagtagtayggattgtttattygattygtgtygtygtagggagtgtgttaagttatagaggygtyggaatyggtttttgygtttttygttagtygttaygatttatttttgtttatggggtttttygtgtgygttttttygttyggggattgaaattgattggttygggagataygaggygtttagaaggattgatagygyggtattaattgttttgtagatatttgaagggaaagattgggyggagagaaggagagtyggttagatttttttaatttttttggatttggaaygtttttygaaataattttttttttatttaggtgtattttaattatygttggttgtgttttttyggtatttttttttttattgttaattttttygttttttttgtygggagtagyggaaagggaygttttttagygatataagttttttttttttgtttygtagtttggatagagttttttggtagyggttgtygtttttatttattttatttatttatttattggtttttaagaygygagaggatggtagyggagygtatttataaagyggtagttatyggtgttygyggttttggggagttgggygygttygggayggtggttttggtggyggygygggyggagygyggygtayggttgtygagtttagggtygtgygggttgttgaygttggttttttgttygttggtatttagtttgttygtttattttyggayggtygagttgtaggttygggtgttgygtttggaagyggagygyggggagtagtaaatggagayggttattttgggaygagttaattaattgttggaygaggtttgtgttttttgttgttggtttttattttttttygyggygttttttygygtagtttttagattgtttagtyggtgttygygggygttygttttttgygagttttaggttygygygagttgtttgygggaggggtyggggatayggatagaygttgttttattagggattyggaggatttggtgggtaagagtatgatttagygattttygtttygggtaagygttttyggtttttagygttgggagygttttgggtaygtygggtaggtggaggaaggttgggygygyggaggttygyggaggygggtaagttttatttttttttttygggattyggttagggtggtgtgatagtygtttygygttygygtagyggtaagygygtttagaggtttaggtyg

SEQ ID NO: 6182 - DNA, 2401 bp, synthetic construct; identical to SEQ ID NO: 5958
  misc_feature 1..2401: note = Description of Artificial Sequence: Synthetic polynucleotide
  source 1..2401: mol_type = other DNA

SEQ ID NO: 6183 - DNA, 1579 bp, synthetic construct
  misc_feature 1..1579: note = Description of Artificial Sequence: Synthetic polynucleotide
  source 1..1579: mol_type = other DNA
tygaagtyggggagygggagygtaygtgygygtgtttattttgttttgggtttttygttyggggaatttygggggtgttagggtatttagggttagggaagtaagatgtygggtygtttattttttttatttygtagttygtttygaaaattttttaaatygagatttaatttggatgtttagtttygtttttttttttttttttttttttttttttyggtygaggttttttttagtttagtttttttttttatttttttttygtygtggatttttattagtatgtttatttgggaggattygttggggggygggagatattygaagttatttatygttagygttttttyggyggttttttygggygatagygtttygggagttttattygtataagtgttgtttttaattaattgtttgggygggggaaggaaaggggtttygtygtygttttygttyggaggttggagtgttgttygtygggtygtgygttygttyggtagyggygtgtattagtattatttttgygtgtaagtttgaaatgtgagttgttttygatttatattygttygygttttttygtagygaagtggttgggttgayggtttgygygygygagtgagtgygggyggygggttggggggyggggtgyggayggygaggttygyggggyggggagggygygygygagtyggggttttttggagaygttaaggtaggtttgttygttttttatttttttttygygtttttttttttttttttttttttttttttgtygyggttggtttggtttttttyggagtttttagttttaygygggtataygtagggtgggtggttaygttygtagggttygygagygyggygtagagygygggtygtgggaagttttttyggygygtttygtgygttttygtttttygygygttttyggtttattttygtttttggagagttgtygtttgygttygggygygyggttggttgttttttyggyggyggyggyggyggttttattagyggagttttygtttatgattggtttygttygggaagttggagaygggygatgaataattgatgtgtgyggtgyggtagtyggayggyggyggyggtggygggtagtagygagygggagygygggagtyggagygttttyggagygggtagygyggagygagygggygtyggattygttygggttttygygtygtygtygtygtyggggygyggagyggggatgtaggyggygttygttgtttgygygtagtttttgttyggygttggttgaattttattyggagtygttygtygyggtygtygtyggtygggttttaagttttygagggygttagggygggatygygatyggtgtaatttttaggtaagtgyggggtyggaggggtyggygtttgggygtttaygggtygggttttgggtttttttygggygygggggtgagtgtgygtgtttgtgtgtgatagaggagggtyggtgtattgtgggtagygtygtgtgttgtatggtgttagttttaggtttggtygygagagtggtatyggygtgtatygggtyg

SEQ ID NO: 6184 - DNA, 919 bp, synthetic construct
  misc_feature 1..919: note = Description of Artificial Sequence: Synthetic polynucleotide
  source 1..919: mol_type = other DNA
tyggggygtttagtgtggtttttttattygggagtttggaagggtttttygtagttygtaggagaygtagygtttttygtttagggggagtaggaggatagttggtygttttygggagttttaggygygaagyggttttttttygttttaggtgagttttgttygaygtttaaggtttaayggttagaatygtttttgttygtyggatttagygaagttaggggaataaattttaaaaatagttygggttttttyggtgygtttatttttatataygygtttgttygttatttaggagyggygtttygttgttaggtaaygagagttygygttttaggagttagtgtaggygtygtaaagyggaaggggygygyggataggtgagtagagggtaygyggtgggtagygaagggggaaygygtagtagagaggagagggygtgtaggagtaggagtaggyggtagagtagagggggygyggtagagtagagggggygyggtagagtggagggggygtgtaggagtaggagttygtygtagagtagagggggygyggtagagaggagggggygtgtaggygyggggygttyggtagagagaaggggtygtgyggaagggggygygygttaggggagggggttagagaggagggggygtttaggagtygggtttgyggtagagatgaggyggtgtgtaggagggagagygygtaygagggggtaaygggtagagaggagagggaatgaaagaaggggagygtggtagagagaagygggygygttttagggggyggggtttagggaggagggggagygtaggatyggggygggaggtagagaggagygggtaygygggaygggygtgtgttygtgaggggtygaggaaaggygtatgtggaggygygyggggtgggtgagtyg

SEQ ID NO: 6185 - DNA, 944 bp, synthetic construct
  misc_feature 1..944: note = Description of Artificial Sequence: Synthetic polynucleotide
  source 1..944: mol_type = other DNA
tygtyggagygygyggggayggyggyggyggygttatttggaggygyggtggygggtaggtgttygaattgtayggygatgtagaggtygttgtttagggggaatttgtggtagtgtagtattttaggttaggggaagtygtaggtttttatgagyggygygtagtyggygygtayggtttygtatagygagyggtaygggtagatgggtyggtygagatagaygggygtaaagagygagtataggaagatttgygtattygagtggtagygtttggttagtagyggtagttagttgttygtttgttgttttatttyggttaggttttygtgttttagtaggttgggtagtygtatgygtttgtagtttatygtgtggtagagyggtaggtyggtagggatgttaaggtattgyggyggtttggagtaggagyggtygtgtagyggttyggtttgttagttatagtagtygtatttttygtagygygtyggygtttagtgtagygtttttagtagtagygttagygyggtygttygtaygttttttttygtygtygtygttygtatggttgygttttttttaggtgygygtygygtagtttttygaygttyggtgttyggyggtttaggtgtttyggygtgygttttyggttttgattttatttagtygtygtygtygtygtygtggaggtygtttaggtgggtggtagtttgygttgygggygtttygattgattttggygttttttatttyggggttttagttygggtttygtygtgygttttagttaattttyggtygtttggttttagttttaaggyggggaggtagtgggggyggtttttagtttttttygtattttgttygagygtttygtttagygttaggttttgygtttttttttyggttyggtttttttgtygtagttttggtttygtttagyg

SEQ ID NO: 6186 - DNA, 1096 bp, synthetic construct
  misc_feature 1..1096: note = Description of Artificial Sequence: Synthetic polynucleotide
  source 1..1096: mol_type = other DNA
tyggttaygygttgggttyggggaagaggygyggtygyggtygaggyggggatagggaggyggtagttttttttgygtagygayggygygggygggyggaggtyggggygttttagtttttygttttygtttttttyggtygtgaygttagagtyggayggggtaaattgagyggyggyggyggggygttggggyggagattgygattyggagtygttyggattgayggagtttattgyggtgygggygttggygygggtayggaggattygggtaggtatygtaagygatttygaggtaatayggtttyggttttttgttygtagggygyggtgtyggaggggagygggttygggggaggtagggaggtagggaggtttttagagttaygygggyggggttgyggggatttyggggtagtyggggygtagggygtagggygtaaggtgtayggggtygagygtgtagtttgggaggtggtatagttgggggyggyggggattagggtagygttttgggggttttaggttgggtttttagattgggttttygayggygttygygggygttttttttagggagygygggttttygtggggaygygttygaggtaggtgagtygaggttggggygttygggggtgttttyggatgtyggtgygygyggttttttgattygttttttygyggtttgggggaygggagaatggggggtttayggtygttttgggtttttatygygtatygygttygtagyggagtttyggagttatggttttgagygagttggygttggttygttggttgtaggagagtygtygttygyggaagtttattttgtttatygtgtttttggygttgttgttggataatatgttgtttattgtygtgggtaygtgyggatagggtatttttgtttyggtattttagttttagygtttttttttyggtattttatttatttttgygyggtttyggagtttygttaaggttygggaaagttggagaattygttttgtaaaaaagatattttttttaggttgtygygtyggggttaggaggagtygygttgtgtggtttygtttttttgatgttyg

SEQ ID NO: 6187 - DNA, 4048 bp, synthetic construct
  misc_feature 1..4048: note = Description of Artificial Sequence: Synthetic polynucleotide
  source 1..4048: mol_type = other DNA
aygttagagatygtggggygagagagggagagagttggaagtttattgtttyggyggggtyggtagttttyggttttaattygtaaaygaaygagtygggttaagaatygygaaygtatygattttgggatttygaggttaagygtggttgatggggtgggaggatttygtattttttattttaggattttttttggtttaggaaatygttgggagttttgttaagtgtggggattggtataatygaayggygtttttagttygggaattagtttttgttygtttattttygyggtgtttttggggygattttagttttttygaygyggggtygygtaaggtagtagyggyggagygttaggttagaggaatttgtttgtttttttgttttattagtttgggygaggtaggttygggatttagggggtygtagyggaggyggygtyggttagggattttgtagggatyggggtgtttyggagggagtggtgttggtggaggaggaggyggtggttgagggggagtaggtggggaaagaggaggaggaagaagaggaggaggaggaagaagaggaggaggaggagaagaagaaattggaggaagaggaggaggygaaggaggaggagaagtygtagygggygtygtaggagygagtgagttgggagygaggggygaaggygyggagaagttyggtygttyggtgggyggtagaaggtttagtygaggyggyggygtygatttygttttattttyggttyggatttaggttttygggtttttaggygtttatttttttttgaygtattttaaagagtttttttttttttattttagggygagtaatagygattaattattaagttatttattaggtttyggaggaagttgtttatgtgattttygtattaattaggtttatgaattaataaatygtttgtataatttgtgaagaagygaatatttttatggattgtttttggatttagggygttttgttygttttttgtagaggagaaaaaatttttttttttttttgtttttttygagaatttttttttttttttttttttgtttttaatttygatttttttaygttatttygttaaaaaaaaaaaaaaaaaaaaaaaagaaaaaaaaagaaaaaaaaagaaaaaaaattattttaatttaygtttgtaaatttttttggaaggatttttttttttttttttaggttgggygygtttggtgtaagattttygggattttyggttttgtttttttttttttttttttttttttttttttttttttttttttttttttttttttttttttttttttttttatttttatttttattttaaataaaygagtttttaattttygttygttttygtygygggtagygggyggyggaggtagygtgyggyggtygttaggagttgggagtttagggygttygtttttyggygtagtatgttttagtyggygtttaagygttgttttattatygagtygttggtggttaaggatagttttttgttygtttygygtttygaggattttattygtttygyggtatttagttaygttaattttagttttataaattygttttttaayggtttttattyggtygtygtygtygtygtyggtaggggygtttattttaattyggatttggtgttygtygaggyggtttygtattygtttaatttygtygtgttagtgtattyggtgtygtygtygtaygttttggtygtttattttttatttttttygtattygttatattttttattygtttygtagtagygggattygtttattttttatttttggtttatttatygttatygatatttgggttatygtttttaaggtaygtgttaygtygyggaattgtagygygtygttttygtygtattttttattgttttyggtttgtttygggtgggygtttggtaaggtttgggyggaggttttttyggttygygggttagygygttttgttgggaaattaggyggygyggggtygggygtggtgtygatttttagttttygaagttaygattggtttggagtgatggtttgygggtygtttgattttttgggaaggggtgygaayggagaagttgttttttagtgygttygaattagagtaggttgggttgtgygtgttyggygtygyggagtttagagttygygggatttttaggtttttggtattttyggtaatgtttttaatygttttggtttygaggggygyggataggattyggtygttaggtttgttttygattgygttygattttgtttattatttattttgygtttttttagtttagattygyggttttttagttttttatttttttttggaggygagaggattttygygtttygggagaaaagtatgggatttgtttttttttttttgtttttyggaggtttggggaggggygggaattygtgygggaggaaagttttagggtttggygttttygtygygatttgtttaattggggygtygagtagttatagygggaaggtaggttyggtttggtttttgtttttttttttttttttaaaaaaaaaaaaaaagaatttggttaggaaattgttttagagggaaatatttgttygtgtgtttttattttttgygatattttttatttgtttgtttttttttgggtayggggtgggaggaggagagttaaaattttagaaaaaggagtaattagtttayggattggagttagtaaaagatttattttyggyggtagtygattaatatttygyggtttgtttatttattaatttattgygtttttgtyggagtttagaatygggtagatgttatttttttttttatattttaaaaaattaaattaaaggaaaaaaaatttaaaaagttttttatttttaatttygaattggatttgtttgtattttgtttggattgtyggtttgtttttttttgtttgggttttyggtgaatygattttttatgttaatgagtgaatttaaaattttgaggttttgtttgaaaagtttagggttgtttttttttattygttattagttatgtttatggtttttttattagattyggagtygttgggatttttttgygttatagattgttttggyggtgtttgtaagtyggtaatttttygggtttygattttttygttygygttttttttttagttttygggagtygggagtttyggagtttagttygygagaggtagtagyggttgtagttaagtatattygtyggttagatttttgtttygatygggttttaaygattygtttygtttttatattttttyggaggggtaataaaataaataatttaaaaataaatttttatgaaaattttggagagtagttygtygtttttttatygtgggttaaagtttttygagaggttagaaagaagagaaagtagttttttygggttgtgggygttaattttttggttaggttttgyggtttttttttttgtttttagygttyggygaggaggtggygaggttygyggygttagggyggttgyggagtyggtygaggttaggagtttggggattggtttttttgygatagyggttggttgggtgtygtatyggtggagattyggygtttygggtygggtagttgagtaggygtttttttygtgagtttttgggaggattatyggttttygtaggtygagyggygyggttatgygaaggttttgagtayggtgtygggttagttyggttygggagaagtgygyggtttyggttagagtagttttttttaatgggatttttgttgtgtttttygtagggaaygatattagtttygagagtttttttttgtataaygygttggttygaaagtttaagyggattygaatygtttttttttygttttagtttttaaggttggaataygtttttgagaagaattattaygtggtgggygtygaaaggaagtagttggtatatagttttagttttayggaaatttaggtgattgyggttygggygygaggaatttatttaggygtgyg

SEQ ID NO: 6188 - DNA, 3292 bp, synthetic construct
  misc_feature 1..3292: note = Description of Artificial Sequence: Synthetic polynucleotide
  source 1..3292: mol_type = other DNA
tygttgtygtygagaygygtagyggatgtygttgtttgtygyggyggaggaagttaygtygttgygttttyggtttattttgtttttattaaagygttagttagatagttttaaaygttagttggtyggagagattttttgggagaaagtgttgtygtyggggttatagattyggagttgattygygagttttgggtatyggyggttagagtagaggggtgttttttygagagtagtygtyggtgtygagaagttgttgttttagtagttttatygagtgaygygygggttttggtygggttagygygtataygtatataggtatatttatttttggtttygggggaaggtttatttttyggttttttagggttaaaggttaaggttaygyggatttttgagttygaagaygtagtgygaggatttatatttggatttttttattatyggttggatggtgggtggggaatttaaatttttttttttttggtttygttttttttagtaggttttaggaaaaatatygaggtygtyggattttaaagggtaggaaaatgatgagtttttygagggtygaggttaygttttgttttttgggtyggygttgygtggttttttagttgygtgggggyggygggtttttgtttagttttagggggygggggagyggtagttgygagygtagataatttygaggtgattygggagggtttggttygttttttttttttttygtaggtttggyggygggaagygggtttttgygtygtaggggggagaggtaggygyggttttygggttygyggtygttagtgygtttyggttaagggygtygtttgtttygygtttttygttygttttttgygttygtaggagygtttygagtgtttttttagygggagttaatatttttttgtgttaataggtttgtttttatttgttgtttaattggattatataaagttaataaygggygggtttttatagttygaagttaaagygttaaaattygagggaaggygaggagggggyggtggyggaggyggttgyggggtyggggttyggttgagttttygtttgtttaattttatttgttattgtaygygtttaatygtygtatatttttygtatttaatttggatgatattttgattttattattagtattyggygtyggattgaygtagtttygagtyggggattgtttttgttgtttttttygygggagtygtagtygtagtygagtygtttygatttttyggtgtygyggtagggtygtttttygttttttygtattttttttttatgygagttygttygtttgggtttttatttygttttttygtygttggatttgygttyggggyggttttygattttgygtttygtagttgagtttygtttatggtttgattttyggtttttygtttgttygtttygtygttygtttgtttygttttttttttttyggggattyggaggagaggggattatgtyggaattygggtyggaygttgtyggtatygttagygtatagttttaatygtygtygttttttttattygtttttaaggagttttygttttttattaagaatttgtttaayggagattattatyggtygttttttaagttttagtygtttttayggaygtttttygygttagtttyggttgtygtygtygtygtygttgtygttgtygtggyggttaagggggttttggagggygtygygggtttygygttttygtaggtgggygatttggttttttttygttttgagatttyggygtagaggtttgttttgttygygtattatttggagygttttttagtttggtggtatttttatattttgattttygtyggyggttatttttygygatttgaaggtatygatttttttttgaattttygttgtttttttgygygttygtttygttttygtttygygttgttttttttygtagttttgggattttagtattygtaaattttttgttyggttagtttttttyggtttttagtttgttttygygttgggttgygttgttygttaatttaattttatttggtgagaaaagaagtggaattggagtttygggtayggtgtttttygggaaaagtggtttygggygtgaatagggaggtttyggayggtyggggtttgggatayggtttggaaggagggggtgattttaatgygtttaagtygaaagggaatygttttgtyggtttttggygaggaagttgagggaatggaaggaggtggtygygttattattatttgtttgtttgttttygggaggagggggattttaggattyggygttttttttttggtttagtygagaaggaggtagttygygggaatggtgaggttttatggtttgggatttggaggtyggygygggttgagtttgtygtttttaggygtygggtttygtttaaggttgtgtyggtgtgtatgtgtgtgygttygtttgtttgtttttttagtttyggagaaggttttgttgagagatttttttttygttttyggtatagatygygatttttyggagttattgtttaaggtygatttygattataaggagttggattttaagagttyggaygagattattttggaggagagygatttygaggaaagtaaaaaggaaggygaagyggygttaggygyggtyggggygagygtaggggyggyggyggttatttygggygtagaagattggaagaagggygttgaaagtttagagaagaagtyggygtgtygtaagaagaagaygygtatagttttttygygtagttaggttttttagttygagtttattttygatatgaagygttatttgagtagttyggagygagtyggtttggtygygtttttgtattttatygagaygtaggttaagatttggttttagaatygtygtaataagtggaagyggtagttggyggyggagttggaggyggttaatttgagttatgtygyggygtagygtatygtgygggtgtttattttttattaygagaattyggyggtygagggygyggyggttgtagtygygggggtttyggtgttagttagttagtygttgtttattttttygtatttygtttattattygtattyggtggtttttttygtgtygttgttayggtyggtttgaggttttagaggggtgggggagggagygttyggtttttttgttyggatttyggaggagattgggtygggtygagggygtygagaagtttagyggtttttaggaattggggtttgggygyg

SEQ ID NO: 6189 - DNA, 3753 bp, synthetic construct
  misc_feature 1..3753: note = Description of Artificial Sequence: Synthetic polynucleotide
  source 1..3753: mol_type = other DNA
gygyggagattygtygtttgyggaggygtygagttattttagtttygagtttygtatygtttttgtttttggagagaagggtttaaggggtttaaggagtyggagttgtygtagtygttaggaattygggttagaatttgtagttgtttttagttttggttgtttttggttagaygtygttgatgttygttaggttttyggygygttttgggggygtatyggtgttgtgtgtttggtyggagygttttgaaatttttyggggtygttyggyggygttgygattggtygygttygggtaatttttatgtaaatgaggtygygtygttttygygtygtyggagattyggygagttggygggygaggaaggggtatttgtatyggggttgggygggygtatttagagttaggygggtaggaatttttgygtagttattyggtgtttgtatgtttttggygyggaagggaygttttattagtttyggygttttttttttttagatttttttttygtttttttttattgtttgtttgttgtattattttttatttagattatttagatygtttttaaagggagtttttggtttttttygattttttatgaatttaggatgggtagtaaagaagatgygggtaaggggtgttyggyggtyggtggygtttttagttttattatttagtttattttgggygggggtttttyggaggtatygygggagttygtyggttggttagttaggaagygtagtttgttygtgttttyggaggaggaggagtyggaygayggttggaaggygttygtttgtttttgtttagattagtayggttttaaggagtagggttttaagtattatttttttattttttttttttgtttgggtaaggatygtaygtygttagtgtggtagygagygagygygaggggagggaggttgagygtttygttaagattttygygtygggttttttttggttagagttgyggtagtygggggttygggatygyggggagaggggygygtattgtggtgtttttttygttyggtgggtttttgggagtaggygaatatagattygtgtyggtttgggttttttggggaaggttgagttgttgagagagtggattatagygagagggataygyggtyggttttatattyggttgtttttaattattgtatatttggtatttttttttyggataygaggtggagatttgtaagtygggtttgggtagtttgtttttatygtaatttttttttgagtttttttttttattygtttygtatttttgttttttttttttttttttttttggaatgattagtattttaagatgattgataatggtgtattttagagayggtttttttttataatatttgaygaaggggagttttgygttagtttttagygtgatttttaaataaayggtttgtgaaatgatgttattttataaagttygaggaatttttttagtttaattattattaagtaaattygttttttaaaattatgttaatgtttttttttttagattttttttttttgttgtttttggtttatttataaaggtgggagtatagagattttatattttaagtagttgggttttttttttgtygtttttaaaggayggggtgttgggtttggggggttagtgagagggataagaggaggggattggtaaggtgggattaaggttgtaggygtttgttaatygtttggttttagggagagttggyggttttygaggttttttaattaattttatggtttttttgtttgttttygttttttaggtatttttaagggtagyggaggttygggttygggyggtttggagygtaygttttttttttttttttygtattyggattttaaagaagagaaagagaggtttttgttygygggttygttttygtyggggttygagyggtygygggayggyggygttgagyggtaggtyggygyggttaagaagaagaygygtatygttttttygygtagttaggtgtattagttygagtttattttygatatgaagygttatttgagtagttyggagygygtttgtttygtttttagtttgtagtttayggagatttaggtaaagatttggttttagaatygtygtaataagtggaagyggtagttttyggttgagttggaggyggttaatatggygtaygygtyggygtagattttggtgagtatgtygttggtgtttygggatagttygttgttgygygtgtyggtgtygygttygttygtttttttygygtygttttattattygggaagtaatttttyggttttatttttttataatttatataataagttygattattgatyggttygtygtttygygtygtttttagttgttygtagagtygggygygtattgtattgtaagtagggtttyggagtaaggyggygtgtttttagaaatatgaagaaatatattatgtgtatttattagtttttatttatggtttttgttttattttttgttttgattgtttygggtatttattggtattttttaagttagagagtttgttttttatttagatygaattagtaygttttgaaaattattyggagtgagatgttttygggtggtggtgggaaagggagttttggttagataggttgtggttggtagggaaaaaaattaggaaaatatttataaaattaggtatattttttttttatatatatatttgtatatatgtatatgtatataygttyggttaagttaggtttttagaggttttggataattattaaattgttttttttygttttttttatttygaggatggtagggaygaaaaggggagagtttagatttgtaaatatttttaaaaagaaaaaaaaataaaatattttaaatatttttgttaattttggtgggtttggttattyggtatgataaygtayggaaggtttttaggtttttyggtggaaagatttgtatgygtttgtttgtggaagtttggttygttttaygtggagggtgggatyggggttaggggttaaaggtygggattttggygtygtttagattgtaygtggttggagttgttygtttatttttttttttaaygtttagaatygtygygygggttggggygtatttyggttggaatttagtttaagagttygygyggagaaagataaagattgggaggtaggtttygttatttaagygattgttttttgggaataagygagttgggtgtttagyggtatattttyggtattgggttygttttgagtttggttatagtagttttygttatgatatgttttgtgtygygtattttttttttaggggtataaagtaggygatggygttgtttgtatttagtaaagtttttattttgttygtygygagtttggygygattagtttgtygttgygtttagttattyggtyggtggtagagttatgtgtttygygyggagagggaattgggygyggtgaggtagttttgyggtttaggagagattygaggttygggattaggtaaagaaggtgagggaggtaaaggygtttttttatatttttttgttgttaatagtttgtattggtttagygtgtggttggattatyggttagtaygyggtygtttgttttgaatggaattttgaygygyggygggggygtttayggattttttygttttgatatttgyggtygygtaggggttgggagggygttgtatygagagaatagtygyg

SEQ ID NO: 6190 - DNA, 829 bp, synthetic construct; identical to SEQ ID NO: 6179
  misc_feature 1..829: note = Description of Artificial Sequence: Synthetic polynucleotide
  source 1..829: mol_type = other DNA

SEQ ID NO: 6191 - DNA, 1328 bp, synthetic construct
  misc_feature 1..1328: note = Description of Artificial Sequence: Synthetic polynucleotide
  source 1..1328: mol_type = other DNA
gyggggtygttgygygtttttttaagtgtgttagygggggaggyggggttggaaaggaaatttggtgaagggttggttyggagtttggggtggggatatttattgygggatagggttagtaagaggattygataygtatygtttygagtgataygtgtaaatgttaagatatagagatatttgtaaatgttatttaagagggtgaggaygggggagyggtttygaggttgtgtttttyggggtaggtattggtttttgtggggttgygggttaagtgtygtttttttttaaggaattggtatttggggggggggggtyggtttygtygygttggaagygtaagtttyggggtttyggagatgygtyggggygygtygtttttyggggtagttttggatttyggygygtttaggygtagygtgyggtgttttyggyggggygggtagygagtygttttagttyggygatttatttygggtttygtagggygygagtagagtatyggttagggygagtaggagggygygggygggggataygggtagygggygygttgttatygtygtyggtttttagtgtagtagttttygggttyggyggygagygttgtattattttaygygggygtygagtyggggtygggygtygygatyggagggattttttgtttyggygagttagtttyggagttttygygtagygttygygtygtygttgagtttttttagttttttatttttaaaaaagttttttttygtgtgtgtgygtgygtgygygygygygygtygttttggtataagttagttttgatygttgtaataaatgagtaaattgttygagttggttyggggattaggaagagygttagtgagagaaggtaggtttgtgaaatggatttayggttagtagttatygtttttattatygyggaataaattattgtttttttygtattttygttagttggyggygtttygygggttttagagatygttygggttttttygttagggtttygtttygagtygyggttygtttattttygagggtgggyggtttagaygtggtttagtggygttygggygttyggagygtataygttttygttttaggatgatgtggtygtagggttyggggygttyggttgttaagygtatatgyggyggtayggtttagttttttaggttgaagttggaaaygatgattttgttattygtttttyggttttttgggaattttyggagtgygggttaggtttttatygyggtttatagttyggygygygatttygttyggttttaagygtttaaaggggtatttttygttyg

SEQ ID NO: 6192 - DNA, 2957 bp, synthetic construct
  misc_feature 1..2957: note = Description of Artificial Sequence: Synthetic polynucleotide
  source 1..2957: mol_type = other DNA
tygtttttttygtataggtgttygattyggagttygggaggygggttttttttttaggtatttagtttagygttagtttgggtttatttttygttattttatagygyggggagtaggggaggtygaaagtygggtagtttggggggtygggataattygggttgtagtaatttygggyggtagtaggattggagagttggtgtyggaygtattgtagagaygtttttgttttyggygygtttttygatatttagtagagagtttggygtttttygttttgygygttygaggttatagygyggagaaatttggyggggtttyggatttttyggtttgggaaaagygatgattgttttgaattgttggggygttygaaatttttagggtttygatttttygtggggtaygygygatttyggygtagatgttagttygttgtttttygggttgagggagygaggattttagaygattttagggtygttgtttaggtttagtttygygttttttatttygttatttygttttgyggttttagtttggagatttayggattttattgygattttttgygtagtgtagtygttttttatttttagtttygagtttygggtaatttaggggtttyggygaggygagtttttttggggygagatgtttygagtygagtaaaggggtygygtattggayggggtttttaagttatagttttgggggttttgaggagtygtggtayggtttagggtagtyggggttgyggggttygtgaagttagaygaggttayggatttagggtttttgtaattaagatygygagygattgtggattygggayggatygtataaaggaggaagggggaattagaggggygttyggtttaggaygtgttaggtttgggyggggyggaaaattgatattagggygaggataaggatttygtttttttagggttgttaggggaggggttygttatygttattttttatgggttttggtttygayggtgtttaaagggyggagggttgggtygggttggtygtattygggygttgttggyggttaagttggatgggtygttagtgagtttyggtgyggtatygttggtttaggttygggygyggttggatatggttatttattgygaygatttgggttttttttyggtttygttyggttaggtttaggttatygygtatttttygggttatgagttaggggatttgggygyggtgggygggggtttttttttgtgggtgaaygygttagygtttagttttaagttttaygtttygggtttygggtttgygtygttttaygyggtttygagttayggggttttyggttygtttttyggygtttygggyggtttggygggygtygatttygtttggttgagttttttyggttagtaggagttgttgaggttggtgyggtygttttatttttattyggygtttatygttatggttatttagagygygtygttgyggaagttgaygtttagttagatttattagtaygtggttggtaatttttttttttataagygtagtaaggygggttggtagaattttattygttataatttgtygtttaaygattgttttaagaaggtgtttygygaygaggaygatttaggtaatagyggygygtyggttygtttygtttaggattttttattttttygtygggtygygggtatttygggggtgggagtattttagataatttaatttttttttgygyggttggggatattyggggaggagggagaaggggaagaagtgtttgggtatggataggtttttagatagyggttgagtttattataggttygygtttatagtgyggyggtttyggggtttttaatttttgtgygttttttyggaggaagaagygggagagttagtaagttgggtgattttgggagtgatttaatttttttgggttttagtgttttatttggtaaaatggggaagatagygtttattttaaggatgggtaaaataaataggatgttygtttggaaagttttggagtttatttgggggtttggygtggtttgygttgtttttggtagagyggttggyggagttttattattagtatttygtaggtttttttttattttaayggggttyggttttttttagggttttttttttttttttttttggattgttattttttttttagttttgttgtggaggtttatygggtatagagtgttygttaagggtggaatgggggygaggatttagattttttgtaagggttagtaggggatttttttgaagttgattttttygttggtttatattayggttygttaaagttygaattttttgaattgggttgtttttttttttgtaggtaaaggtaattattggattttggattttaattgygagaagatgtttgataaygggaattttygaaggaagaggaagaggagagttgaagttagygyggtygtgygttygggagttaggagygtgggaggggtygaggygttagygttggagttttygagygyggtttgtttggatttgtaggtttygttttttttattygtattygaggtygttatttgttttttyggtttygtttttgttatgagygttttggttggyggttttggtatttttttygggggtttggygggygatttttttttygggaggyggttatygatagtygttatttaygttttttagatttttaattttttttttggtttygtttttggttattagatygyggtygtyggttttygttttagttattttttttatagtygggaagggatygaagtttgaagggaggttggaggttagtygggtgygggtttagaggtgttgagtttaggttttyggttttttttggtgatagttttaygtgttggygttgaaggttttggtgttttgggaggaagygtagagtygggggyggttyg

SEQ ID NO: 6193 - DNA, 1860 bp, synthetic construct; identical to SEQ ID NO: 5965
  misc_feature 1..1860: note = Description of Artificial Sequence: Synthetic polynucleotide
  source 1..1860: mol_type = other DNA

SEQ ID NO: 6194 - DNA, 1422 bp, synthetic construct
  misc_feature 1..1422: note = Description of Artificial Sequence: Synthetic polynucleotide
  source 1..1422: mol_type = other DNA
tygtgtagttygttyggyggygttttygggygagggtttggtgttggggagygagygyggagygaggtgtttttttaaataygttttgtagtgtgayggyggtygttyggttggaagagttatttttattttgyggtaggagttygttygtygttatygttygtttyggtttttatggttaygygtttgttttyggtttygggttttygttgtygtygygggaggtgygygtagaggyggyggygttgttggtygggttgggtygttygtgygyggggttgtgatttatyggtyggygtygtagtttygtaatttgttgataattyggttttagttyggtygttgttttygygaatggagagygggttttyggyggggggagygtagygygtttgttttygggagygyggttyggtygtttyggtagtygtttyggttatagtaggtgggaaggaygygygggtttgggyggygggagggaygygyggggtygyggttyggtagaaaagttygygtttygaggtgatattggtygygaggaaagtagtttygagtaattttyggtttygttggggygggaggygttayggataatttagggttttygtttygygygttyggttyggagttygagttatatttaggtagagtaggygtygyggtygggttggggygggygggttattyggtgtyggttttyggtgtaaatttttyggygygtttttggttttgtgtagttygagatggttgagtttggtttyggagtygggagtggggygtagattgatttttaaatatggagaaggagaygtatttgtygttggygygttyggttygagttttttatyggtttttatyggtatygttttygttagttttaggygtagtttttaggtygttygyggaggggagggagygataggggtygyggttgttttttggyggggtyggggttgygagttgtttttygyggggatttttygttygtttygttgatygtygttgtttttatagatgggagtagttttyggattgygttygtttygtygyggttattttgaggttaggggttygggagygygattttttggtygtygtttgggattttgattttttagaggttatggaggttggyggggagtagggygttatttgatygtttttttttggaygttttttttagyggygtttaygttttygtaattttgtagygtttatggtgagtaygggggtttygggggttttgtagttgggggttaggtygttgygggggggyggttattygtatggggatttttaggttggaaaagttgtggaatggygagttggtgatygggttttygggtttagtgtyggggtgggaggttttgtggagtgggggtyggggataggtygygtgtttgggtatttttgtttttygyg

SEQ ID NO: 6195 - DNA, 1479 bp, synthetic construct
  misc_feature 1..1479: note = Description of Artificial Sequence: Synthetic polynucleotide
  source 1..1479: mol_type = other DNA
gyggttttttttaagttygaagtagggattyggttttgygtatttggygggtgtgtttagattgtaattttygtattaggtatttaagaaygtgttttggatatattyggyggtgggagygggtgtttggtttgtattagggatgaggggtggagtagygaaagygttyggagygygtatttatttatattttttaagttagggygyggtygttttgggygygaggttttaagttaagtttygygttyggttaggagtyggggagtattttaggttttyggtttggggtygtygttattttattttgyggygygtatttttgatttggtttygtttttyggyggtygygagtagygggyggagygtaagtagagaggygttttgggttgtgyggtatygttttttttyggtgtttggggagggayggagggatygggygggagagagagaaagtttgatygatyggttggygaagagttgtatgtaatyggtgggaggtygggtyggttgggtttggggttygggtttaggttygtatygtttttyggtaggtttttggyggtgagygyggayggttyggaggyggyggttttgagttggtaggyggagggttgttttttgygttygtttgttyggygyggttygaggatgygggggggygatgttyggggttagggaygygttttgttattaggygttgtagttgttggtygagttttgtgttygtggggttttggagtaygatagttgttaggattttatttattatttgygggatygtgttagatttyggtttygygatttaggtgagtgtygttatygtygtttggagggatttaagggttttgggttgggatttggggtygtatyggggtttgaggtagaatagygaygyggattgggagagggyggggggyggttatygagttaggagagtgattaagaattagygtattgtggtttgatgttgtaattaggyggggattygggyggtggttattgtayggaggtygatttygggtyggttagggtagggttggagggattaygttygttatttgygtttttatygttaaggtttttgggggyggttttttagtttygagttaygttttttatttttygggttatttgtatttagagygaggggaggtygyggyggtttyggagtygtgggaagggggaygaggtygaaggaaattttgggaagttgggagttggggayggtttygggttggggtygaattttatygggtgttgtttatttttttttttaagygtttagtttttttttttggtatggggtgagaagggygggaygygattyggygttgggtyggggatagggtgtttttggttttgggtagaygggtttgaattygttttyggygggtygtayggtatggaggtggtttgggtttgggygttaggttygattagygattatygtyggttaygatggggttygtagattygtyg

SEQ ID NO: 6196 - DNA, 446 bp, synthetic construct
  misc_feature 1..446: note = Description of Artificial Sequence: Synthetic polynucleotide
  source 1..446: mol_type = other DNA
tygttattygttgataataayggaatygtgggtattggttttttaaygtygtttygttygttttttttagttagtttggtggatatttyggtgaaggttgtagatttttagagttattttttttttaagtagygtttttygtatttttyggygtygggaagtttagagggagttggtttgtttttatttttaggtgtyggyggyggtttttgtygtttttygygggataggaaggttttgggtagtagtagygatagagttaggataagtttagaagttagagygattttttgtattgtggagtaygttatgattgtttayggtggtygtaggtgtagaygttagtyggaatyggaatyggaatyggagtaygggttgtygttttygatygaatygygggyggygyggayggygtygygygagggataaggtgygygaggygtayg

SEQ ID NO: 6197 - DNA, 2991 bp, synthetic construct
  misc_feature 1..2991: note = Description of Artificial Sequence: Synthetic polynucleotide
  source 1..2991: mol_type = other DNA
gygygygtagttagygtttttygyggatatagtagtygggtgttggagaggtttggaaagggygtgtyggagagttaagtgtagtygtttagggttgtyggtygttttttttttttttgttyggtaggggatttagygygtaygttagtgtggaggggygggttggttggttagtttgygggtttttgyggttatttyggggatttttttaagtttygtttygtagtgtttttattggtttyggatttttttttttttagttgttygtttgggtttyggggygtttaggttattayggataaatagtttagggygtttggygagaagttaggggtgaggaagttttggggygttgtygtygttttttttaattataaattaggtyggataggagagggaggggtgggggatagtgggtgggtatttagattgttagtattttgttatttatagtyggggttttygagyggtagaaagtttyggttattttttgtygtttgggttgggygaagttaggatygtgtygygttatygttaggatatggagttattgtygttatygtttygygaygtagatttgayggttttygayggttttttttgtttttttgttataayggaygatttttatgaygattygtgtttygatttttyggatttgygttttttygaagatttggattygygtttgatgtaygtgggygygtttttgaaattygaagagtattygtattttttygyggyggtgtattyggtttygggygtaygtgaggaygagtatgtgygygygtttagygggtattattaggygggtygttgtttattgtgggtttgtaaggygtgtaagygtaagattattaaygtygatygtygtaaggtygttattatgygygagyggygtygtttgagtaaagtaaatgaggtttttgagatatttaagygttgtaygtygagtaatttaaattagyggttgtttaaggtggagattttgygtaaygttattygttatatygagggtttgtaggttttgttgygygattaggaygtygygttttttggygtygtagtygttttttatgygtygggttygttgttttygggtygyggyggygagtattatagyggygatttygaygygtttagttygygttttaattgtttygayggtatggtaaggtygggattttaggaagtgaggaagttagggyggygttygggatattagggaygygttttygagggyggggagttggttttgygggaggtttgggttaggatttttttygagagagaggatttttttgttttgggtagttgttattggggtagtttgttttggaagtgtgygggtaagygttygagttgttttattgggggygttattagaatattgtagygygaaygtgaagatttttttttttatttatttttatttttaaaatgtaaatttgygttttttggtgattgttygtttttggtttggttttgtatgttgtagattttattttttatttattygtaattatttttttaattaggataggtttgggttyggaattagagttttaggttagagttagggagggggyggttataggaattggtgttygggtttygagtygtttygygggtttgatttagtygtttttgttgtttgtagatggattatagyggtttttygagyggygttyggyggyggaattgttaygaaggygtttattataaygaggygtttagyggtgggtatttygggtttttttttgttygtttttttttttttatggagttgttttggtttttatttaggaygtttttatttttatttatataygtttatgttttgggaagtggtgtaggagatgaaatattaagtaagtagttttttgttttttggattgtttyggattttaattaaagtttttagtttttaatttgttttaaagtattgggttygggggtgggaggtttgtygyggttttatttttgtttattaatygagtttttttygygtagaatttaggttygggaagagtgyggyggtgtygagtttagattgtttgtttagtatygtggagygtatttttatygagagttttgyggygttygtttttttgttggyggaygtgttttttgagtygttttygygtaggtaagaggttgtygtttttagygagggagagagtagyggygattttatttagttatyggaygtygtttygtagtgttttgygggtgygaattttaattygatatattaggtgttttgaggggatggtggtygtttattygttygagggatggtgtttttagggtttttygygtttaaaagattgaatttaaatgttttttttttaatagygttttaaaagygattttttttgaggtaggagaggygggagaattgaagttttygttttygttttatagggtaaggatatagygyggttttttttaygtagtatttttttyggagatttattgygatggtygtttygtgtttttyggtgggttagagttgaattttgaggggttaggtttagttttttygygtttttttttatgggggtgagattttygtagatttaagttttgtttygggatgtatyggttatttgggggggygtgagatttagtgtatttyggttttaaatgtagtaggtgtaatygtaatttatttttaattygtttttyggtttaggattattttttgtaatatttttgtaatttatttttgtaaataagagttgttttgttagagtaggagtttttggggttgtatttatttttgaggtatggtgtgtggtgttatagggaatttgtaygtttatatygtaggygggygagtygygggygttygtttaggtgattaaaataaaggygttaatttatatygtygtggtttyggttttttttggatatgggtgtgggattyggaggaaaattygtaaattgggttagttgttttttagygaygtttgtaggyggtaggyg

SEQ ID NO: 6198 - DNA, 928 bp, synthetic construct
  misc_feature 1..928: note = Description of Artificial Sequence: Synthetic polynucleotide
  source 1..928: mol_type = other DNA
gygggggygagggggygagggttggtygttygtgaaaggaaaaataaattttaaggaagtaagaaatyggaygaaaggattttattttaagtgatttttttgaaygygtttttttaaatttygygatagtttaaggagttgygyggygyggyggttgyggttaagatttgtgattaatgttatttgatttgagtttatggggttttgtgygttttgttatttattgttatgtygttatttttaagtttatttyggagaaattattygygttttttgttttaaggttgagttttttgtttattttttttttaagagaaaagaagaygggaggggaaaagagagaatyggagtttttggtttggggtttaaggtttttgtttaygttgygggggaggtygtagtagattyggttggggtttttygggtttaggtggttaaagttgtygaaatttgttttggatagtagaaagagygtgtyggaaygtattttgggggtttygtttttttygygtaggggagagygagtatgtttttgtttygggygtygtgyggtygtagtagtagygyggttttttttagtgygagtygtgtttggaatgtttygggtaagygaagggttagtaagygaggygaaayggatattataaagtagagagtggtgtgagttttttygttttttgaaaagatggtaagttttygtttygggaaggttgtaaygttaaggttattttttgtaggtttyggatttttagttttttatgttttttgtyggagtagttaatagagtgagagygtattttggaaagattggtyggatgtygggyggygatagggaaaagygttygaygtttggttttggggtggggggtgtggggagggggggtagggagttaaygggygaggygaaggaggagggttgygaggttyg

SEQ ID NO: 6199 - DNA, 1267 bp, synthetic construct
  misc_feature 1..1267: note = Description of Artificial Sequence: Synthetic polynucleotide
  source 1..1267: mol_type = other DNA
gygaatttygagtaattgtttttygagggggttygtgygygttyggtggygtygtttyggtttgggttttttygaggaaaaatatttattygygagggttyggyggtttttygattyggyggggatgaattgtggtaatttyggtagtttttatygyggtgyggaagtaaagagggtaatattggygattgyggttyggaggggttggagygygtgaagtygtgggggygtygtgygtttttygttttttygtttyggtygtaggttttgggatttygatttyggtgtttygggtgatagyggttgyggygtttgtagtttagattttygtagttttgygggygaaggaggygaayggaatyggtttttagtggggagygtaataagttatagtagttaaatttygygtttttgttygggtttttagaygaaygtagtygtagyggggggtygggtttygagttttaygtygtygtygtygygttagyggtggggggygggttgggggyggggyggtyggggttgttttttygggygtatatgygagygtagtattyggygttgtygagttatttttttygtygttygttagtaagtttggyggttttaagttaggygygttttaggatttaggtttatttgtttttatttagtttyggtgttttttgttaggyggggattttygagagygatgtygatggatttgattttagttgtgtggttttgtgtgtgtattgttaggataggtaagtatgattgtggyggttagagggattygggaaatgggggtgtttatagattayggyggygtggggagatttggagtygagttttgygttggtttggggaayggyggtagygtggatyggtttttgggatttttttgttttgttyggagtgatagggtgaaaatagggatttaygggtttgaagatgttttygttgagtgtttttttttaggggattyggttttaggggygtaggagtgaggggygyggtygagtaggygtatttttttgttgttagtaatyggtttttygttttagggagtygaaattygtagtagggygggttygygtgtttygagttttygaatttgtaaggtgttgtggaaattattttygtygattttygttaggttgggaaggggtagttgygggagtygtattygtagagggagygttttyggttggygggygyggtyggggttygggagggygyggtgyggygagggtagagagttgygggagaattttgggatttygyg

SEQ ID NO: 6200 - DNA, 1225 bp, synthetic construct
  misc_feature 1..1225: note = Description of Artificial Sequence: Synthetic polynucleotide
  source 1..1225: mol_type = other DNA
gyggaagtygtttyggattatgtatggaaggttaattgaaaagattagtyggggygtttgtggtagttttgttattttgtgatagtgtttygtttygggaaattgtatygttaygataaaygggatygtgataaaaygatttttttygtttttatttgtagattatttagaygagattgaattgtatttgtttttttttygaggggagtygygtttttagggtagtygaaggtttggggttgagggggggtttttattaaggygygggtgggggtyggagttttaattygatgagaagtgataggygtttgggggatttgggtttyggtygggattagygtaagtagggattttgyggggatatygtttttttaatagagtaaggtttggtttaygttttyggttttttttaatttttttttattgtttttttttgtttygtaagttttatttatttttttagttatagagttttatttttaggtataggaagtttttyggaaaaagaaaggttgttttagaaagagatygagagagattttttaaatttygggtatagttayggtaatttttagtttgttaatgttaaggygggygygtaaggtygtttaaatttagatttttttttttatttattttaaaaaataataaygtgttagttattttygtagatatygtyggttggtgtttgtttaggagaygttagggttagagygttatttttagtatygaaatggtagagagaaagygtagttttaaatttttttttagaggttaagttttaattattgtgttttttttttagggattgttggygttttygtttattggygatgattatgygtttagaattygatygygaagtaattaataggaaaatatatggtgttaatttggatgtttygygtttygygtatattygggaaygagyggtataaagttttgtyggtyggttygygatttygygtttttyggggtttgttagtygggtygtagygataaaygtttagggttgygygttttggttggggttygttygagagatagtttgyggttggggagtttgagttttaaggggagagtttagtygtygaaggygagtttatyggttaagttttggggttyggtaggttttgtataattattttygtaaagttygttatttttgtgttttttttttagttaygygtttattagtttyggaagtattagggggygatyggyg

SEQ ID NO: 6201 - DNA, 1627 bp, synthetic construct
  misc_feature 1..1627: note = Description of Artificial Sequence: Synthetic polynucleotide
  source 1..1627: mol_type = other DNA
gygtagtagagygtyggagaggagggaygyggaggttatygaggggttagtagggtygyggygttagggtgggggtttttaggyggygttggttayggtttattygygagggygagygygttyggtyggtygygttttttgtygttygtgttygggggtgggattygygtygggagttgtygagtgygtggagggagttaggtttyggttygtttgatggattgatttggagatggatygaattatattatttgtygtgtatyggtttgttttgtttttgttttgttttgttgttgttgttgttgttgtaaggggtggtggygagttttaggattttattaaggaagttaagatttaaggagatagagggatatttatttttataatatttttttttatttttttttttttttgygygtggtaagtttttttttttttttttttttttttttattagtttttttttaatgaggtaagatygtttttaataatttgttaatgtttttgtggygttyggtgggggtyggaatttgagatttygaatygttgtgtgtgtgtgtgtgtgtgtgtgtgtgygygyggtgggggtyggaatttgagatttygaatygttgtgtgtgtgtgtgtgtgtgtgtgtgtgtgtgtgtgtgtgtgtgtgttgttattggatagttgatttattttttaagttgttttttttgtttgtygtgtaagggaygygtaaagggttagagaggtttggyggaygygttaaaattggtaaagttggyggtttagggggaggggtaagtggatttggaggtttttttttattgtgtatttttttggaaaaaaagyggagggggtattaagtaaaagttttttgttaggtagagttagttyggygtttttygtatatagttggggttagtaggggttgtttttttgtygggtatagygtttttaggagttagtyggggagagttgagttaaggtygaaggagtygtttgygggtttagtygttttttttygttygttggttttagagyggaygttgggaygttyggggtttggtagttttgygttyggttaggagygggygggygagtattagtttgygttttggagaaggggygtagygtygtagttgaggtyggagtagtttttygygggygtaggatatttgttagtgagygttyggattgtayggttttygggtagtgtttgtyggygaggggygggagttygggtgatttggttatttttattttyggtttaggttyggagggyggtygttttttatygtttttttttttttattggtagagygygttgygggyggattttygggttyggagtagtttatyggttattttatygtttattyggttttyggtgttttttttyggtygttttatttagtaatttttygtgttttgtttttygattggaaatgttttayggaagygttttggatagggttttygttaggygataagagttyggtgttgagatgtgttaygtttttatttttttattaattatggatggaaataaataaggaagagttaattttgttgagtttttttttyggtaaygagaggygttttgtagtygggagggagtygtygttygygtyggtagtyg

SEQ ID NO: 6202 - DNA, 1857 bp, synthetic construct
  misc_feature 1..1857: note = Description of Artificial Sequence: Synthetic polynucleotide
  source 1..1857: mol_type = other DNA
tygygttgtttaggtaaagggattyggygattaagatattttygygagggtttagggygygtttttttygttaggttttagatttyggttttgygttatttttttttaygtttyggygygggygtagttagttyggttttttttaggtttttaagtttyggatygagtgtggggtygtttttttttttyggaaggagttatygtygttttaagtggaagaggagaggaagggggygggggagyggggggyggggagyggaggyggaggagggggagggggatttttttggtttttaygtggttygggygtttgtgaatygygtttatyggagggttttatagygaaatataaaagtagttgggaagyggyggggattygagtttttagygtygggyggagygtyggatagagtttygtagygtttygyggtygygatggggtygaagygttygaagtttyggagtttataaattgtygggttygtttygtygtygggattygggtgtttgggttyggtttgaagyggyggyggygtatyggtatagtygygggagtatgggtaggaggatgyggggygtygtygttatygyggggttttggttgttggygttgggttygttgttggygttgtggggagggtttttgtygtygyggatygagttgttygtttttyggtygttygaagatygatttttayggygttyggttyggagyggyggtttygygttygygtttygtttttttttgttttygtttttggygtgggaygttygyggyggttttttgaaaatttttygggygttgtttattttggyggtyggygyggayggttygtttyggtagtttyggagygagtttaggtggtaygtgttagttaggtagtttyggtyggaggagagygtygyggtgtaygggggygttttttggagtygyggtttggaggagtaggtgttttygggtttttyggaggtttaggyggyggygtggttggaggyggttygyggygttyggatggtggttttggagygygggggttgygggygtagttttaatygattggttygttttgtygayggtattygygtttgygtgygttayggtattaattyggagtagatttagggygaggttttgttttattatttggygygtttgttgggtttttagygttaygtgtygtygttggtattggttygggtggaggttyggggygygtagtgggygtaggtgtaggaggagttgygygttgygtattggatygagggtagygtggtgagtttgataygttggttgtttaattttayggaygtggtggtgttygygttttggygttyggaggayggtygtttgygtttttttygggatgtygggggtgagttggttaattttagttaggyggagttggtggatttagtataatggatygatttaatttttttygattatttgayggttaatttygatyggttygtaagtaatttttttagtttgtagtgggattygygygttatgtagygtgttattagtaatttgtatygyggttygggyggggygttggtttttttggataatgaggygggtttggtgtayggttatygggtagtaggtatgtgggataagtataaygagtygttgttgtagttagtgtgygtgtttygygagyggatygygyggygygttttggagttgtatygyggataggaygtygyggttyggttgttgygtttttatyggygttaygagtttygttttttygagttggtygtttttgtagatttttaygtttagttgttatagygtygtttygattttttygttaagtatattttgtattgtaaggttaagtayggtygtyg

SEQ ID NO: 6203 - DNA, 2423 bp, synthetic construct
  misc_feature 1..2423: note = Description of Artificial Sequence: Synthetic polynucleotide
  source 1..2423: mol_type = other DNA
gygygygygygtttgyggaggggggtggtaaggatttagaaggggagtttattttttttttygagtttagttttggggagtygggygtttaggttygttaggttgtaaagagagttgagagttgtttygygtttygygtagaatyggyggtggaataattagygttttaagtgtgtgtatttgggattagggggygggggagggggatttgyggtttygyggttaattyggttggtgtagatttggggattttagaagggatagtgttygtttagtygyggygattgagggtttttgttygggygtagttygggttagtygygtgtttyggggtygyggtttttttyggaattttygygggyggggtttgtttttyggagtyggttggyggggggygggyggygtyggggaaggggtygttatttttttagagyggyggggygaygttaggyggaagggygyggggygygtaygttttaaatggtattygttgttattygagtttagagtygtgtgggtagtygygggttatataagtygygagtttggtygtygyggggtagayggygatagtagyggyggygagygtttyggagygyggyggaatagygtttttygagtttygtgtttttygaygggttygttygttygttygttttttygaggagygtyggttygggttygygagggtygtygttatttygtagtagatttggatttttygttyggygagttttyggttgttgtttttyggggggtttyggygtagyggtygttttyggagagtttyggygtttygtygttyggtttygtagaygtyggaggygttatggtygttaagttyggygagttgatgggtatttgttttagttattaggyggtgatgtygtatttygtgtgtttggtygaygagttttygtagttygtgyggttygttaagttgtttaagggtyggggtyggttgyggyggtygygttagtttygttttaagaygtagtyggtgattttygaygagatttaggaggtggaggaggagggggtgttttttatggaggaggagaaggttaagaagtygtttttgtagagtttggagtgtttgygtygtagtaygtagagtttgtygttgtagygggagtagtttagtagttgtaaattgaggaatagtttggattttagygatttygattyggttttgtaaggggygtygttygygggggggaygygygygttygyggttygygyggggatyggygtgtgaatttygagagtgttygygttttgttttygggggattygtaaggattygggatygtygtttttygygygttyggattttygtttygttgygaatyggtyggtgygtttttygtygygttygttttggttygggagygtygggagyggggtygtttttttygtttttgtaaatgtttattttttaattttttttagtgygaattttgttgtgagtgtgtgyggggaggygygttygygttgagtyggyggygggtagttattttatgtttttgttygatggtttgtaatttygattttgtatatygttttatygtgttttttagygtatatttatttatatttaygttaatattttygttgaatatttttataattgttaggygtggtygttgggattttgggygtagygyggttgttattgygtttggaggattgatatttatttttgtattgygatggttgaaggtatttatttaaygatttttttatttggatatgtttgtgaggtttttgaaaggagataaataaagttaatatatttgtatagtgtagttttttaggtttttgattttttgtattttyggggtttaggtttttaagattyggggaggtgggggaggaggtggtagggggatgtyggattagggagtygggagtggagttatttttataagtttyggttatyggaaygaggttgygttatyggtgygygggtyggttgtttgtttttttaagtggatttattttyggtttagtgtgtttttgygtttttggtttattttttatygtyggtattygggttgaagtgaagtygtaggaggggyggaggtagagttgaygatggagagttttttttttygtatagtttattttttagagttggggttagggttttygtttygtattygttatagaagaygtatttttttttgygttgatttttggyggygggtggggagatgtyggagttagtaatgygagatgtttgggygttgggattygagagtgggttggaggttagtttgggttggtygagagtgtgggtgygygttygttgtygygggtaggtgattttttgatygtagttgatttagygtagtgtttggygtttttgygttgyggggaaaatygyggtygttatgtttttagtygttttttgygtttyg

SEQ ID NO: 6204 - DNA, 1146 bp, synthetic construct
  misc_feature 1..1146: note = Description of Artificial Sequence: Synthetic polynucleotide
  source 1..1146: mol_type = other DNA
tygtygtaggatttaygttgattaygtttaagtyggtttygtttattygtttygtttatygttaattttaygygttttygttyggataygygttttygtagttttggagygttygtatttatttataagttttygtgtttagttttygtgttttaggagtttatatatatttygatttttaygaagygttttaggtttttattttygygtttaggtatygggyggtygtttttyggggtttattttygttgtagaatttgtygtygaagttygtgtggttgtagtygtagtttatttygtygggggttagtayggtgtagaggtygtygttggygtaggggttgygygygggygygtatagygggtyggyggtggygtygygtaggttttggttgtttagtagygyggggggtygttygtttagttttaggttggttaagaggtygyggaagggyggttygtatttgayggtgtttagygtaagygtygagaggygtaygtygggygggatgtygtttaygaataggtygttggttatttgtatttygygtygtttggagygtatttyggyggygygggtttygtygtttatygttagygtygtgyggygygygtygygggttagtagtattatgtgttagyggtygtyggttatyggygtgtttagttgtagygtggtyggttyggygtaygaaagygtgaagygtagtygtaggyggtygtttattagtagtagttttaggaagtygtagtygtygtygtygtttaggtagagtagtagygygygygtggygttggtgygtaggttgaagttgagttygtygttgttygtygygttygtttagygygygtagygagtttattgttyggggtygtygtygaattttaggtygttygygygygtygttagygttagtagtagtagtaatagtagyggyggtggtgtyggtygttatyggttttyggaygttatgtttayggyggtttyggtttygttyggttttyggttttygtttaggttttagagtygygggygtatggggygggagggggtygggygtttttygygttgagyggggtttttttgtaggtttatagtgttatgggttyggtygyggggygaggygygtagaggtttagatgtyg

SEQ ID NO: 6205 - DNA, 577 bp, synthetic construct
  misc_feature 1..577: note = Description of Artificial Sequence: Synthetic polynucleotide
  source 1..577: mol_type = other DNA
gygggtatagtyggtttttgayggygtttaaggtttygttygtgyggygttgtttattttttattattagagatyggttygtttagygggtaggttttattttaatgttaggttaaagtttttattttttggattygggtttggygttttygttttyggygygtttttattyggyggaygyggtygygtataaggtttagtayggttygygttttygtagttyggtygyggttgaatatttttagygygaagygggtgggygttagtagtttyggggayggyggtttttaggtttgaaagttggyggttyggggttgggygggggyggttattgygttygggagtagttttagtagygataggagttgtagttagggygttatggygagggygaagtyggyggttyggatttaatagaygttttatygatttatygggtatygagttygyggttagyggggtttgagttttttttttagyggggygayggtaygtygattaatgggygttggtttgyggygtttgygygtttttttgtttataggaggtaygtggggygygtagggtagggagagyg

SEQ ID NO: 6206 - DNA, 1721 bp, synthetic construct
  misc_feature 1..1721: note = Description of Artificial Sequence: Synthetic polynucleotide
  source 1..1721: mol_type = other DNA
aygaagaatyggttggttaygtygaagatgtttattaygtttygttttaygggygagagttttagtaggtttgggggyggggygtaggttattgyggggtaggtgatttttggtttatttygtttttyggtttgttygttttyggggattttatttttggggtggggttggggataaagggttagggttttyggygtagtygtttttaagggtttttagagtttaagttgttttttagggttttyggagtttaagtttgygttagtttagattagtttgtttgtgtaggggattttyggyggtygtatttagtttyggatttttagaygygagttygattttagyggttttttagtttgggttaggtyggggygygtgtttygggttttttgtggttgtatygygygttttgtgtttaygggygaaggygttggaattyggygttyggagttygagtttttgaaggygggaggyggygttygattttaggggttgygttgggttgtyggagttaagagtgtttgygtttttagtttygygttagaagggatyggagttygagttygtttyggttttyggggttttygagtaggtgttygtygagggttttagagtgtgattgagygggttggttyggyggtygttgtttttygttttygttttttygygtttggtygygttatttattgtygygggtgttygygtgygygtygtygatgyggtygtyggggagygtttggaggtggaagtygatgtttaygttgtagtagagtygtygtagtygtttgatgtttagtaggtagtygtyggygtygttttggayggtygtttttttgggttgygttgttatyggtaggygygttaaygagagygttattaggtttttttagyggygttttagttyggtttttagygtgtygttgggtgtagtgggtgyggyggygttttttyggttygtttagggygttagtaaggttagtaggatygtygggagtagygttatygyggtygtttygggtttygatatttyggttygagggtygtgygtyggttaggyggttagtgygttygggaagttggggggtagagttgygtttgtggygtttygygggagygtayggtygatttygggtaggagtgygtaatygaggaggtgygggaggtaagygayggggttttygggygtygggttttatttyggttgtatggagyggygagtygggyggaaagygygyggttggagttgggattttgaggagtagtgygygtttttttgagygttaggttygttygaggtygagtygttatatatatagttyggygtttttttttattygttygttttygyggggggtygttygygtttttttgggygttyggggygttgtggygttygyggttggtygtaggtygtttgttaattagggtygggggaagggaggaggttggggattagygtygygagtgttatttggagggatttyggtttttatttttggtttygttyggtttayggatttgttygtttygttttttggyggtttttatatttttgttttttagttagttttgttttttgtattttgtttttgtttgttttygttttygtttttttttttgtttyggtygttttggygtagttttaattygggtattygaagtttttagtgggygtagaagttagyggttgttgtttgtttttygtttttyggaggtttayg

SEQ ID NO: 6207 - DNA, 1721 bp, synthetic construct; identical to SEQ ID NO: 6206
  misc_feature 1..1721: note = Description of Artificial Sequence: Synthetic polynucleotide
  source 1..1721: mol_type = other DNA

SEQ ID NO: 6208 - DNA, 615 bp, synthetic construct
  misc_feature 1..615: note = Description of Artificial Sequence: Synthetic polynucleotide
  source 1..615: mol_type = other DNA
tyggygtttgtygagygygtagygtygggygaggygygygggattagygggtgttgygggygygygggttagaggyggtyggygttttttgttyggtgggttyggggtygggtygygggggtttggggttyggyggggyggyggttttagtagyggyggyggygyggyggtygyggagggaggttgagygygggtyggttgtgttygttaagggttttaggygtygygttygggygtatttgtattttgtygygggaagtaggtagttyggtttggygttggtttagygttggygttttttttggggtatygygggttyggtggattggttattygagaaataggtttatttttttttttttttttttgtgygggttttygggayggaygttttaggygyggygtygagtggaggygagggggttgyggagggggaaggggttaygygggttayggggtttaatttttgatttttygygaygttaagaatgtaggagggtagagttgagggagattttaggtggaatttttaggtggggaaggttgagttgtyggggttgygggtatygggaaggtttagggtaaggygttyggyggtgygtgttyggaatttyg

SEQ ID NO: 6209 - DNA, 1542 bp, synthetic construct
  misc_feature 1..1542: note = Description of Artificial Sequence: Synthetic polynucleotide
  source 1..1542: mol_type = other DNA
ayggaggygyggygttttttatagtygtttttaatgaagggaagygtgtttygaagttagtttyggtgygtttttttttttttyggygtttttttttaaatttygtyggatttttaaaggttggaataggyggtgyggttgtagttygygttgtaatygtaggatatttgatggggyggyggyggygggggtagggygtagtttggaaagaagggggygaaagaggttaaatggtttygttygtttttttygtygggagaattygtagyggyggggtatagggggtttaagggttygtttaaggttaagtygtygyggggggtagttagggggttttttttggtyggggagtagttygggaygttttagggttyggggtatagtaggttttttattattgtyggyggyggtttaaagaggtygggttttagtttygggggttttygtagtayggaggtttyggyggggaataygtygagaggttyggyggtaagtaagattgtygttttygtgtyggygtygtagtygggttttagtagtttaaagaattttayggttttygygtttttttttaggtygtttaagtttaygttyggtttygaygggttatattygtygtygtttgttygggayggtttygtgaagaaggayggaggtagattgygtgttygtagygggatttttttggtttttgggatygtygtggttttygyggggtttgttaygttttttttygygtttttagtgttygtattttttagttyggtygtyggygtagttattttatttttygtyggttyggtattttyggggaygtggygtagygagtygaagagygyggttagatttyggttttgtaagttggyggtygyggyggtttgygaygtttttygtyggggggtagttttgtygtgggtyggggtygygattgtyggggygttaggggyggttagyggtygtttggttggygtgtyggyggygttyggggagggygggtyggggggygyggygtttatgaggtygttgtagygtttgatttgtttttgtaggtatttgyggtggtttatttttygtttygatttgttyggtttgtttagygttagtttgatgttgttggaygtygagttaatgaagttgagtagatygygggtggtttygygtaygttttttttttyggttttygatagtagygtattygtyggagtttyggttttatygttttygaaatagtagtttttgtttagggtttygaaggygttttttagttygttyggggagttttygaagtygaagggtaygaaagggtgygtgttgaggagygtygtttgtatygttatygtygyggttttygggttgttygtagygttgttygtgygttttygttagtttttgttygtygtttagatttagttttygtttyggygyggygygygyggygtagtttattagtttygggtttggttygttgygttgtttttygggggagtttattaggttttgtaagtaaggggyggagggagggagygygyggygatygtttyg

SEQ ID NO: 6210 - DNA, 1542 bp, synthetic construct; identical to SEQ ID NO: 6209
  misc_feature 1..1542: note = Description of Artificial Sequence: Synthetic polynucleotide
  source 1..1542: mol_type = other DNA

SEQ ID NO: 6211 - DNA, 1768 bp, synthetic construct
  misc_feature 1..1768: note = Description of Artificial Sequence: Synthetic polynucleotide
  source 1..1768: mol_type = other DNA
gygygtygtgttttttatygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgygtygtttgygygtggygtagttaatttgggtaagggaagatygtttggtttatagttggttggaaagtttaggttttyggyggtagtagtttyggtygatttttyggtttttygggtttygttagaagagygyggygtaaagtatttatatttttagyggttttaagtttygggygagttttttgggtttattttttttagyggtaygaattgygygygatgygygttttgaaygttttattttttagtttgtttttttygttaggttggaagttagtygygtygttttygtygatttygggygatgttatygtttttygaatatttgaygyggagttyggtattaagagtttygggttaggaagttgttaggtaggggagggttagygttagttgtggaygtttygggatagttttttattttagtttttgtttttgttttyggygyggygtaaaygtaaaagttttygtggtygtagttttagtttyggtggtygttygattttygtygggatttyggttgtatttattggagaagyggyggtttygattttygaggaggyggyggyggttgtttttagtygtggtygttatagttattgttyggtttygttygtagttgttttagttgtggtttttgttygtttgtggtatttatagtttttgtygyggttttygtagtttttttttttttttatttttttaagtatygttygygtagyggtttttygygagagaaatattttttttaaaaaaagaaagaaaaagaaaatgatattttttttttygtygtttttattattattttatttttyggttttatttattttttttttttatttttttttgttagttttygtttyggtgyggggtttttygttygtaggattagygtagtgggaggaggtagaggtgattaggttttgttyggtttgggattttttgttttgaggtggggaggggagaaatgggaagaggtggagtagyggttttagttygttttgyggttgygaggtttagattygagattaatttttttygygataggtgaagttttatyggagtagaaagttgttttatttgtattaagaatgygygttggagayggttgtttyggaggttttggttygagagaaaattagttttygttgttygygtttttyggtagygygttttttgygtttttttygtyggatatttagtagaygtyggaggtygggaggttaagattgggygygtygtaggtygggatygyggtagaggttgttgtgtygatygaggagagggttttgtygtttttatttgttttgggtgtygagagtttattttagaygyg

SEQ ID NO: 6212 - DNA, 2656 bp, synthetic construct
  misc_feature 1..2656: note = Description of Artificial Sequence: Synthetic polynucleotide
  source 1..2656: mol_type = other DNA
aygtttttttygyggtaggaaagtaygttggtgttattttagagttttagagggttgagggaagattygagttttaaaattagtygtttttaggttyggygtygggaatgttttttagttygtygygtttttttygtygttttttttygygygtttttttttttttgygttaygtttttagatygttagttattttygtygtygaggtttttttttttttygtttttttygttygyggtttgggaggaggagattgygagagataagygygagggggagattggagaggggtttggtygtgygtyggygtyggttgtgatggggagttyggagtagttaggyggygagtagtagyggyggyggttgtagttyggagtagataggagagtyggygttttttttygtaggttgygttgtgaattggtttgyggattgggatttygygtttttygttttttttttttygttgttgttttttttatttyggtttttttttttygtttgygaattttyggyggyggyggyggyggygtttygagygtagagygtttttgttygyggttttagtttyggttagygygyggtgggygttgyggyggtagtagtygggggatyggttygttyggagtaagagygtygagtatygggtgaagaagattaygggggaggygtttygtagagtygtggatygttagyggaggtaagggtgygtggggatttgtagygtgatgatttggttgtttggtgtatygattggagygygtttgtyggagtatagttttagttgttgggtgtaaatgggttgygaggtgggttggggaggygagagtygaygaagygygtgggggaaattttttattttgtaaagttttaattttygygtagtttygagtygtygttgttatygttgtaaataggagaagagggtggtttggtttygyggygggagtygggaggtttatayggagagttggttaagtttggggttgaggatttggggaggggttgygaggggggttgyggattagtgtatttattttyggtttttagtygtttttgtaggtggatgagaaggtttaggtggygagtttgtttggtagtyggtgtttttygggygtagtgggggatgtttagatgtygatggatgatgtatttaggggatttygaggtgtaagttgggttatygttaggygaggygyggygtagagagggagtttagtttttattttygttaggaaagggaaagggttattagtttgygggttygttttttaygtttgattygggtttgyggggtttgtggttagggtgagatgtagtgaayggyggyggyggtttttygattggggaygatattttttayggagtggttggggatagagattgtttttgttattttgataaggagagggaatyggaatgttttgygagagtgtatgatttttggygggygtgtgggaaggttgtttgtttttgaaaagaaagtagygygggtttgattatttttaggagtgyggaggagttgttttyggattgggggygagaaygttaggggtattagtttygagtttaggttttattttygggyggttygggaygaattttttttataggttagtgtgtgtgtagggtaagtgtagggggttgaggggygttggyggggaggtagtagaggtggtttggattattttggygyggygygyggtgagygygaggatttygttagtgggagtygttgagttaaagtgtatttggtttttyggtttgtatgatggygagttyggatatttttagttgtgttgtgatttgaattttttttttttttttttygttgatttttgttatatgtgtttttygagatggtttaatattgaatatgattgggttttgyggaaagtaatttttatttattttttatygttttttttttgtgggyggggggtggygggggygtgtttggggtaaggatgtaggggtggtyggagtttggttgygagttaagagagtygtttgggttgttygggatgagaggaataggggtgttttyggggtgtgggtgtgttggyggtgatattttgaggttgtagttygttggaataatgggtttaaattaggyggtggagaggggttttyggaatggaygtygggggyggggaggttgyggagattttgygaggttttygtgaaggattaggaggggttttygggagggagtggygtttgyggttyggagygtgggyggtyggtggttttggtaygyggaatttggtggatttttagygtttyggtygggagttttagttttatttygtygtygtygygygtttaatgggatttagtttygggtttgggygaatttgtagtagtygyggygggagggagggaygttgggatygyggtaatgattgaagttttttttttttttttttttttttttygttttttttygtttttagattttggygygtttgttttttaagttggattttatttttatttataagtgttagataaattygygagaattttttttaattygtttyggttttagttagattagggagggygtttagggggagggggygagttgtttgggtagtgtttggggaggtgygaygygtttattyggggtttgagyggttggggtttttgtgyg

SEQ ID NO: 6213 - DNA, 623 bp, synthetic construct
  misc_feature 1..623: note = Description of Artificial Sequence: Synthetic polynucleotide
  source 1..623: mol_type = other DNA
gygtygtagygttttttgtttataaagttttgttagtyggagaaggtgtagttgttttaagagaagaagtgygaggtattgggtayggttagggtygttttygygttttgttygtyggttyggttttygtggggttyggtggttygtattaaggggaggagatagagtagtaagaggtgagggattattttgtaggagttattttttttttgggagtttgygggtygggygttttttttygttgggatyggagygygtagtyggggtgyggggygtatagtatataaggtygtttygaggagttagggagttyggaygygyggagtatygygtygttygttattagttygyggtyggtaygttagtttygggtttgttggagtatttttatatttttgtttttattaggttgttagggagygtttttgtttattgggtagygyggygtttttygyggygayggtgaygygttttggttttgataagtttggttttttttattttatygggtggygtygttgttgattttaygtttagtygtttttattttygtttgaaattttttygatagggtttygtttygggggtttagtttttagygygtatatattygygtggtgtyg

SEQ ID NO: 6214 - DNA, 1967 bp, synthetic construct
  misc_feature 1..1967: note = Description of Artificial Sequence: Synthetic polynucleotide
  source 1..1967: mol_type = other DNA
gygygtygtttttgttgtttagtygaatttygttttttttagggttgygttgtayggggttgttttttygagtygttagygttyggygttttttyggygygttygttttttttattttgtgygttygyggyggtgggagtagagtyggtyggtttttggggatttagyggtygygttggtgatgggtagygttttttttttaaaggygggyggyggggygggggaggtygyggttygggtggtgtygtygtaygggttyggatttygagggggaagtggtttgttagtttyggtttygggaagagtgaataataaggttagggtagtygttttagatygttatatttttgggtttaataaagttaggatygttgttttgtttttttygttttagaagaataayggtttgtaaaatggggtaaaatgggtagaatygtayggtygttgttgttggtgtgatygttgttgtattttagtygatatgaygttagttttttatttgttaaattgttggttagttgtaaagtttattttyggtygygagtattgaaggatgggagggtygagygtygygttttgataggaggaagtgyggaggggyggagggygaggagggygtgattggggttgtttggtgtgtgygygygygtgtgygygygtgtgtttttataygygtygygtgtttagtgttgtayggggygggagaagaatggtaggtagtygttygaaatatttygttttgttttttttttttgggygaggttttygattttggtaaagtgtgaataatagggagttgggaggaagatagtagtgatgttgtygygggtggygggggttgygtygtygtttagagaatttyggtagtgtgtagggaggtgtattttattttggttatttttatttyggtttttttggaaaatttttttgtgygtgtttatttttttttttagttgttatttttttatttttatttaaggatttgygttttggttttgatggaygggagggaaggaagaaaagtaggggtygtagagagttgggtgggttgggyggatattttgggyggggggygtgtgttgggaagygatygaggaaagtygggyggaggggttgtgtgtygyggtygtagttttaggtatygttgtatttgttttggayggtygattttyggttggggagygtayggggygggttagggagtatttagtgygtttttttygygggyggtataagagtagygttyggtygtygtttttagttaattygggttttttttayggygattaattagtgygaagttggttgggygggaagtygygagaggtttttattgyggygygggtggyggttaggagttgttaggatagtttttyggtgttttagtttaayggtttygtttatttatygttaagagaaatttygttttgyggtyggtttttygtttgttyggtagttttygaggaaataaaatggagattaggtggttatygggagtgtttttggttyggtygttygtgttygtttattttygttttttttaygtygatttggagtattttatygttttygttagygtttattttygygtygyggaattygggtttgagygygtygtyggggagggtattttggtaggtatatttaygygygtgygttgatyggtygatygygggtygggggttttattgayggyggggyggggtygtggtagggttyggagaggaggggtggggattaagtttagttygtttggttttgggttttygttgttatttgggygggggttatttyggttatgttttttttygyggtgttygtgggtgtygygaygygatttgtttatatggggygggggaaggggggtgtttttgagatattttygttttygggtgggagygtgataatggagttyggatatttggtgggttttttgggggatygtttggyggttttttttattatyg

SEQ ID NO: 6215 - DNA, 2558 bp, synthetic construct
  misc_feature 1..2558: note = Description of Artificial Sequence: Synthetic polynucleotide
  source 1..2558: mol_type = other DNA
tygygatagttaaaaaygggtgtttygtttygataatagattttygyggattttttggtatttggtttattagygttygygaattttgtttygggagatttattgaaattyggatgtttaagtygggaggygygtagtaattaggaggatgagagggtygggtttgggttaggaaagyggttttttaaaatagatgttagggggattgtagtttygagttatgagaaaaaagttaaaggygagatgataygtattgaattggggtaaatattggaagaggagataaaattgygtgtttgagtatyggggtgyggggagggggggataaaattygtatttagtgtaaattaaaattttgggagtaggtgggggttgttgygygttttttatttttagtttttttattaaggattttgagtttttatgtatttttgttttttggttttttttttttttttygttyggtyggtgagaggyggtygtyggygttttagtagtagttagatgttaggygaagttyggagygyggagygtggggaagggaggggaagggaggggaggggaaaggaggggtggggyggggagygygygygggttyggttagtgyggggtggtgggygggttgagttyggggayggygygggaggggggagggaaggggggtagttgtgggtagggagtygggttyggtygttagtattaaagatggagaggygtyggggttttgtaggggagggggttyggygttgaygtgggaygyggyggaggygtagtagtyggtggtgatttgttaatttygtagtagagaggagttgagggygatgagagygggtattgygaattgtygggygatgttgtygttgtygtygtgatayggagagtaatagttttttagtaatattttttttygatataggtatatatttttygataggtaygtatatttattttatagtgttyggttyggttgyggtgagtgaggggtygggaagaggygtatygtttagygagygtygygygtyggggtttttyggggttggagaggtttggggggygygygttygtttyggttattyggtygttgggtttgtgttttttttatttggygtgttttttttttgtygttgtagtygtygtygttatyggttgggggtyggttagaagggggagtttyggttgttagtttgggygtagttgtttttttagttttttttttttagggtayggtyggggtgagaggtggggggygtagyggtgtgygggggttgagggygtgagtagaggggtyggggattyggaggttttgtatygttaggggttggyggagtaatagagttygtgggtgtttttatgtatgyggatyggtgygygggygtaagataaggttgtggtttatttatttgtgtgtttattygtyggtyggttgggaagttagaatyggaggagttgaygagtagatttgggggyggaggggagtaggattgggattgtttaygttttgtttttttttgagaaaaygtggtgggtttttttttgattggatttgatttttattttttttttgtaggggagggagggaagttttagagggtttgtagygttgygggtttttttyggttttyggygggatyggyggtgatatyggagttygtygtgygttttyggtygttttyggtgggtgtyggtttttgtatttgatgygttygggatgttttttttattttggygygttygtygttagttygtatagygtttygtatattttygtaygygtttgaaatgygtayggtttygtyggttygyggaattattyggaygtayggagygtttygtatygattygttygtygttttttygagaygttygtatygtgtttgggtygggygygttggtygttggygtygttggttagaggtttgggatttagtyggtygtttttagggggttayggttttgggtyggagagggagggygggtagattttttttygtttttttttttataattygttgyggggtttttgtgtttttttttygtygyggggygggttygttttttttgtygttttygtygyggagtttagttygttyggattgtygtygttttttttygtttttttygttttttttygtttttagtttagtttttttttttttaggagtttagtttttygggaaaagttgtttttttaagtttgttgaagtygtttttaagtttyggtgggggtygttgggaattgggggggtgtgagagygyggtygattttyggagttygggygggttatygtyggttttttttygygtygtttggttggaygttgtagttagygttagtyggatygygggygtygagyggygggtgggggagayggttgttygtgggygtttagattttttttaggatttaaaaggtttgttttagggygttaagtttttatttttttggttgtttttttttagtttttagaaatttygatgtttgygggaaagtaygyggtggttyggttyggttgaatgtttattttaattttgayggttttygtttttatttyggggyg

SEQ ID NO: 6216 - DNA, 2558 bp, synthetic construct; identical to SEQ ID NO: 6215
  misc_feature 1..2558: note = Description of Artificial Sequence: Synthetic polynucleotide
  source 1..2558: mol_type = other DNA

SEQ ID NO: 6217 - DNA, 1508 bp, synthetic construct
  misc_feature 1..1508: note = Description of Artificial Sequence: Synthetic polynucleotide
  source 1..1508: mol_type = other DNA
tygtttyggggygagaaggagaaaagttagagggttgaataggtgaygttgagtttgttggagygtgtgtgttttattaygtaagggygyggagttyggtygttttatttttygttatttgygygttygggggtaygttttttgygatagtttggaatttagattatttgygtttgtttggtttygatttagtgtttaggtggttttagtyggaaatgtttgtttttttttaatttttygatttyggttgtttygyggattaggtaygtagygttttagtygtaggtttggatatgtyggatatttggatttatttttagtaatttttttttttygggaagagggataygttttttagtttgaagatttgtttttaggtttaattggttaggygyggaagyggagaatttygtattttggggygygttgttygaggtggttayggtggygtattaagtyggggttaaagtyggggtagaggggtggggtagggtygggggagggtgatttttgggtttggagaataaatttgttattygagggatttttagttttygggatttttattatttttattttgtttttagttaatgygyggataagygttatgyggtgygttaatattygygttagggttggggttygyggygggagagggaygtayggatatagyggaggaattagtygtygagttygaggtttgaataagtaaggatttttaggttaagagttayggtttgaggatttttygattyggagggtatttyggggttttagtgttattaagtygtaggaagagggtaaggggttgggggaggggtttagggtagaattgtygtygtgtagggagtagggagatgaggggtttttttgttattatttttaygggygygttttaaaayggtagaygygggtggttggyggagyggtygggggttgatttttattyggtttttgttagggtgtttgttttttttygttgygttttattyggggttttgtatttyggtyggtttttttaygtatttggagttygtygggtatttygtttygtygttagtygygttattttggtttygtygttttygtygtttagtygttygygtaggttttatttttgtgtaaagagtttaggagtaggaggaaagttattagttatatgttataaagaggttttatttttyggggaggtggttttgtggtyggtygtgyggtagygtttttttttygtttagygygtttttagtygttygtattyggygtttygttttttttgttttttagtttagygttyggttgyggyggyggttttttttttttyggtttttyggtttttgttattygyggggttgggttaggyggtygtttttttygttttttygyggtatttygggtggtgagygtygygygagttyggagtttagayggattttagttttataagtttaggaataggagyggyggttygggttagatygtttygattyggtttygttgtttgagaggyg

SEQ ID NO: 6218 - DNA, 1119 bp, synthetic construct
  misc_feature 1..1119: note = Description of Artificial Sequence: Synthetic polynucleotide
  source 1..1119: mol_type = other DNA
tygggygygtaggyggyggttagygttggagttttagttagttttttttttttaygtgygygttaggttttggttattttggtaattygtttygtttagayggtattaggtagttgaatttagttttttgttaygggggaaaatgtttttattgaagygtyggagygtagtttttgttttttattgtaagyggygttatyggattttatttgtaaatttattagtgtgygttygyggggagggggttygggaattygggttygggtaatyggygtygtatgttaattagggggygttygttttygttttgttygtggtttttttttttygatttttygaygtttygggaggagtggggtyggagygtagggttgggaagggttttaggatttaggaaggagaygggtgttttttagagaggattttatttttttygaggttygggyggttttyggtttttttttggggtgtygtagtttttttygattygttttttygtagtygtagtygttygggtttggaggtggtygggtatyggtgtygaygtygygagggtagygttygyggygggaatattaatgtattttaaagggtayggtygtygtygtagtaggtaattagttggatygyggyggagygygyggaggtggttgttggttgtaaggattgygtttagttttygtttygtttttygaggttttygygtgggtyggygggtagtgygtgggttataggaagygggttgattggattyggtttaggatttygtataagggtagttttttgtttatagttttttttttagtttttygtttttttttygtttatygtttttttttttyggygatyggtttygtyggttgygggggggtggggggggtggggtgttttgtgtagtygtttattttttgtttyggtttygtgttttygttggggattgtttgyggtgagtttgtygtaygtaygttagggtygaggtagtgatgyggggtagygtgggaggaygggttgyggagttygygttattttgtttgtggggagygttgtgtttgtttttttgttagygygtttagttgtttyggtygtygttaygygggattgtttgttatgtygttatyg

SEQ ID NO: 6219 - DNA, 1119 bp, synthetic construct; identical to SEQ ID NO: 6218
  misc_feature 1..1119: note = Description of Artificial Sequence: Synthetic polynucleotide
  source 1..1119: mol_type = other DNA

SEQ ID NO: 6220 - DNA, 653 bp, synthetic construct
  misc_feature 1..653: note = Description of Artificial Sequence: Synthetic polynucleotide
  source 1..653: mol_type = other DNA
gyggagaagttaggagygatgaggggyggggyggttttyggygtttttttttttagtttygttttygygttgtygtyggagagggattyggggygtagtygtttygtttttgtyggggttttaggaggaatttaagaaaagagagatggagggaggaaatggtatygttttaggaaggggtaggatttttaggatygaaggygttttttttttttttttttttagygatattgggaaataaagtttygyggttgaaaagaatattaygygyggttaggattygagtagggttttggggygttaagggyggggaaaatagggtattyggagtgtaggagattttttagggtygttttttttttygggggtgttttgaggaatygyggyggggattygtygttggtagtttgygggttttggtgttagygygtatgggygggttgtgyggaygtggttggttttttaaaggttttagatttygttygggtygtttagttttttaaagttgtgttttaaagtttaggggagatagygaggttggggaygtygggaagtttttttgaggtgtggggtttttgagtagaaaygygygggggattgttagggttgtagaaattttggttygaggyggtggttggttygttttattttyg

SEQ ID NO: 6221 - DNA, 1768 bp, synthetic construct; identical to SEQ ID NO: 6211
  misc_feature 1..1768: note = Description of Artificial Sequence: Synthetic polynucleotide
  source 1..1768: mol_type = other DNA

SEQ ID NO: 6222 - DNA, 1101 bp, synthetic construct
  misc_feature 1..1101: note = Description of Artificial Sequence: Synthetic polynucleotide
  source 1..1101: mol_type = other DNA
gygttaagtyggttttttaatttggtttgttgaaygtaaatygttgagagtttgttgtatygttttttggggtttttggttgtygagtttygttaaggtaaagaygttagtaagygaggaagygtagyggaagaaaaataagygggygygygaggggagttttaggagggttgtygagtggttggtaggyggttttygtttttttygggtggtttygtyggyggttgayggttyggaggaygygygtttygaaaagttagatttygggyggyggygygttaygtygygttttttygygtttttttttygttgygtttygggaaaggaatttgttttttyggttttaggattggggagtgtgtygyggggtygagggtggggaatagttagagggagaygygaattaggtygttggyggagggtttagggggagygtagaggygayggtttttatgtyggyggttaatatgatggagaatyggtygttgttygttttgtaggtgttygagtygtagggtgygttygagggtagttyggtttggtttagttygtygatttttaygtttygtygtyggygttttaagatgygtygtatgaagaaygtataggagtagagtttggaggtygggttggttygggatttgttygtygttttggttttyggtaaggagtttttgtagttgtygtttatygagattaygttttttagygaygaggatatttygtggtttaattgttttatatttagygygttttygygtygaaaaygttttttttttygtaagtggttgagggtgagggagyggaaggagtgtagtgaaagtaggtaygttttygtttygttygttttttttttttttttttygttttttttagagtygtttagggtttyggggtattttgggggaaaygttttgggggagaataggagttygttattagaggygtttttggagggygttgygtttggttttagggatggtggtatttagtttttaygygtgttattygttttttaatttagggtgaggggttttatgttgtaygataygtttaygtggggttttaygttgtattttattttttttgattttygtagyg

SEQ ID NO: 6223 - DNA, 1101 bp, synthetic construct; identical to SEQ ID NO: 6222
  misc_feature 1..1101: note = Description of Artificial Sequence: Synthetic polynucleotide
  source 1..1101: mol_type = other DNA

SEQ ID NO: 6224 - DNA, 2341 bp, synthetic construct
  misc_feature 1..2341: note = Description of Artificial Sequence: Synthetic polynucleotide
  source 1..2341: mol_type = other DNA
gygtggttyggagagygtggataaggtaatttgttttggatgttygggagaagggagttyggtygaaagggtttagtttttygaggttgttttaattggggygygyggyggtttaggagggaggyggggaggttttygggttgggtyggggaaygtyggtttttaggttgggtagggaggayggtttagagygygggttttygggttttatttygggaaaagtttgggtttgttttgygttgttgygtgttgygtttttgggatttgttgattgttttagagggaaygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyggtagyggagggtttgagtggaaaaatttttattggatgtattttttaatggttggtttgtttyggttttygttygagtttttttyggtagtaggygttgggttattygtagttttagttaattttttttttatattttttttattttatttttaaaaagtttgttttyggttggaaaaagtattaatgaaygtatttgtgggaagaaayggaaagtgaatgagttaggagggttattttyggttaatygttttaggaaaagtaaagaagttaaaggtttttggttttggattttgggggaaggtgatggggggaggtttagatttygggaattagggygyggaygttgggygtggatttygttattgttttyggttagtttttattttttaggagtaagtattttgtgtgygtagygtatgaatgtgtttgggtattttygygtatatttatatagtgtgtgatgygaaaagtaggattagtaggggaggaagagggggtgtggggggggagggaagatgagggagagtagaggggagagaagagagaggagagttygaggygagagagagagagagagagagagagagagagagagagagagagagagagagataggatttttttttygattygtaaagtgaagttattttttaaaattagttgaaaaaaaagttttattyggttaattgtttttttygtttygttataataataaaygtgtataggggagtgagggtagggygttygtagggggtaygtagggagggtttagggygttagggaggtygygtygggttaattygaaggggttgygaggttaggttgtaatygggttaatgtgtggaatattggggggttyggttgtagatttggttaaatggaygggattattaaggtaagyggyggggtaayggaygygggyggyggggatyggtyggggaggygaagyggygggygggtaggtgyggggttygygtttyggaagaygtggtttttttttttttttttygygtttyggtttygygtyggttttttyggygttygggtggygagttttattygygggttagtyggttaggygttygtattgagggygattttttttygaaattttagtttttaaagtggagtttyggttttttttttatttygttgttygtyggggttgtaggaggggayggygggaaatygggggattttagggtayggaayggagttaagggygagagatttyggggtttattatttttatygatattyggggttttygtggttttagygttaggtattgggtttttttttygtagaggyggaatayggygggggygggggttgtagtygttygggttygggtttttgtttggtgggttttggggtgggtaagtggtttygttgtaygagggtaggggtgtaagtgagtgtgtygggggatttatttgagygggtttttttagatggaagtttttgtttatatgttagygttttttttttttttyggtatttagtygttyggttttaggygttggagagtygtyggtttygygggatttttgggtyggtttygtygttttttyggyggggaattttttttagttttygttygtatagatttttagygtttygagttttygtttttygygtttaggygtgygtyggttttaggattagggtttttggagttgtygttttygaaagggttttgygtttttyggagtygttttygttgtaggggtyg

SEQ ID NO: 6225 - DNA, 3857 bp, synthetic construct
  misc_feature 1..3857: note = Description of Artificial Sequence: Synthetic polynucleotide
  source 1..3857: mol_type = other DNA
gygaggggyggggggyggggagggaggygggtygyggygttggtttyggggttygyggtayggttttttttgtygygttgtttagggttyggattttgttyggygttgygtttatygygagggtgttagattygtygygtygtygtygygtttttttagtygyggttttttttttygtygtttttttttgtttttttagtttttttttttaygtgtggatgaygttaaaatttygygaaaaagtygygtggtggtttttygagyggaggygygatttygtygtttagyggttttttttygggggygtttggagggggagaagggyggaggyggtyggtttttttttttttygggaggtaggatttttygaygtygatygtyggaygtttttygttttaaagtttattggaaaatttatttttgtaaagtaaatgtatttttagagttattttyggtygygtgaggygtgttttaagttgaattagataggaagagggggaagttygggttttttaatttttttttttttygaagggaggggagtgagatgttaggtgggtgatagayggtaggygttygtttttttaatttaygtttgtygtatttgtygttttagtaatttagtttygtttaagtygaaattygtygaagggagtgyggatgtataggtttggyggattttgtttttttttagaaygtagyggtttagygtttyggygggygyggttgygattagagggtttyggaagygagtgaatatttgtaatygtattgttygtttttatttattttgttttttygtgtttttygtttttygaygttttttttttttttttgttygtatttttttattttgtttgtattttttttttttttttgatgtgttttttatgtgttttttyggatttatgtgttttttygtattttgttagtygggttttyggttttgattgatygtttatttttttayggagaaatataaatatagttttattttttgggggagtygaggggaaggtagtggtttttatttttgagtttgaatttagttattattygttttttatttggtttaggygtttttgygyggagaaggygggattygaattygygttgttttygggttttgagtygatygyggaattatttggttgggaggtattttttaggtaagtttgggagtatgtgtgtttagtgttgtaggtttttgtagaaaagtgtttataaatatttaatattttgttgtattttttatttttaggttttgtatattttttaatygaaattttaaaaygttagygtagagggtggggagtyggtyggaaaaagaataaaagtttaataaaattggygttygttaaagtttattattagttttatatgggatatatatatatgtattttttttttygtgaagggtgaaaaggagataaggaagaattaataatttattttttttygtygttttttattttygygttayggtgattagtttggattttaaagttagagtataggtttttgygtttttttttgaaatygaagtttatattgaaagaaagtgtgtatttttgtttagaaggtaatatgygttttttygygtgttaggtggagtgtattttaataagatattagggttttaatatatggttggagtggygattaaaagggaaaatttagtttttagtttaagttttttagagatatttttgttaattttygtatttttttaygttttattttaygtgtgagagtttgtaaaattatyggggattggattygatggygagttttaygttygggaatagttagtaatyggaaggggaagtggataggggaattttaagaggygagtttgttaygygggaagygttygaatttgygggtttttatgaatgtagagggygtygggaagggggggtattyggtygygattttttttgttttttttattygttgttttttttttygttggaatttttttgtaaagtaagayggagtagggggagggggagagggaaggggygagagggttttyggtttattttygagaygtgaggattygttatttaggtatttttttyggggtgggttgggtttygggaygattattygtttttttttygttttygttgtttttatttygggagatttagagttttggatgttttttttyggagaagggggggtgtgyggagtyggggtggaagagattttgttygtagagttatattaagtgatgtttagaggttgggagtttyggyggtttttgttttttgtttgtygggttagatttatattttaaaaatatttttygttttttttttttttttygttttttttygttgtaattttttttgattygtttaaaggtggtttaggtgaaattggagtaatttttttatgggggttttaaaatgtaagtgaatgtttttattyggggtgatttaaaagtttaagtygggaagtttaaygtgattaaaattaataggtgattgttyggggtygattgtgtgygggtgtatayggtattyggttygggtgttattygyggygttggattgttttattttgagtttgtaatttgggttttttagygagttttttttttttttgaaagttaatggtttttatagtaattagatatttttttygttygtttttttttttttttttttttatatataggagatgggatatttattttygttgttattgataaggtyggaggyggtygggtttttttttagttttygttygttttagygttygtttttttttygtttttttttggtttttttttgatgtagtggggaaygygttttattaaaaaaaaaaaaaaaaaaaaaaaaaaaaagtaatttgttyggtaataattagygygtagtagtaggagttttagagttattggttatgtaaatagagggaggggagayggygttttaaatttttttttatttttttaaagygatattttttttttttttttttattatttttttygttttattttygtttaaagaggttggtttyggggtttgagttaatygtttgtatttttagtttattygtttttttttttygttttgtagggaatttagtgtayggtttatttagttygygttttatttygttttgttggtttttygygtttttgttygggttttttttttyggtgagggaggtatttagtyggtttyggtgtgtttagagagttygagttaygttatgttygttgtaygtgttagtttggttagtatattagggygttggtttttttttttttttttggagtgaaatatattaaagggygyggtgggggtggggggtgaygggaggaaggaggtgaagaaaygttattagatygtattttttgtaaagatagttttgatttaagtatgygttagagtaygtgttagggtygatygtgttggyggygattttatygtagtyggtttttagggagaaagtttggygagtgaggygygaaatyggaggggtyggygaggatgygggygaaggatygagygtggaggttttatgttttyggggaaaggaaggggtggtggtgtttgygtagggggagygagggggagtyggatttaattttttattygttttttttttttttygggttattttttagaaagttgtatyggtgtggttaygtttagygtagatatttygggyggtttgttagtagatgtaggggygaggaagygggttttttttgygtggtygttggtygygggggaatygttgggagttttgttttyggtttgyggyggttttagaygttgtatygygtygttttayggygttygaagagtttttagaaataygatggtttttgttyg

SEQ ID NO: 6226 - DNA, 1439 bp, synthetic construct
  misc_feature 1..1439: note = Description of Artificial Sequence: Synthetic polynucleotide
  source 1..1439: mol_type = other DNA
tygttattatygttattttttyggaattttttgggttygygttagttttatttggttaygattyggtaggygaaggggtgyggaggyggttttattagttygtttttagttttgtttygagagagaagttygttgagagggtagatagttgagaaattygattttaattttttagtyggygtttttygaatygtttygagagtttagattagtygggtagtggatttyggagtaaagtgttatgtatattttggagaggagggaggygtggagggaaagggyggtaaaaatgaaatgtttttaagttagtttygtaatttttttyggttygagggaygggyggagggtagaggaggtagyggyggttagygygaggtgagggatttatttgaaggtgaggaygtagagyggtyggtaggatttgtggttggtgttttyggttatgtttttgttttagaagtygttggtgaagatgttttagyggagyggggygtygggtygtaygtyggggttgtttaygatygtttataygtygtygtgtaygaattygttttgtagggagyggtygtagtataggtagtttgtttyggttagtagygtygyggtttyggtyggygttagttygtagtttygtygtygggagggtgtgyggttttygtygtygtttygggtagaggtggttattattatygygtygtygtygtygttgttgttttggtttttttygggygtttggtatttttttttatyggggtttyggyggygygyggygtttgttyggaggggggttygggtatggtgttgyggtagttggattygtygygagtttttygygtttygtygtygtttgygtygyggagttggtttagttgtaaataaatagtagttttttygtttttttyggttatygttatttttttygttttattgygtatgttygttygtttttttttttatygttttttaatttygggaygygggtyggttttttygtatagttyggygttttttgttttyggttygttttgtttgtaggtggatyggggttygyggygygyggttgttygggagttgyggggaaggatattttaggtttttatttgyggtgttyggttgtgtttatttttaygttttygtttttatttttttttttygaatggggttgggaaggggtatatttggyggatttttttygggggatttaggagggtttagtaggtgygtagtttggaatttttatatttattttttagggagaaaagtgtygttgtttttygggaagttttyggttttttagtattygggataatagtagyggygttyggagagaygttttttattygtttygygttygygtttagtygtyggttttgtgtttttttgttygggtttttttttattygttyggygyggygtttygtttggyggaggaattygyg

SEQ ID NO: 6227 - DNA, 1288 bp, synthetic construct
  misc_feature 1..1288: note = Description of Artificial Sequence: Synthetic polynucleotide
  source 1..1288: mol_type = other DNA
tygataggttgtagtygygggttatttyggaggttaaggtagttatttttgtaagggagttttgygtttaagtatggtttgttygtttygtttggtttttattaataaggtygggattagyggtyggtggaaygagygagagtagttttagttttataggtgagtygtttttataagtagttaagtygygagtygtttyggygtygttatygttygtatttatttttttatttygggagggagatgggaggygtgggagaaygyggagaggygyggygaggttgggagygggagayggygtygggaggygggaagyggattagagaatgggagaagttyggtaggtggataggaggaaataaaatttaaaygttttattttygaagtygttaggagttgagygaaggaaggagygaggtaggaaagygtggygttttaaatatgtygygggagyggygygggaggygtagaatttyggagtttgtagtttagygygyggggttttagyggagygygaggaygygagyggagttttttyggttatttgtgttgttttygttttggttgtttttgtttygagggaagatgttygagtattttttttattttatttggtyggygaagtatagttyggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgygtygttgagagtyggtaatttttaggagttttaygttggttttatggygggagyggagggygtaggggaaggagaggygygygaggaggttgyggttgtygygaggtttgygttaattttttygtygygygagygagtygaggygygttggaattagagattyggtatggagtgttgaggggaggggggagtygtaaaaaagttaaagtaagttttygattygtaagtaygttttttttttttttttagygtattggtgtttttggygggtgtttggyggygaygygtttaatygtagttyggygygggygttaggtgataggyggyggagygygtagattyggtttttygygttttttgaagaagggattygtgagggagggagggagggagggygggyggttyggygtttttgtygaggtyggggatgtttatygttgtttagagttggttygaggagtttttttyg

SEQ ID NO: 6228 - DNA, 1006 bp, synthetic construct
  misc_feature 1..1006: note = Description of Artificial Sequence: Synthetic polynucleotide
  source 1..1006: mol_type = other DNA
gygygtgaagaatttagattttttaatgygtatattatttttataygtagggtygaggyggtagygyggttyggagggggttyggagggaggggtyggattygtttyggygyggtttygtyggggaattagttttygagtygaataaaagtagttaaagattygtatattyggtagaaggggggyggttttaagaaagttygggttggggyggtttygtattttttygtttttttygtygttygaatttgttgtaaaggtagagataatggagaaagtttygggagaygygyggagagattgtttttttggggagggaggggygggtygggggaggyggggtaaggaggagggaggggtygtygagggygaggtyggygtttagygtyggtttttygtayggttttttggatgttaaattyggtttagggagtttaggagtygttgtagttttagtttttttttttttttttttygatgattygggtaatgttaattttttttygggattgaaagttttaaatttaaggtgttaagttgatgggyggtttttgtttttatttttygatttygggygygtgttttgaaagataggagagaaaaaagattatttagttgtaggaggtaaggttggagygagtagygttygtttgttttttaagtaaaggagggaagtttatgtgtattygtgtattgggtttyggagtagtttyggggtgtagggtattttttttttagggygtgyggaggaaggttattaaaataygttgtattgtygaggtggagttgggtaaagtaggtagagattggtggggayggatggygagtttgggaagtttygggtgttttggtggagaggttttttgtygggggyggggygttggagagttttttyggygyggagagtttttygggygyggagagygtagagaatttggttaggaggtgttggatagtttyggaattygygygttttttgttaaataaagygtggagattyggattyg

SEQ ID NO: 6229 - DNA, 1185 bp, synthetic construct
  misc_feature 1..1185: note = Description of Artificial Sequence: Synthetic polynucleotide
  source 1..1185: mol_type = other DNA
tyggttttttttgggygtagtgygtatygtyggygtttttagatttttggattattyggtttgggggygygggygyggttggggagggaggggagagttggtttatttggygttgaaggttggaaggtatagtttyggtttttyggagttyggttyggtagtttygtattgttygtagagggattgagtatttgaaaagtttatygygtttygtagggygtttyggyggggttaatttgttyggttgyggggtatagttttaggggaattgggttagtaggtaggggtyggagttgygygttygyggtggttagggyggtygtygggtygtggggygygggyggttgtagtttgggygttggggygttttygattygtagtaaattttygattaggaaatttttgtttaggttgttaaagtygggygtagyggggaggttgaggagygyggaggaagttataaygttttagtaygtatyggygtgggttgygatygygttggggagtatagtgyggygttaatyggtttgttgygygttygttttgygttygtttgtygttygggygtttygtatygtatttagagtygtagtttttygtygtygtttttygtagggttggagygygyggagttaggtagggaggaaaggttattygggayggyggyggatttggaaygatattatttatttgygttgggygtttttttaagggatgggaggagtgagtgtgggagggggaagttgtgagtttttttggtygatagygtaggttttgggagygtaggggggagtttttttttttttttatgtagatttggaygggttttttttttgttttttgtttttttttggayggayggaaggtgtgtttagtttatttatttatgttattagttttataaagtgatagaygyggttaataataagggtagtgttgtggtaaggggaggggattygtagtgggaggaggtgggygtggaggygaygtgaatygggygygttygttattttttygttgtygtgtagagtygtggtattttygttagagtttaagtagttttttaggygtggggtttggtggaygttggtttggagygttyggagggyggggtgggggtgggggggaygygttgtygtttggggtgttttygygtatttttgttgggygaattttggtttttyg

SEQ ID NO: 6230 - DNA, 409 bp, synthetic construct
  misc_feature 1..409: note = Description of Artificial Sequence: Synthetic polynucleotide
  source 1..409: mol_type = other DNA
tygtttttyggggaaggggtttttgaggttygggtggtygtttgggtaatygtagtttgtttgygttttttttttttttygygtgggttttagtaatatttattgtagtygggttaggygagtyggygygtattatyggygyggggggaggagagggtygggtttgggaagatgttgyggaggaygttgyggattygygagttyggggtaaggyggyggygtatygttttttttygtygttttttttttatttygttttttatygtygtttttagttttttttygggatgagagagagtygygttgyggagtaattttagtggatgggttygygggggttgagygggyggaggaygygggaatttygtgatatygattagttgaygttgttygygtgaaattagagtyg

SEQ ID NO: 6231 - DNA, 1813 bp, synthetic construct
  misc_feature 1..1813: note = Description of Artificial Sequence: Synthetic polynucleotide
  source 1..1813: mol_type = other DNA
gygggyggyggaggagggttggyggttagatatagtatygttggagtttagagagtygggtagaggttggyggagagtygaggttggtttagtttttaggagatyggygagttggggtgtgtgggagygggatgtttttaaggygaaaagaagygttagtttygtaagyggtttttatttgggttgtttaggtyggatgtttaggagtttatagtaggggggatggagygaaggatygaggggttgggaggygaggtygtagygtattgaygtaggttagygaggtygttggtttygaygtagggygttyggtaaggtgtttggtattaygagagttaatttttgygygttattttyggaggttagtgygtttagggygygtyggttyggtaggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggggaygggtyggttatatttttygygttatttyggtaggtatygggtgggtttttttttygttttttggtttgagggyggaattyggagaagagtggaaataggggtggygtgaaggagagttgggggttgggggygggatygggagggggtgttgggggaagygaygtagyggttgggagattttgtaagggggtttgaagaggagtgggggatgggtatggaagggtgggggattattgaggtgggatgygagagtggaagggggatttagagggggygygatggtyggaggagggggagatggaygatggggyggggyggtatyggtygtygygttttttgtygttaggttygtttttyggtygtygggtttaygggttttttttggttagygttygtttttygtttttyggygtatttgtatttatttgttyggygtttaggttygagtygggtagtagtagyggaygtagygagygtagtttygygtygtatttttyggtygtttttttttygttgygagtttaygtygttgtygtygtygttatygttttaaaaaggataaaayggaatagaaaatgaatgtatgtataaaaaaaatygtaaaaagtaattgaggaggatggtagtygygygygyggttyggyggggygggagtygagaggtygyggtattggtggtygygattygggtaggyggtyggygygtgtygtaygygggtggttgtagttttttyggtygttygygttyggtttaggtayggtatygttttttttttyggggagttttttygattggtttgtttttttgttagttaggtaggagggygyggygttygtttygtttygttttygttttygttttgggtagatgtygggagtttttttgtygtygtgggagggggagttgagttgtyggagygtgygtattgggttagygggyggtyggggtagggttggggtttyggygttgagygtttttagtygygtygggtagtttggygtttygttgagtyggagtaattttyggtaggagtttttaggttttggttaagtttygggattygggaagttatttttgttttygggggttygagtttggagtggggtttgtaggtaaagyggggttggggtygttttggtygttagtggttaggaagaygtagygatttyg

SEQ ID NO: 6232 - DNA, 1294 bp, synthetic construct
  misc_feature 1..1294: note = Description of Artificial Sequence: Synthetic polynucleotide
  source 1..1294: mol_type = other DNA
aygtttttttyggatgygygtggagygttttataggatygtygttttttgygygttggygygtataygtttttygttagtttgggygtygggtttygaattttyggtttgtaaatttgygtattttttttygtygygttygttagataatttggygaatagttygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtygttttaaaagtttttttttygggtttttatttttygtattttygtattttgggggagygtatttaattgaggtaaygtagtttttttttagtgtttgtagaaaaattaaagttaggggggtgagttygtyggttgttaattttttygtygtttttttygttttattttgttttygtaagtygagaaygggttgtaaaagtttgtaatatttttggggggyggaggggggaggggaggggggtttttygggttyggggygtygtygtaggttygygygyggtygtyggatttygygtttygggygttygttttyggtygtttttygtttygygttygggttttygtygttttttttttagtttttttttagttttttatttttgttggtgttggaatagttttgtttgygtatyggggtaggyggttygtttttgygggyggatttttggtttagyggggtttttttggagtyggyggtygygttygygtygttgttgtttggttygttggyggyggggtygggggttgtyggagttgattttatgtttttttttaatgtagagatygttggagatggygagtttygagattttttttattttttgtttttagagtaattttatggtattaaaaaaaaaaaaaaaaaaaaaaaaaaaaaaaaaaaaaaaaaaagaaggagaaggygatyggygaaagtaggagggaaaaagtaggyggyggygggygggtaagtaaaagygygagggagygygyggagtgtttgggtggaygtgtgtgtgygttygaaaggggataagaggygggtttggttataggtagygttagygagagtttttttagtyg

SEQ ID NO: 6233 - DNA, 939 bp, synthetic construct
  misc_feature 1..939: note = Description of Artificial Sequence: Synthetic polynucleotide
  source 1..939: mol_type = other DNA
tygatgtygagagtggttttgttggagaatygtygygtttgtagtttttgtattttttttyggagttgygttagggaattayggaygaattggaaggggtygagaagaaaggttttggttattatttttagttttaagttttttygtttttttagattttggatttttttyggggaggatttttaggagttttttggtagtttttygtygtttagggtygatttttttatttttttttttattttyggttttygggygagggaggtttygygtygttttttagattggttgyggtyggaagattgtagtygttttgagtttattttttgtttttttataattaaggagtatggtggagttgggttaattttaggtatagtttagtygagttaggygaggtttagagagatttgattygtttggtagttttaayggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagygtgtagttttyggtgagggtagttttaygtatagttttttatattttttttagygtttgtagttttyggtgygygtaggttttaagtttatatgygtagtttttattttgygygtagttttatgtatagtttyggaygggtttttagttttattggygtagaatttattatygtttgttttttaygygttttattgggagtgtagtttttatttygagygygtagttttaygtagtttttttatattttttttagygtttgtagtatttttagtgygtatagttttgttagtygttttttygggygtygtttttgtattatttyggtttataattttgyggyg

SEQ ID NO: 6234 - DNA, 939 bp, synthetic construct; identical to SEQ ID NO: 6233
  misc_feature 1..939: note = Description of Artificial Sequence: Synthetic polynucleotide
  source 1..939: mol_type = other DNA

SEQ ID NO: 6235 - DNA, 899 bp, synthetic construct
  misc_feature 1..899: note = Description of Artificial Sequence: Synthetic polynucleotide
  source 1..899: mol_type = other DNA
tygaaygtagttaygygtttattggttttttgtttttggygtttttgggtaygggggagttggggyggtttygtttgygtayggyggtgtygggattgggggygggtaygtygttttygttttttaygygttygttygttygttygttttygtttttttygtttygagygattttttgttttagttttgtaggtttygtattgtagatgtttgttggtttttttgygttyggyggttttygyggtgtttygtaagttttygtgattttttagtattagtyggttgtgygttttttgtttttaygggtyggttagtygtagatatttatttagtttygygagtttagtygtttagygagtggggtagyggggatygagayggayggtagtygtgttagagttyggggygttttyggatgyggtaggataagttgatygggtttttgaggygyggggggagatgtttgaagyggtagggyggyggygtgggtattattttgagtaatgtgtttaagaagygtagttgtatttttyggatygygtttyggttgttgtgtattttggagtygggtgaggattttagggttgtagatggggygttgtaaagtagygtyggggttgttygygtttttgttttagtttgatttygtttaggtyggggagttttggggaaagttygygtgttatttggtgyggggtatygygttggtatttgtagggagygattggtttggaagggtagagggtagaygggggtttgggtggggtagyggttattttaggygyggagaattygttgtttttatttttttttygyggatttttattttgyggtttgtgtgttyggtttttttygygtggyggggaagtgygggtggttgttygggtttttagaggtyg

SEQ ID NO: 6236 - DNA, 899 bp, synthetic construct; identical to SEQ ID NO: 6235
  misc_feature 1..899: note = Description of Artificial Sequence: Synthetic polynucleotide
  source 1..899: mol_type = other DNA

SEQ ID NO: 6237 - DNA, 547 bp, synthetic construct
  misc_feature 1..547: note = Description of Artificial Sequence: Synthetic polynucleotide
  source 1..547: mol_type = other DNA
ayggtagatttyggagggggtgtttaggatagtgayggttgatatgaagttagyggtgagggatagygttaygggtattgyggttattttgyggtygtttattaggaagtttttggaggtttgttggtygtttttagygaaggygtagtagatgtygatggyggtygagatgattagtatgttygygaatattaygtagttttatattaygaaggtgtygatgtttygtggygtgtttatggtygtayggtygtttgagttttgygygtaaattggtggtttygyggygygtagtyggagttyggygygtattttttatttyggatttttggygygtaggygtggygtttygyggggattggaggygttttttaggtgtyggttttygaaygtatttygaggyggggtgagggttggtagtygtttttgtattygtygttgygagtygygttttttaaatttaggtatgggatttyggaaaatygattygttgttttgagtgtttattaygtgaggaattggagtggtygagttygttaaggygtyg

SEQ ID NO: 6238 - DNA, 2505 bp, synthetic construct
  misc_feature 1..2505: note = Description of Artificial Sequence: Synthetic polynucleotide
  source 1..2505: mol_type = other DNA
tygagttaaygygttttagtggtaggtggygaatggtyggagattyggttttttagtggtgtttatygttaygggttttygttygataggtttatttttttttatgttggagtaaatttyggttgaaagagggtygtattaattggtttgygtattygaagtgggaatagagagggaggaaaattatgttttaggtgttayggggggaaaaaagtgaaatgygaatygtaggggagagagygatygttaggtagatattttgtgaatygyggtggagagtatatttaggtggggaggttatyggtttaatttattatttttygggagaatgygggtagggatagtagtagggggtagtatttaygtttttaygtttgtaagggttttttaagtttttggttattgttttttattttttgtagtttyggtgttygtygggggygtgtgtgaggggyggggtygtatggggaggagggatttaaaaaaaaaaaaaaaaagygaggtaattagtatttttygattttattggtttttygtygtttttgttttgtataygttygttttattggttgttyggggtttgttggggttyggtaaggtttgtagtygttayggtygttgttgygtttyggtgtagggtaggttggygtygagygaattagggtygggaattgggagtygggagtygggagttagttgttygyggagttgyggyggyggyggtatttggggtggttttagttttaygaatatygtggtyggygttyggtggttattgygtttagyggggtttagggaagagyggtttagatattttttattttggaagaaaggggtaagtttyggygggagtttttttttyggtttggttygttttttattgygtttagtttyggttyggattttggaagatgattttagggtttgttttgtatattttagyggyggtagtttygggaggtagtygaaagtattaatagttggtagtagyggttagtggaaaagtgagttaaggyggygyggattyggtttttttygygtttygyggtattygttgtttttygtygttttttttttttggtttttaggyggttgtagtatgaagtggygtagygatggttaggagaggtaagaagttygtggtgagaaygttggaggatttgaygttggattygggttatggtggygyggyggattyggtgygtttttttaatttgtttttgtgttgtttygattygtattyggygttttygtatggygggagttgttggtygtttttagttgattttatgtatagtyggtataatagttttgatattgttaatattgttttggtggaagatttygaggggttggattgygtyggttagtattgttygyggttgttgtyggatttagaygaggttttttggattttttaggagttggaggygttgttgttgygttygygggattttygggtaggttyggyggttttyggyggtttgtttaaggaygygttggttaagttgtygaygttggtgagtygggygttggtgygtatagttaaagaggygtagygtttgagtttgygtttygttaagtgtattaagtaygagatttagagygttatggagatygtgttgttttggggtttggtygygtattgtayggyggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtaygtygttatttatttgatagtttgtatggagagtttttttygggatatttattygygggtygtggttttyggggtgtttyggagttgtagtggttttgggttaggttygggtttyggtttaggttygagttygggttttggtgyggttttygyggyggataaagagygggaggygttygggggaggagyggygagyggyggygtttgtagygtagttagtagygttagygggggtagtagttgttgygtttygtyggtygtygyggtygtygtagtttygtyggtagtygtygttaattattattattattattattatgygttttaygaggygtttaagtttatygtggagattttggagtatayggttaataaygattyggagatttggggttttttgtagttttattagtatttgatttgygggaagaaygttagyggtaagtgtttgygygggtgttatttttttttatttaatttggttaatttttggygtaagtttgtttygygtttttttttygygtttttttagttaygygttgttgttttaagtygttgaggaggyggtygggttggaggtagttagaataagaggttgtttgtttgtttttgtattygggtgygygtattttaygttgttggtgttgttttaggttygggagygygaggtttygttttyggtgyggggyggggyg

SEQ ID NO: 6239 - DNA, 1587 bp, synthetic construct
  misc_feature 1..1587: note = Description of Artificial Sequence: Synthetic polynucleotide
  source 1..1587: mol_type = other DNA
gygygtttygatagtttttaagatggtygttaatgtgggatygatgttttaatattggaagygatttgatttayggygattttaggttagtgygggtagygtyggtygygyggtygtgaggagttttygggygygttttgggygtattggggaggttttygggygggtaggyggaygttttggggyggygggyggyggttgtyggggttygtyggggttyggtygttygttgtttatygataggtattaggaattgatttygtygttgttttttgttyggtttagttatygattagttgtygygattatggagaagygttagtgagttttyggtyggyggagyggtygagyggttaggyggtygggygaggagyggggaaggtaggggttayggtttygggtagggggttgttggygggaattttyggyggttttttttgagtygtattttgygygttttttaatttygyggygttyggggaggtygyggagygygtygtttgttagttygtattyggttggggtttyggygagggagggagggagttggygggtagggaggaggaggaggagaggaggaggaggaggagagaggaggagggagtyggggttggygaggaggyggtttygygtttygtygttygtyggtattttagttttygtygttygtttggttgygtagttyggaygygtygttattygggggtygtygtygtygtygttagagtygtygtygtyggattggtygtaagygtyggtagatttttttttttygggtyggggttttggggttygttttgttttttgtttttattttttygttttttttattttttttttaagtttagatgtagaygggyggtggaggtgggttygggygttygtaagtttgygtttttgtttttagggyggtggagagtygggagyggygtagagtaggtgatttttagttttygggtttaagggaatttttaaatgagagatttttttgtttgttttgttttttgygttttttttygttgtttttttygttttttttttttygtttttgttttttttttgtttttttttttttttttttgttttttttttttttttttttagggygatttttygaaattttattattttttttttattttttttttgtgggagtttgtgtgttttttttagatttggaggtgttttttgyggatttygtaggagtyggggttgggaggtggaattttagagaaygtatygtggaggygyggtttyggtttttgttttttttyggagtgtttyggaygygtttggtaaggttttttagttttggagtttygtaaagtttyggygggtgyggyggggattaggggygggaaaatggtgyggataatagggyggttagagtattttgttttgatygtgatattygyggaagaygygagattattagtttggagataaaaagggatttatttttttttttttttttaattygtyggtaaatttygttaagttttttttgataagtggttttagtattygygtttttttttygttttggtygttttttagttttygttttttygaaygttttatttttyg

SEQ ID NO: 6240 - DNA, 5693 bp, synthetic construct
  misc_feature 1..5693: note = Description of Artificial Sequence: Synthetic polynucleotide
  source 1..5693: mol_type = other DNA
tygyggttgttgggagagtattggyggtgggttgaggtttttggagagttygyggggtggagatgggggtyggttttttttyggygtttagtygaggagtagttgttagttgagtgyggattygagagagaattttygagggatatttaygttttttatygygtttgygtygggygttttggttttaggaggttgtttyggggyggggttttygggggtygagygyggggggyggttyggyggttttattatayggyggtttygttgagttyggggttgggatgygataggggttygttgtagtygttggtgtygtttattgggaagggygggttgggttygtygttgaatatttygtygggtatggggtgtagygtgttyggtaggtttggttyggggttyggtgtgttygggtgygagattatgtyggtgaatttggggttgttygyggygtgygggtyggygagyggyggttttagygtttttagyggygtygagtyggggttagaggtygttaggaagttggagtyggtyggggattgygtttgygaaggygggtygtgygygaagaagtygtagttgtttttyggygygtagtagtygttttggtagtttgtggagggggagygggaaggagatagggygyggtgagagaaggygaagtaggygggggattygggattyggggaggggattygggygggygagagaggggagygygygatatygatttaaggttagagagatttgyggaggtyggygttttttgagayggtggaygtygtaggtttayggggagggttggggagagagataatgagagatttygaaagggtaagagatttagattgttagagattatatatagagaygggagagatttygagatygtgggggatataygyggtaaaaattyggagattttagttataggttttttgatatttagagatggagagagatagaggyggttagagaygtagagatagataatgatttttaagtgttttagggtyggtgagagatatagagatgygggatagygagagatagayggagagatyggtagaggggtagagagaaaggyggaaaagagatttagagatgyggagttygyggttgagattygaaagttygagatatyggagggtygyggaggagtygaggagaygtagagagaggaaagayggtygyggttagagataygygtggaaattttygggggyggtagygagggagttaggagtgagttygaagatggagagaagtygatgygtttagagaaygtaagayggtggattagagatgagttttaggaatttttagagaagyggaggttgataggttyggggagaggaatygggtagggataaattagyggatagagtagagygygaaatggttgagatygggaagygatttggtygggggaaattggattygggtygyggtaggagygattggtgggttgggtygggyggggyggttttggygttttaaattyggtttttgygttttattaatttagtttaagtttttygtttygttaagtayggtygtygygtygatttyggtgagattatttgtatyggtttagtttagtttgagaaagagaaaattgagttttagygatttgggagagggggaggaggataygaagattttttgggttatggttagagtttygygggttttttggggtagaagttyggttttttagttttgtttygggttggttttgttagtatttttaggttttgaagtatttgaggatattgagattttttgagaagttggtgatagttatgggtttttttttaaggaaaatgtaaggatgagaattttgtttataaatttaggaggtgtagggatttyggattgtaaatttattttgttttaataaatttgtattaattttttgatygttttatatagttttttttttagaattttygggatattttgtttttttttattaggtggggttttgaaggattgaygtgggggaygttaygaaaggattattttgtattaggtattygttttgtayggygggaaaattagygagtttagaagtttgagttttttttgtaaatttattttttttgttgagttttgggattttagttaaggggygaatttttgatgttttttgttatttttttttttttttaaattttgaaatttgtttaaatggggggtgtttggaggygtggtttggaggtagtttaagtaatagttaaaayggttgttaattattttttaaaattattaatttaatttttttygaaagtgaaggggaagatggggagyggtaaatttggagttttaaagggatagggatgggagayggtygyggttygyggygagtyggaaaattagygaaggtygttgttttygygtygtgygygtygttttygtttatatggyggtygggtyggaggtaattggaataaaygtygtttgaaaagggtataaaagtygtagttggggttttgttygygtttttayggggagtygtyggtttygtygttyggtttttttttygttygttgtyggtygttatygtygggattttttagygyggattaggyggggttgtttygttgggggttggggagttttttttattattayggggaaygaggggtttttagtatttagttttttattttatttagygygtagggagaggaggyggtgggataggtyggggygggggygaagtggttttyggggaaattttggttaattatttaggyggggaaaaatttygggtyggtatygtttttattatttygttgtttygggtttagattttgtagggaaagaggtaaatttaggtggagagagtyggtgagtggagatttyggaagataygtttattattygggttttttagggttgggggtttgttyggggttgggggtttgtttagggttggggggttgtttagggttgggyggttggggygttttagtttgagttttgttattgtttggggtttttgttttgaaaagtatagtttggtattttgtttataatttttaggggtttyggttyggttttaaggtttaatttttttttaggttttyggatgtgttgaggttagtgatggggttattttttttttttttttgygtttatttgggtgtttagtttttgttttgttaatattgttattgaatttattttttaagagaaattgtttttttttaatttgygttataatttagaagtgtagatgttttttagatatagatagttttggggtttttttaaatttagaagttttagaatagaagaggagaggtgtttttttgagtttttagttttgggaagaataggatagtgagtttggtgagtttaagtaatgyggtttagggtaaggagttgaaaaaatyggatagggggagttgggatggtttattaatttagtgtgagggaagtgagaggaggaaaagttgaggtggtaaggggatagtttattttaggtttaagtttggtattattatttgaagttttttgtaaattggggtttttygttttttgtagttttaaagayggtggaaatttggggttggtttaatatttgtgtttttagtttgtaggaattttaggggtttyggggttggagggtggattatagttttgtttagagtaattgtyggtatttgggttaatattgttagatgttgtgygtatatatttygttatatggaataggagttgttgttttygatgttagtgagtaggyggtttggaatgaatttagatttttattttttttttttatattattttttagygttyggaatttattttatgttaagtatattaggtatagggyggtaggaaggttgtgygtttgttygtgggggtygtatgtatgtggatttgttagtattggttttagtgtgattggtgggagtgtgygygtttgtggagttgtgttttygtgagtgtatttgtgtgtgagagggtggaatttatttataygtgatygtgygatygtgtttagaygtgtgtttttggagtttttgaaygtaagtgtgagtgtattttgtgttttgygtgggtgaatgtgttattgtatttygtgtgtgtttttgtgtgtattattgtatgggtgagattatgtatttgattttgtgtttaggatatgtgggtgagtgtatatgtgtttgtgatygtgtgtttagygagtgggygatgttttggagyggyggaaagygtgttggtygggatttttygtttttagttttyggaataggataggtgyggaatagygaatttyggggygttttttattttygtagtaggtgtayggggtggattttaatattttagattygtttaagyggtygtttagyggaygtatgygtygyggatttyggaagaaggygtgttttygggygtttagggygtttagttgttttattyggygttttttggatygtyggttttgaaattatatttgggatagaggagggggttgtgaatttaggattaggagtgttttttttttttttttttttttttttttgattgggttgtttttgttgggtttttgygtttttttygtattaggattttttygaggyggggtygggtyggattaggtygggaggggtggagagaggtttyggygaattagttaagggtgaaggatttygyggattygtggggygatttataaagatttgggttttttggttttyggttygttygyggtttgayggttttataaaggtttttttttyggtayggttttygtttyggtttttyggtttyggagttagtttttggtygtttgtttgttygygtttyggygtagggagggagggggtatygtttgtttttttgttygaaaggtggaggtaaagagggatttyggattttagagaggtttataattttttataagtaaggyggggggyggaatttagagaggtaaagtgattygtttttaaatygtaatattaggaggatagtagggttagatggaatttttyggtttatagttttygatttygggtaagtgttttattygggygtayggtttgtttttagattagaattaggygygttygtagttaaggaagtttggygggagattttttygaggttttyggtttttaggttagyggggttaaggagttgtgttygtttygggtygtatttggatgaygygtatgttgaggtyggttttttgygttagttgttygyggatgtggygygtgggtttgggygtggyggygaaggtagttttgagygtttttagttgtttggttttgatggtggtgygggggtygygtygtttggtgttygagttttgtttttygttttygttgttggtygtttttttgttygaygaggtygagttgttygtttttttggggtygttttgtagtgygttttggaggttyggggataaattgyggttygtataggatgatattgygggyggayggatygggaaggggatagyggygttagygayggttagaygtttttttagtttagtggygggttttygtyggtttaagttayggtttgtttaggttayggttagtttygttggatttttttttaaatttgygatagttttttttttagggattyggtgttygtttattttttttaggyggggttgggtttttggaggggygtttttaagtttttttygygyg

SEQ ID NO: 6241 - DNA, 589 bp, synthetic construct
  misc_feature 1..589: note = Description of Artificial Sequence: Synthetic polynucleotide
  source 1..589: mol_type = other DNA
tygtttygttttyggggttttagggaggyggygattggagtttygttgtttatttataataaaagaaagtagggttggygtttttataygygtttttatttattgtyggtygyggggagaattttatttygygttttygttagggtttyggggagttttgggttggyggaggygaataagatgyggtttgatagaattaggtygtgtttttgtaaattttaatgtygtttygttagtygyggyggttttttagattttatttgtyggggagtttygagtygygtaaaatttttgtaagttgtgttttgtagaatgtaaagtygggttggaattygttattttygtygttttagtygattyggtygaygagtttttttttgagtttttygggttatttgtygggayggttatttygttyggtgaagtyggtgtatttattatattttttgttgtttttagtagggaagtyggyggtgaggygggggagtaggtatggtggtttyggggtttatgyggggtttattgtttatttagaatagyggttattgttgtttattagggygtatttatygttggagttttygyggyg

SEQ ID NO: 6242 - DNA, 1294 bp, synthetic construct; identical to SEQ ID NO: 6232
  misc_feature 1..1294: note = Description of Artificial Sequence: Synthetic polynucleotide
  source 1..1294: mol_type = other DNA

SEQ ID NO: 6243 - DNA, 1373 bp, synthetic construct
  misc_feature 1..1373: note = Description of Artificial Sequence: Synthetic polynucleotide
  source 1..1373: mol_type = other DNA
gygagygtttggygttttttggggygtagtttygagagagtttttttygggatttyggaygtaaggtttttgagtggttttggaagttggatttttyggggattttgtttygaattttggttatttggaagtaattttatygagygttttttttattgtttagtttygaatygtggyggaaygygtttttyggtttttttagagttttttttgygggagaagtataatttttttaggttttggagayggygtttttatattttaatttygtttagayggaagaagtgagaggtgygggyggtttygttatgatygygggaggagagygtaaggaggtttttygtaaagttggaggttaggtyggagygatgtttygggagyggagtttttttagtttygggtttttagtygyggatagttggtagtgttaaagatttygttattatttgyggttygtagttgygattyggtygtagagtygggtatygaggaaggygtaaagttgagtttgggtaggtataayggtttttagggattggtattttttagttygggttgttygygggagggtagygagttgtgttaagggtttygttattatygttagygtatagttyggagttaagygygyggttgaggaaygattagggttttgtaaagttggagtttgggygygtagattttyggatyggagttttyggtttgaggtygttygttaggaggaaaatgaggtygttygaattaagttgggaygygtagtaaagttygagtttttygygtatattaggggttygggygggagyggggagttttggggayggagaaggggygygggaygtttggattaggaatttatttgaygtygagtygggtagygtygaggttgttttttygygttgygtattygttygttygtttygtattttttttttttttttygggygttygyggtygtygygtttygggttttgaatttttygagttygtygtttygygyggttggagggygtyggttgtatttattygttttttggtaggagtygygygygtttttttttttttttttygttttgtgtttttaagatttttttttatttttttttttttagtttttattttttttttttttttttttttttttttgygtttttttttttagttttagygaatttaagttygggayggaggttgygggttttttyggygtagtgttgggygtttygygygygtttttggtttatttygttygttyggtygttgttygttgttyggtygtttttyggaggagtygyggygttaagtagttttttatttagyggttggaaaygyggtataaatatgtagggattgagtygtgagtttagygagggtyg

SEQ ID NO: 6244 - DNA, 1524 bp, synthetic construct
  misc_feature 1..1524: note = Description of Artificial Sequence: Synthetic polynucleotide
  source 1..1524: mol_type = other DNA
gyggttttgyggattttaggtttaagggggtatygttttaaatattygaygygtttttattattagttttttattggtaggttttaagygggaaygggattgggaaggtttygggtttggggggttttatttygatgttttaggggygttttgaatttagttttagttaggyggyggtattttaggtagygtagggagygygatyggttyggggagggggaggaygyggygttttygttttttttyggttygtttgtttatttttaggtttttttgttygtyggttttttggttttgtttattttggggttggtggtgggygygggtygggtttaggtttatgttyggttttttttattgtttgttttttttttttattattttattttatttttttagtgttyggtttygtttygttatyggattttttggaatgggggaygygggygygaaataygaatttagttatyggtagttttttttttaygtgygttyggttygtagygtagagggyggttyggggtgggggygttttatttttgttttttatggygtgtaygaagtttttttggtatagttggttgygaagttttttttttaggttgaagtygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagygttttttgtattttattattgtaatttaagtaattttgygtaattgttaaagatgttgaaaagtaggataaggagaggggttygtatttygagggtttagttgygttttaygyggggtattttttttyggtgttttyggaagtattgaagggatatttggggatttttttttgtttttygttttygaaatgtgttgggtttygtttattyggtygggagtttggttatgtaattygygaagggggtttyggataygggttggyggggtaaatgtaggttttaggaggagtygttgyggygttyggttyggyggtaatagtagttttagyggtygyggyggtagagtygggaagtyggaatygggggtyggyggtatttttaaagttggagtygttttygagttatyggggaagttggaaagttgaaatggaagggttgagattttagtygttttygtygttygttygttagtgtaagaagaggaggtggggggaggagaatyggggtttggaagggggagaggtagayggttygttataaagttyggatyggagattttaaaaygtattagtagttgttttatttttttataagygygygygtatatttattttttaaggagatttttttattatttttygtatttttttgttttttttttttatygtttagygttyggttttttagttttttagatttygggygaatttygagttygtttagtttttttttaygttttttttyg

SEQ ID NO: 6245 - DNA, 1009 bp, synthetic construct
  misc_feature 1..1009: note = Description of Artificial Sequence: Synthetic polynucleotide
  source 1..1009: mol_type = other DNA
gygtttgtagygaaggattygygtgggagygagaaatgtttttgtttagtgtttygygygttggatygygggggygagtttgagggtggagaggtygtygggtggaggygygtaggggtgygtgggtgggtgyggaaggagtgtagggtatggaggggaattttggggyggygygaaggaggagygtttggaaaggygyggtgtttggttatagaggggttyggagtgggagtgtaggggtgyggggagggagtgtagggaygyggggagggagtggaggggtggggaygtgttggaggggygygtttygatagaattggagaaattggaaaagtggaggggyggggtagtggttggaggaatttttgaagygaygyggggaatatgtgaaggagtgttatgttggaatttggaggggaggggggatgttggagaggtatayggtgatggatatggaaggattygggaggtgtggagtggtgggttyggttygtygygggaaggatatagagggatataggttgttttggagaggygttttyggatatttggaggggygtatagtgttgggatttggyggygtttggggyggaggggygygtyggatttagtygggygygttygggggtygggygtagtgggagttgaygggygtttagtyggyggygttttgggttyggttaggygtaggayggttttggtagyggtgtagtagtttaggttagtttttggggggtttttggttttygttttttygygygtttyggttagtatygttyggagttygggyggggaagtgggygttygyggtttgggaagttgttttttygttttggagtagagtygtygttgyggtygttgaggaaggayggagtagaggttygygttgtttggggagaagattgtggtgttatttygtygggaatgaagggaaatgtagyggttgtttgygtttygggattttaagaagtatagtaggtaaagagaatagttayggttygttatttyg

SEQ ID NO: 6246 - DNA, 961 bp, synthetic construct
  misc_feature 1..961: note = Description of Artificial Sequence: Synthetic polynucleotide
  source 1..961: mol_type = other DNA
tygtttttttygatatttaaaagtttyggttttgygtaatattgyggattttttttagtttttygttygttttttttttygyggggtttygtttagggtyggtttttygtttttaygtygtagttygggttagyggggttygtygyggtggygttygyggatgttgtygtattggtygttgyggtayggayggygtagtttygggygyggttyggtataggygtyggyggttttygttagttagtagttyggygaggygttggtttatttatggttttygggyggyggtttttgygtttagttttgygygtagttttygtttttygttyggggtygtygagttttygataygggygagatgttgaayggygtaggtttggataaagtttttaagatgtttttgtygyggaggtygaggattygttygttygtgggtgagttgggaggggygyggygagggagggtgggttyggggygggggyggygyggggygygtttgyggttatgygatattgtttygttygygtttygtttttttttttgggttttttgggttttttgggttgtaggattygtygaygyggygygttggtygtaygggggttgggygtygttgtatttgyggggttaaaaggttttaggtyggggygaggtgagyggygggygttagagattttyggttygtttttgtatagatgtgtgtgtgtgtgtgyggtttttttgtgygygtgttygtgygtttttaygygyggatgyggtttagggatgygatttaggyggtagttatygygatggtgggtayggtttggyggygtagagaagatgtagttttttttgtyggyggtyggtatygttgtgttgtagagtttaaaagtagagggggaaaaaggtattygaagggtttttygagtgatttttattatttggagtttygggttttygygygtttatagyggygayg

SEQ ID NO: 6247 - DNA, 961 bp, synthetic construct; identical to SEQ ID NO: 6246
  misc_feature 1..961: note = Description of Artificial Sequence: Synthetic polynucleotide
  source 1..961: mol_type = other DNA

SEQ ID NO: 6248 - DNA, 980 bp, synthetic construct
  misc_feature 1..980: note = Description of Artificial Sequence: Synthetic polynucleotide
  source 1..980: mol_type = other DNA
gygtgagygaggtaggtatatayggattygyggyggtttgtttgtaatagygttgggaatgtatattggaaaattatattttgtatgttgaaaaygaataattgtttgatatttgggttgttgtygagaaaattaygyggtagyggtaggtttygagttaggggtygttattttygatggaatatttaaatygtttatttttatygaatttttattttttaaaygtatttttygygygygtgtatatttttaaaygtattttygatyggaataaagaggggttttagatttttttygtgygtayggggtagtygggagggttaygagagggaggtgtgtgtaatggaagtatygagatagatagatagatagatgtttatgtattgttgtygattttttggyggyggggaygggagtyggaygygagggggatagatagggtgyggggataggyggttygygggggygggggggttatygagggggttattttggttygtttaggtygagggggttttttyggtgttttygaagygygtgggttattygtgtygtatgtyggygtagttgttygttgtggtaaggggggggyggtygggtttyggagygggtygggagggygyggggygygtatttygyggtaggtgagyggygyggttgtaggtgagtagtagtttyggttygygygtttagtttttttygtygygttygttyggtttataygtttttygygygygygtygttttygtttygygygygttyggtygttygttygttygtgggattttygygaggtygygygtttttaygggttagggttgttttagggtgygggtaggygagggyggtttaggggygyggggygaggggygaaggagttaggaggttgagaattgtatggtagttttgtttgtttgtygygttgygygttttattttagtyggyggtttygggtttgtatygggyggggtaggggagyg

SEQ ID NO: 6249 - DNA, 408 bp, synthetic construct
  misc_feature 1..408: note = Description of Artificial Sequence: Synthetic polynucleotide
  source 1..408: mol_type = other DNA
tygtattttttgaagttygttgggygygttttgggttgtttttttttgagtagtygggtttagagttaaggygygatgattgtygygtaagttagggtttaygyggtyggggtttttttttygtttygggygtattagaggttagaaagyggaaagyggttttgttaggttaaggtygatagaaatygagagtatgtygttatttgtyggagagaattgttttgttaggttgttataggtgatttgttygygygagttayggtttttgygtagagtttttttygaaggggagagttagagttattygygggtttggtyggggttttttttagttyggygtttaygtttygygttttgygttygtttttgyggttgtttatgtttaggtgtttyggaagaggygtygyg

SEQ ID NO: 6250 - DNA, 2190 bp, synthetic construct
  misc_feature 1..2190: note = Description of Artificial Sequence: Synthetic polynucleotide
  source 1..2190: mol_type = other DNA
gygtttygaaatttggttttttgygtttaggggaaygaggtataaattttygttatttagttttattgagtagagattgygagttygaatttttaagtttttyggggttttgattttttaatggyggyggtttaattgttggtaaaattttyggtttttgattgttttatygttygttttttaaaygtttagygaaggttgatttaggtggygggyggattttatygattttttaaattatatygtttggttaaaatygttygtttttttttygttyggattttaaaggttaggtttgtaagttagtaagttaayggtatttgggttttgggttgtttttgtgggttagggttattgatgttygygatayggattggatygygtattaygtttgttttyggtagaggttttattygggtggttgagygtagygtattggggtttygyggttygagagyggyggggaggagygggygttygtygagygtttttygggatagttyggtttggggatttaagygggttatgggatgtyggygttggtttttttttgagatttttttgttttttygtaggtaygagttttttttaaatyggttttttttttatattttygtgaygygaggtygyggttagtgtttaatattattaaagtttyggttttagtttagtttygggtagtttggtaggtttttaggagtttttgttttyggtttygggggattttgygtatttgttttaggttttttgggaatgggttttgggtgttaggtaggtttyggtgygtgttgtttttagtgtttagggtttyggtagtgagattttaattygatagttggataagggattagygattttgtygtaaayggatagttttagygyggattyggtttgagygttgatgttygygggtttaggttagttatttttygaggygttttttyggagaaagggygtagyggttttaagygtgttygttgtaattagtgttttaggttttygtygtagttagttttttygggttatagtttygttttttygygtgtatttygttttggtttyggaggttttgtttttyggtygttttatygtagttygttttaggtttyggtttttagtygygttttatttgtgagaagtagatagttgagtagygygtatagtaggatttyggtgttttagtagttgattatggtgagygygaygyggtttgttygttyggtgttygygtttttygyggttaaygattyggtygttagagttygttttttygttygtygtygtyggtttygygttttgagygttygtttygyggttttagttaggagataattattttttygggtaattttygtygttaggygttygttggtygttgtattygagtttyggagttygtttygagtygtygtygttgtyggggaggagtygagaggagtgttygtttggygygtttygagtttttygyggatttygatgaagagtagtygagggygggggygatttataatttttttttagtttattttttatttyggtatttttttttggtgaygttaaggggttttttattttttattygtttttttatttattttttttttttttttaggttygtttttttgyggttayggagaggggygggggtygaygagggygggtggttyggggtygagygygygtggggaggtgttggygaygygggttygggagygyggtttyggtaggtttagggtttttgtttygygtttttttgtttttgtttttttttttgtttatygygtttaggaaatttttgtagattttttttattyggtttatttagttttgggggtygttygaaattggggaagggataaggttgaagtttygtygtttggttttaggggyggaaagttygatttaagggaagttggtygygttttygygayggtgtttttggtayggaggattgaggygtagttyggttgtttttttttgtttgtttttttygygttgtttygtygtttttgatttttttagattgtttygagaagtttaggaaggtatyggagattttyggtataaggtattgaatttggagygtttgaggggaattgaygtttgtttggtatttttgggaagattgygaattagtttaggttttaggggagygtgttygtgtttttttyggtygtattgatgtattyg

SEQ ID NO: 6251 - DNA, 2190 bp, synthetic construct; identical to SEQ ID NO: 6250
  misc_feature 1..2190: note = Description of Artificial Sequence: Synthetic polynucleotide
  source 1..2190: mol_type = other DNA

SEQ ID NO: 6252 - DNA, 679 bp, synthetic construct
  misc_feature 1..679: note = Description of Artificial Sequence: Synthetic polynucleotide
  source 1..679: mol_type = other DNA
tygagtggagagtagyggtygtagygyggygttaggttygggttgggttggtyggygygaattttygggggygtttgggyggttaggtygggtggyggttgygtaygtaggagtattttttgagtttagtygttyggtyggtttgattygygggtgatyggataygagtaaygygtgygtttygatttgtgttttgygyggggtygggyggggatyggtygggggygtygygygttyggtygggttgattgtygggggygattttygyggggtaaggygggggygygggagtagygygtagttgyggggttattttatttgagygttttgaggttagggtyggggtttgaggatayggygttgggtttygggggaygygggtttaygtyggygttygagygttattttttygtttttygtyggtttaygtagtttyggggttyggtaygtgaagtgtyggygygaggttgtttaggttatygtatgggtygggygataaataatygtataggatatataatattttggattgttataagtttttygtaggaaaagataaataatatttgaggygttgyggygyggttttttygggttgaataaaaattaggaggtggggggyggtggggygaagtaaataatagaatygaagaattgtygtayggagtttgggtyggyg

SEQ ID NO: 6253 - DNA, 2013 bp, synthetic construct
  misc_feature 1..2013: note = Description of Artificial Sequence: Synthetic polynucleotide
  source 1..2013: mol_type = other DNA
tyggtagatttggagaygttttyggttttttgggagtttttgagggtttaggtygggtggggygygttttgyggtaagttttttttttttagttatygttttgaggagtagaaggygyggggatatatatatataygttygggtaygtygtygtatttttttaattgaattttggtgttttttttttgtttgtaaagatattttaggttttgggtttgggagttgttttygygyggttttgtttgattttagyggggttatagtagtttggygttyggagyggttttagygyggygtygygggtttaggtgggtgttttagagagygggyggttgygygattgaggagttggaggygtattttttygttygttagayggttyggttygygttttygttttatttttttygygtttttttttttggaaaggaaggtyggagttgtatttttaaagygttttygtttttatttttttyggttygtygygttttaggggttttataaatttgttgtaagtygtyggggttgtagttgtaggtaagggtgaggyggggtygyggtttgggttgtygagtaygtttttttttagttttaagygtgtaygttttttayggaygygtatttagtattttattttygtygttgttttygaggttttygtttaattagaggtygygygygtygygtygtyggygggtagatatatyggtttttyggtttgygtttttgyggttttggtttygttgtagygtttyggttyggttatatttatygtttygggygygtygttygygygyggtttygtttygggtyggtatttttyggttyggttgttttyggttttygtttyggtttyggttttygtttygtagggttyggtttygygatggtggtygyggyggygagygyggtagggagggygtgtgtatgygygtgagagygygtagygtgtgtatgtgygtgtgygygggagggtttyggtttttttgygygtttygtttttgttttttgttygttaygatgygatgtyggtagaatttttatygygygtttttattgttyggygtttatattygygtatataygygtatatttaggygygtatattyggtttygtattttygattygtttttttggagygtttataaagattttttgtygggayggtyggagtttgyggagygyggttttgggttttttygggattygtyggttttaggtgtttygttgtttttygtagggatttygygggyggttyggttttygtattttgtttggtygggtygyggtygygtttttagttygaatttgggtttaggtgtygattygggtttttygtattttygygggaagygtyggtttttttygyggygtygtygttttttttttttttttttagttyggttttttyggygtttttttgttttgttttatttgtttagttyggttttygtttttttygttgtttttygtttgtttygtygtygttttttttygygtttttttttttttatygttttgygttgttttttatatttttygtattatagygggtgtygttygtygttygyggggtttagggttygagygygtagtgggyggygaggggattygttaygttyggtttygtygtttttttygtttttygyggtttygyggttgttagtttyggtttggygttagggtggygaygtttygygttagtttyggttgtygttgatagtttttatttygttygggtttaaagggatagygtattyggttygatyggttttattygggggtttyggggaagggatttygttgygygggaatagttyggggyggtggtatagtyggggtygtgygggygaygtttttttygtygtygtggagttyggttttyggggttggaggtgagttaaggagaaggayggttagattaygttatttagggggygtttagyggttaagtttttgggtygataatgggtgtgyggyggtgtaggttgagygttttggattgygtggyg

SEQ ID NO: 6254 - DNA, 1501 bp, synthetic construct
  misc_feature 1..1501: note = Description of Artificial Sequence: Synthetic polynucleotide
  source 1..1501: mol_type = other DNA
tygaaagaggggygygggtgggygygttttttygygagtattttatttaagggggaattttttttagygtayggygaagttttttttyggttgttttatttggtagtttttttaggatttyggttagtttttaattggttttagtaatgtttagtyggagtttttttgggttttygagtgggagaaaagtgagagtaggtgtttttttagyggygygtttygttagggttyggtaggatttygtttttaagtyggggaaagttggtyggygtttttttttttygaygaagtygttttagggttgtttttagaggaygygyggtaggtaaagagaatgaatttgagygtttaygaaaygttttgtayggttttygggagttgggagaaataggtgttttttttygaygttygygggygaygtttgtygtattttgttygttgtygygtttttttygggtatttttygttttyggygtttttgttttygtttttagtgttagggyggaggtagtttyggttygtaggtaattattgttagyggagttygtyggggagygggggtgggygygtyggyggtgggygggygggygyggyggggygygggtataaaggggygyggygyggggtttyggagtttggttttygygtagtatgttygttagygtttygtygygtygttygyggtygtygtygtygtygttgtygttgttgttggtgttgttgggtttgggyggtygtygtttgygtgyggagtygggygayggygygtagatttgggttygtttttygyggttttttgttttygaggtygygggttttttttagggtatttttttygayggttttttttgggtygtgggtagygtygtttattagatygagggyggttggtagtagtayggtaagggtgygtttatttgggataygtttatttattattttttggtattttygggagattttyggaaygttagtttgtygttgggygtttygtygtygttgtagttygttatyggggaygtagttagygatagttataataaygtttttygygatayggaggygttgygygagttyggggttatttattatygtttttttatttygtgggygygagtgttttttaatggtagygygggygtttttaatygygaggggttgygttattatyggygtttgttggagyggttgygggagttgggygtgtagttygtggttattttgtattattgggatttgttttagygtttgtaggaygtttayggyggttgggttaatygygttttggtygattattttagggattaygyggagttttgttttygttatttyggyggttaggttaagtattggattattatygataatttttaygtggtggtttggtayggttaygttatygggygtttggttttyggtattyggggtagttygyggttygggtatttggtggygtataatttttttttggtgagtgygaggggttaggyggagggttayg

SEQ ID NO: 6255 - DNA, 668 bp, synthetic construct
  misc_feature 1..668: note = Description of Artificial Sequence: Synthetic polynucleotide
  source 1..668: mol_type = other DNA
tyggggtygttygtaygtaaygttttygggtygggttaggttggttagggtagggyggtygtttttygaggaattgygggyggggyggyggggttaagttgagygttygttttgttttyggygtttygyggttgygggyggagygggttttgyggagtttttyggtygtttttttygtagttttygtttttagggaaggtaaattaygtatyggttygyggagagaygtygtygggggtttttgtggtygygttgggggtygttttttggtgttgttttygtygggttgggygyggtyggggttgyggggttgtagggttggggggyggyggyggggtygggttgggyggtagtagttgttggagygyggygtttyggttgyggttattagtgtagggatgtgtttyggttygtttttattgaaatgyggygtttygtatagttttattttagtttttttttttagaggagggyggyggyggyggyggyggygggygygttttttttttttgttttattygtttataygttttttygttttttttttttttttttttttttgygtgygygtttygtygttttygttttttttggtagggygtatttattayggttgygttttaggttttttttttttttagygttttttttttatygtagtaatttyg

SEQ ID NO: 6256 - DNA, 1006 bp, synthetic construct
  misc_feature 1..1006: note = Description of Artificial Sequence: Synthetic polynucleotide
  source 1..1006: mol_type = other DNA
tygggygttttgttygttygttygygygttttaggatttaaagtygggttttaagtyggygttttaygtygaggtttygtygtagttttyggagttggtygtagataagaaggggagggagygggagagggaggagagtttygaagygagagggtygagygttatgygtygygttagtagagattatattaagtatttgygtggttyggaggagatgggyggyggtttyggagtttygtaygagggttttttgtaygtttygtygtygtttgygtygtattagttttttgtygtttttygttttatgttygtggtttttttggggttggggttgggttaggttgtttgtagygtygttttgtttttttattttagagygtaggtgagtggttatttttttaggggatygyggttgagagygtttatttttttttttygtatttggaaattgagtttggyggtagggttgggttatttagagtttgtatatttyggaagggaaagtgattttagaagggagagaggaagtgttgagtttggggataatttggygtagggttgtygggygtattttgtttttttttygtttaygtattttagtttttyggtgttttgggggyggatttttttggtyggaygatgggtttgaattttatttygttttttygttgggaaataatattggttttttattttttttggtagtgattgtatattttttttttttgttattttttatttgaagttaagaattaatttttgtttaygtaggaaaaaagatgagygtttttatttgggtatttattttttttttttygtttattattyggygggtttyggtttttgygtttggttgttttgtaggtgtgttggggttayggtgttggagggttgygyggagygggaggtygyggtgttygtgtttaggtygtttaatgggtgggtagaatgatayggygygattagagaggygygggttygggatgggggttttgyggttgtggyg

SEQ ID NO: 6257 - DNA, 867 bp, synthetic construct
  misc_feature 1..867: note = Description of Artificial Sequence: Synthetic polynucleotide
  source 1..867: mol_type = other DNA
gygyggaataaggygttgattgttttttagttttttttttttygygttttttyggtagtagygaaaattyggaaatttgattttggttttaggagagtygggttttatgaggtgtattgagtatgttttgtagggttyggygtgggagggaygygttggygttttttaggttygggyggaagyggygttygtaggygttgaaagygagygattttttgagttygggtggttyggygggtaagggyggygygggagattygtagggygygggygyggattyggggaattagggttatygttgygggyggatgggggttatygaggyggttygtttttaggygtatatttygtatatttttttgttaagtgaaggggttaaaatgtatagatgggggagtttatttaggaatagaggygygagaygtatagttatttttgggttgggagtaygagttagtagattttyggagygygttaaayggataatatgttyggtgttgtaaatagaggtttttgttggtagggatattggaaagaagggyggagagggagtatagygaaaggtggggatygtagaatttggaatttttgyggagatyggaaagaaaattaatyggagtattttttatatgtagagttayggaaattgttttggaaagagaaagtggtagygtttgggttttttyggttagttygggttagtyggttgygygtgygaagttttttttagyggagygggatyggtygyggyggtggatygtggyggtttttgtatttttgttttagtygygtttggaaatttgagttyggattygyggttgttgtaaaattygtttttagtttattttattgygaattttgttttyg

SEQ ID NO: 6258 - DNA, 1072 bp, synthetic construct
  misc_feature 1..1072: note = Description of Artificial Sequence: Synthetic polynucleotide
  source 1..1072: mol_type = other DNA
tyggttgygtygttttagtttagggaygttttygttttyggttgttatttatyggttatygagygttygtttygtttygggtttattatgtttgttgtagtttggttygtattagaggygygataataaataagtgtattggattgggttttgtattygtttyggagtagttgttttagagattyggtgttgtttatygygttgttattttttyggygttygggaggaagaygtaattttttyggagttttttttagagttatygggttgttaggataagttataggtatagaaygaygyggttgttgttygtttttttttttttttagaaattttaaaggatgtyggtgatagagagttttaattaatgaygattgtgygtygtatttggggaagggatatagaaaaaaattttgtaaatatygtgaggatgaaattgttaaagggatgtaagagttttttaaatattaattaggggtygyggyggyggygggttyggygyggagatagygtyggygggattttagygyggtggtygtygttgygttggggggyggaggatagygtaggagttgtagtygtygttttygttggagtagtygaggggtyggtgttatttttgttygtttttttattattatgtatagtgtgygttgtaagaagaaggygggagatgtatgtatattttygygattygttttttttggttygtttttyggygtgygttattgattaggggggaatgtggtgaagayggygaggaggagagtygaggggggaggggagggtyggtyggygygaatttaggtyggagggtgygaggagttagaggaggttggagggggyggyggttatagttgggtyggagaaagttgttttttatgtagatggtaattgtgagtatttttgtgggggggagggtgtagygaaggttgttagggatttygygatygygttttaataygtattggagygagtgtgygagtgattatgagtgtgagygggtgygagygttyggyggggttgatygttaygttggyggggtyggyggggttaggtagtttttttygyg

SEQ ID NO: 6259 - DNA, 1633 bp, synthetic construct
  misc_feature 1..1633: note = Description of Artificial Sequence: Synthetic polynucleotide
  source 1..1633: mol_type = other DNA
aygygygtatatatattygttttygtttgtttatttttttttygggggagtyggygygygtttttatttttgtygtatatttyggygagtygagttygtagygttttaggattttgyggttyggaattyggattgtagttttgaatttttatggtggttttttaaatattttttttttttttttttttygttttgattgtatygtttttatttgggggttagaggagtaaggtagtagtttttttagttagtttttgttggtttgttatygtttatttggtttataaaagtttgttgagygtagtttagagggttgygttgttygttttttyggttggtagaagggggtgaygttgggtagyggygaggagygygtygttgtttttggygggttttyggtttgaggggtaaggtgaagagygtatyggtygtggggtttatygagttggatttgtatgttgtattatgtttttttggatyggggttgtgatttttttttttttggggttgttgtttttttttttygtyggggyggatgtgaaggttyggagttgyggagaggttygttaggygtayggtgttaagggatttagtttggyggatattttttattaggagatygtaggtaagygygggygygttgtaggggtaggttgtagttttyggttgtygtaygttttattggtygttyggygtttttttttttttttttgttgttgagttggtgtttattttttgttatygttatgggatttygygttttygtgttgggyggyggatgtttttgyggttttttyggygggggaaggtgtgygttttygtygttttattgtgtgtataygygggagtattttggttttygtttttygttgttttygygtttttttattttttagttgatggtttaggttyggttggttagggagttygggttatttyggggyggttgtaaggygtagayggagagtygagtygggygtttatttygygttttggttygggtaaatttggaagaattgygatygtagtttgtttagygttatagtttgagtggygttttttttattttygtttttgygtyggtaggggyggtggagagaygyggagggtttttttagttttttttttttttattygtttttygggygatagagygttyggygttygggtygggggygggtaaggttgggagggattttygtyggggatttggtttttggaygtyggygttttaaggttggtttggggattttaygggttgtttgttttagatgtggggygggttttttygttagggttttttagtgtttttttagttgttgttggttatttagggttyggggatattttgttattyggtttggagtyggtttygtttgttagygaatagttaattttagygggtggtttagttggggattygggttygggttygggggtttygtgtttttygtatgttyggttattggtattgttttattaagagtttgagagygtttattttttttttyggygttagtgtgtgtagtatttggttttygataatttgygyggtagtttgggtgtttgtttttyggtttttagttttaatygaattygagtttttttggggttttgtgaatgaaaygtgtyg

SEQ ID NO: 6260 - DNA, 1143 bp, synthetic construct
  misc_feature 1..1143: note = Description of Artificial Sequence: Synthetic polynucleotide
  source 1..1143: mol_type = other DNA
tygyggagttttygyggagatttgttggagttaggttgtttatttttatttttttattygygygttggtttagaggtttatttaggtagyggttttggtgtygagggggtaggtgtagygttgtagtgatgtttagtggtttygtttttagttatttgttttttaatatttgttagatgtttaggyggggtaggttygaggtgtygtyggttttgggttttttaagttagtttaggggtatttygyggtaggygttttygatatttaygygtaggaatagggagggygtatygyggttttygygtttyggttaggtyggtaaggattttatygtttygttttygggtggaggygtttttttttatttttttttygygyggggttttygttygtagtttttttagtagtttttttygtagttttagygtttttgagtygttttggttyggatyggttaaggaattaaygagygygtatygygggtttygggygtagggtayggagtyggtygygtygtagtttttygggtatyggyggyggtgattaatttgtaattttagygtttagagttgttatggtgttygygggyggyggyggyggygatagtgggygatyggtaggattagtgttaggygyggygtttagggygggyggggaygygggttttttatttayggyggtttagtttaggtagygygttyggttyggttggggtygyggtttaygttygtygtgttatttattgagygtygtygtygtygggtaggttgggggaggggtgggagtyggagttttygggtttttaaaaaattattattttatttaaatttttaaagttagttttgttatagggattgtagtgatgtygaagggygggtatygtagaggaggttgygtygtagttggtggggagygttagggtyggtattggtagtttttttttgtyggttgttattygtagttagttttatagtaatagttaggtttttatttgygagtttttttygggggtttttygtatttaatagtayggyggyggtgtgtaygggagttygtygggtataygyggggtatatttaagtgtattgttaggaggtygggagtttagygtgygagygtgaggttagattgtgtayggtatyg

SEQ ID NO: 6261 - DNA, 1143 bp, synthetic construct; identical to SEQ ID NO: 6260
  misc_feature 1..1143: note = Description of Artificial Sequence: Synthetic polynucleotide
  source 1..1143: mol_type = other DNA

SEQ ID NO: 6262 - DNA, 1371 bp, synthetic construct
  misc_feature 1..1371: note = Description of Artificial Sequence: Synthetic polynucleotide
  source 1..1371: mol_type = other DNA
tyggttgagagygtatggygttttgagtagtgtaggtttyggtatygagggyggaaagygttttgagtttatagtygtaygatagatygtyggtttgggttttttaggaattttttgtagttttgttyggttttygattttygttatttattagtttttttaggtatttaagagttttttagyggygggttagggtyggttttttttagtaggtttttttggagagygggaggaagataggaggygttttttyggtggagggttttttagygaygtagttaggagygttaggaggttataatyggaggagaggttggygttttagttttagttttagtttygaagygattttttttttttygaggtggttttggttaagtttttagttattttygttaaatgaggaggtgggygggatgtagayggtggagygggaggtttgggygygttagtttgggagttagtgygyggggtagggygaygggtagygyggggaygygaatttttaatttttgygtttaagaygaaggattyggtttygatttttttattattyggygygtattagygttygtttagtgatttttaggtttggtggtggttaggggtgggaggtgagtygaaagggaaaaagttattttatttaagtygtygtygggttggagttagtttgygygggtttygagttttyggygayggygttagtttttttygttygttygygyggtgttttygtyggtagttttttyggatttygygttttttttygggygttygttttttyggagttttaaygtttgtgygygtatttggtagtagagatagtagtagtagtagtagtagtygyggyggygatagtgttaggggtagygagagygggttagagtttatggttggtggtygggttggtygyggattyggayggtygggagygggygyggyggtygtagagayggttttttttygygyggttttagygtagattttagatttggagtygtgygggyggagaygygyggggttttttttygtttygtygtygttgggtttttagygttttyggattygygggaggataggaattattyggagtgaagttgygttaggtgygggygggygggygggygtgygyggggyggggygtaygtgyggtaggggaaggggttttaggttttagtttttagygtygggygagtttttttttygtygggttgggtgtttyggtyggyggygttygattagatttgagtaggtgttgttattattattaggaaggagagggatttagtttttgttttaggttttyggggygtgtgtagttttygtagggggttgggattatygggttaggygggygtygtaggagagayg

SEQ ID NO: 6263 - DNA, 1545 bp, synthetic construct
  misc_feature 1..1545: note = Description of Artificial Sequence: Synthetic polynucleotide
  source 1..1545: mol_type = other DNA
aygygaatttygygggtggtttygggtggtgggttttttttagygygtagttttygttygtttttttttyggygttgtagtygygatttgggatygaayggatatygttttttyggggtttyggyggygttttgatttttattttttttygtygtagtttttggtagggtatttttttggygygaygtygygttttttttygggatygttttttyggttttttagggtgygtttagttgttgttygtgygtttygttagtttgagygtttygggygggyggyggtggagaagtttagtttagttttttttagtygygttttyggttygygttgtttttagtttgtaagtttatgaygtggygaygtygatygagatataaagatygaggttgagatygttaggggttgagggtgaggtygygtttyggggtygttggagygygggygttatgygagattgtttyggttgygygtygttttagaggagttygagygttttttttagtygyggygygttggttttggtygggattgtagttaggtgggygtygygygtgtgagygtygygygtgtgagygtagatttggattygggyggyggaggygaaagtygttttattygyggggtgtaattttgggygyggaattygggttgtygggtgatagtgattagttgattttggagtttatyggaggygyggtatyggaggtygtgyggattattgtygaatagtygttggagattygtagagaagggygggttttgygttyggggygtttyggaggtaagttyggagagttygggtygggyggagggygggagygtaygagtgtgtgtgtgtgtgtgtgtgttygyggtgtgttygyggttyggtgtataygygygygggttgtaaagttaggagttgygggagygtttttttgtttyggtttggtttyggagtattgygggtygyggaggtgtgggggtttttgtygttgygtttagggtagyggyggaaaaggtgtgtgyggatgyggggyggggtygtatttggtggatagagtagggattygggaagagaagttayggaagatgattatgtagtttggggtaagtttttttggttgagtatygttttaggaaayggtgttttgagggttaaatatgtgagttatttgtgtaaaaagtttgatatattagaggygygaagtaagatggaaagttggataagttttaggtggatygatyggtgtatttaatttttaaattgagatttttagttaygttgatgtggaatgggatygttgtttttttygagggtttgataaggatgtttaattttatttgttagaaagtaygggagttgggtttggttygyggggagygtaagttygtttataygyggtttaatttaggtaaatgtagtatgttygatttgttttgtygttattttttygaaagygataatttttttgggttatygaatttattagagtagttatttgttttttygtyggyggtgyggggagygtaatatttgagtagtttaatttttatagygyg

SEQ ID NO: 6264 - DNA, 1545 bp, synthetic construct; identical to SEQ ID NO: 6263
  misc_feature 1..1545: note = Description of Artificial Sequence: Synthetic polynucleotide
  source 1..1545: mol_type = other DNA

SEQ ID NO: 6265 - DNA, 1027 bp, synthetic construct
  misc_feature 1..1027: note = Description of Artificial Sequence: Synthetic polynucleotide
  source 1..1027: mol_type = other DNA
tyggtttyggttttagtttygataaygtttttagtgttygtagaagyggttttyggatagygaggatagttygtygtygtaggtttattyggygtttgatggatatggtggttaygttttggagtataaygtattgtattttattgyggagaggaygggttagagtatttygggtttttyggttggggtaagggttagyggatgaggggaaaaggtggggtaagtygttgyggggagaggattagtgyggagggtaggattayggttagtgtggagygggtgggtagaggtggaagyggttggtgggygtgagggggyggagtygggtagttygtggggyggggtaggaggygagggagggggyggggttgggggyggagygtatttgtggttgygtagtaggygtattagygttttggygatgaygtttattttygttttgggygttaggtggaagtagagttgygttatygttattattatygyggygttgyggttttgtagtaggggtttggtgttgygtagtagtagtyggtggtyggggtttatgatatagggttttygggagggggyggtygyggyggtygtttttttagatttygygtttttggtttygtttttttttgagtygtagaaggtttttttygygtttttttttagtagggatttttggayggggagatygaygggtttgtgggygttttttygggatatatttyggttygttttgtttgggttgggtttatttaygttttgggtggggtttaggaattgygtgygggygtagygggtgagtatgttgatgatgattatttggttttatttttttaygtygattagtaggttatagagttttyggtagtttttgtgaattaggtygatgygtttygggtagatttttttaaaggttattattatattgttygttattagttggggaaagaataaagaygagagggtgaaygygaagggtggaaggtyggttgtyggttattatttttttyggagygtttttatataygtatyg

SEQ ID NO: 6266 - DNA, 693 bp, synthetic construct
  misc_feature 1..693: note = Description of Artificial Sequence: Synthetic polynucleotide
  source 1..693: mol_type = other DNA
aygaataaaygttttattttygggtagtyggygggtgyggagygagtattygtggggygggataagtgyggaagtygttgygttttygtttttttattttygggggayggttatttttagggttttygaggagttygtttygtgtatttaggttttaggtyggtttttaagttttggttygtygttatattagyggttttttattygtaagtataaatgtgatatagatattagtttttygtgtttttggtttttagggttttttttatygygttttagtatttgtagtttttttatttttatagygttygtygtygttaaggtaatagagggatgttyggtgatagattyggygtyggttttyggygtygtaagagaagygttygygygggygttttggattygtagagttttyggygttttygaagtttttggtgtggtygggattygggagaaggagtagggttggtggggttgttgtagtyggtgagtgtgtgttggygttgggggttggaattttttaggttagtttttgggyggtgtygtaggattttgttygttgyggttttgaggyggaaataggggttggggtygagygygggttggaagttttggtttttggagtgtygtttttagtttggggtygaggyggtygtttgtgtagattygggatttttaaatagaaygaattyg

SEQ ID NO: 6267 - DNA, 1496 bp, synthetic construct
  misc_feature 1..1496: note = Description of Artificial Sequence: Synthetic polynucleotide
  source 1..1496: mol_type = other DNA
aygtygagygattagatgtaaaattttttagygtttgaaattatygyggaygtygtygtygtygtygtygtygtygggtgggagtygygaggagygtttagtggygyggtttgtygggtatggtggtyggttyggygatygttgattygtygggttygggggttttggaagygaggygygtttttygatttygagattttgtagggttgtaatagayggtggggaggtaaaaaaaaaaaaggaaaaggaaaaaatggtgttaaagttattaagttttatttattgggtagaattaaaayggatatattaygtatttgtaaaatatatatatttatttttatatatatatatattyggagttygaggaaaggaagagaaggaagatgtagtaggagttgtagtagtygtygygaatggttygtygygyggttgtagaaatgtataagtgtttygagttttaygaaaygtaygggttatyggagygtttttttyggtttttttttttttttttttttttttttttttttttttttgtygyggtttttttttttygtttttygttygggttgggagyggtaggagagyggaattttttttttttttttttttttatattygttttttttttygtttgtttttttttttttttttatttatttatttatttattygttggttygyggttgtagtyggtatygttattygtagtttygyggtagttygttygttttaygtttygtagygyggygttygttagtygtagttygggggaaatygagatygaagggaaaaagttgtatttgagattgygagggtyggggttggggagggagagttggygagttggttgtaygatayggaaaggygtttttttttttattttttggttttygygttattyggttttgttgtaattyggatygyggtaggaagtgaaatgaaygtggyggaggtgattggggagtgtttttaagttttgggtggggggygtttttaagtttgggtgggtggggggygtaggtttayggayggygayggggggtgtyggagygtatagatattttagagaagtatttagagtyggggatygggatygtagaygygtagtttttggtttgaatgatatttattttygtaatttagagtttggggttttggttttggttgggaggggattgygggatatggtaygttaggtgtttttygtgttygttgygtttttttggaggtgggttttgtattyggttttgagtaggtatggatyggggaaggaagaaataggggtygaaagggttgygttggagagtygaggtggtttygggygagttgtgygtgtaagagaaatggtygggggaaattgagatgtaaggggtatattttggtaagygttaygttagtatygttagaggtyggtttttygggtttagttttygggtgagttgagttggttgtygggtgagggggygggygggttgtttttttyggattygggggyg

SEQ ID NO: 6268 - DNA, 5820 bp, synthetic construct; identical to SEQ ID NO: 6021
  misc_feature 1..5820: note = Description of Artificial Sequence: Synthetic polynucleotide
  source 1..5820: mol_type = other DNA

SEQ ID NO: 6269 - DNA, 699 bp, synthetic construct
  misc_feature 1..699: note = Description of Artificial Sequence: Synthetic polynucleotide
  source 1..699: mol_type = other DNA
tygtggtgggygaggtattyggggtttttttttttttggtttaygaatttttaatttygaaygttgtgggattgtatgggtttttgttygggttaatgaaatgygttgtygagaggaggttgyggygyggtttgaggtyggatttttataggtyggagagttttttgtyggtygyggtyggatttttygggaaatgggattagagygyggagggagtttggttaggaggttttttaggatttagtygygaygttgaaaagtatgaagggtyggaattaggtatttatttagygagygttattaattygaagttatagygttaattttttgattyggtygtttttataygtagygtygggattagaggygyggtygtygttygtttygtttttatattttaaaygygttygtttygygttttygaggttgygggtttagggttaattygtygygtygygttygtttggttygagygygyggygggtygggttyggttagttggggygagtyggtttgttygttggttygggygttyggtttygggttgggtaaggagygtttggttatgagtygygggatagtttaggygggayggatgygttttttagggtttaggygaggtygygyggtgtagaatygtygggatttttttaattygggtatgygtatttatagtagyggtttttggaggtygyggyg

SEQ ID NO: 6270 - DNA, 1845 bp, synthetic construct
  misc_feature 1..1845: note = Description of Artificial Sequence: Synthetic polynucleotide
  source 1..1845: mol_type = other DNA
tygttttttygtygygygttgggggttgtttttaggtgttggtttttgtgtygagaaaattttgygaggaggygagggagttggataaagagygggygagggagggygtttgttagtttgaggggtgygtygggyggtgygygtatttttttgggtttagtttygtattyggtygttygyggtggttagagtttagtttttttaggttaggagtggygttyggttgtattttygygttttygggagttgaataaagttaggygggagaagtaaaggttagygtttggaygttggagttggtgggaggaggygagtagaggygyggagtaaagttgttaaattgygygyggagtygggygtggggygggggaagggagaggagggagggaggggtaggygggagtygggagggagygagygggttygtygygtttgagtaatttttgtttgtygttgtygttgtygttgtygttgtygtygtyggttyggattygttyggagygtagggtgtttgtttagttgygygyggygygyggaggtttyggygttygtygttgygtttttyggtttttgtttttygygtyggttygygtgggtttyggygggygygaatttattatgtagttgtagtttyggagttggatgttggtygygtttaygttgttygtggttttttttattttygtagatattttagagatygaagaagaaatygggtaaatagttgtttttaggttygtgttaygagttttggygggatttttttttttttttgtattttttatttttygattttttttgtgtgygtygygtttygttgtagtttygttggagagatggggayggtttggtagaaggtggyggygataggggttygggayggtttggggagaggagggtgggggygyggttgttgtggggtgttttygggyggggtttaygggaagtttttagttggttygygtygggaagyggattygtttattttgtttttttgtttggygtgtttaagygtagtgtygtyggggtygagggagggygtyggggagtgtttygggygggyggaggggtygagagtggagggaggtaggagtttttttgtttttagtayggtygttttttygttttggtaaagtgggtagggggygygtagggatttttgagttgggggaggggtttttggggtyggagyggagggyggggttttgtatgggttattgggaagyggaatgttttttgtatatatagataggtataygygtttttygtyggttygggagttyggygtaggagttggtattattagagaagggttygtatagttggattgagatttttygttttygtttggttttggaygtttagttaagttayggtaatttyggygattttgggtttttgtgygttygtagygyggagayggagatatttygggaaagtttgtatygtygttyggtgggtttttgggtttttaggygggygatttggygttttttttttttygatttygttagaggtagggtgggatygygagttyggattttttyggtttyggattttttggagtgygtatttgaggygygggaygtatyggttgtgtgttttaggggttgagattygygtttygtttygtagttttyggttygtygggtygggttttttttyggaatttttaaagggyggtagaygataggtggggaggtagtyggggttttgaggaggttygaggagagttttttggttttgggtaaggggaaggtgaggttttaaagagggtagaaggtttttttttttgtgggatttgtgttttgttaggygtttttttygagtttygygtygygtgyg

SEQ ID NO: 6271 - DNA, 1844 bp, synthetic construct
  misc_feature 1..1844: note = Description of Artificial Sequence: Synthetic polynucleotide
  source 1..1844: mol_type = other DNA
tyggygattttttggtattttggatagtttttyggggagtagtttatygttaggyggyggttgttaagagaggaatttttttgaygyggagtttgtygtttyggggttygtttttyggtaggttyggggagaggtggggtgataatgggttggggtgygygygtgttttataggtgygagatagagygagtygtyggggtgtgagttagygygttgggggttaagaagttgggtgaatagttayggaattttatttaygttyggtttttttatttatttygtttatagygygtgttttagtttagggygtgygtgygttyggtgttygatttygggttgtgtgtgtttatttggygagatgtygagagyggggggagtgtttttgtyggtgtatttgggtttaggttaggggattttttttttttattttygygtgggtgtgggggtgtgttygggttagggygygtgtgtttttgtgtttgtgygtgygtgtgygggttagggtggtgggatygygtattagggtagggtgtttgygtttgygtttgggtttgtttggtttgtatgtyggygygatttygatttggattygtgtttttggatgtygagaggttagygtggtgggggtgtttagtttttyggaggagtattatgttttgatattttygttttatygttttaaagttggtttggggtttygtagggagtggtttgtatggggagggttygygtgttgtgtttttgggaggggtaagagagtgggggygtagggggygggttaggtttttgggygyggygygggttygggggattygygyggttgaygttaggttattttttaaatagagtyggtagygygtttygttyggtatttttygaagagttagatygyggtyggygttagygttatygttyggtttattygttagttygtatagtygygtygtygtygagygtttygtgagyggygtttygaggattaggaatggggtttygggygttgggygygtttygaattyggygtaygtaagagtttgggagygttygagtygttyggttgttyggagttttatygtttaggatygggagatgttggaaatgtaatygtttgtttttygaggagtygttgttttygggattttttggtattgtgygtattttggttagtagttttyggagaagayggygtttttaaygttygattygygtggtygtggtagygttaygygagttttttaggygatygtagggttatagtagtttagtygtyggtgttttttyggaaattatgattttyggygygggtttatggagttatggtttatagggttttgggtygygyggggttattttagtygyggagggygygtaggttgtttttygtttttaygttttygtttttttgtatttatttgtgttatagttttttgtgttgttgygaygatttgggtyggagtygttttttyggygygtttygttgttttygyggttttagygygggyggttagaaatttttttagaagtttygtttttgtgattttttygggtygaygtttagygagtttagygtttttagygygttygtygtygtygtgttygtttttygttttttyggttttaattatttyggtttatttaagttgggtattaagyggttgttttaagtttttattgtgggygtgaagaaggggggtattygggtygtgttggagtttattygagtatattyggaygtgygggttttgggtayggaattttatttttttgataggaattayggtygygggttggattggtataggtaaggattaggagtttygtttygtgygtygggtttttgatyg

SEQ ID NO: 6272 - DNA, 1480 bp, synthetic construct
  misc_feature 1..1480: note = Description of Artificial Sequence: Synthetic polynucleotide
  source 1..1480: mol_type = other DNA
gygggtgyggtttttygggagttygygggatttttttattttttattttygtttgggaggttyggygtgggttggygatgggggtggaaggttttygggtttgtggatttgyggtaggaggggyggttggtagtaggagtttttgtattatttttatttttaggggygtttyggggtgggtgggggtatttagtgtttygygaaaggaagaggaggagggggygagygtggagatgagtttaggagyggaaagtagygygygttttttygatyggtagygggggtgggygttttttyggggygygggagygtttttaaagtygyggggygttygtagygggtaggagttttgttttgtatttttttayggyggggygtttygtaygtttttttatgttggttttyggtttyggaayggygygygttttttgtttyggaaygtygtttttagttaggyggagygttgggagttgggtttaggyggygggaggagggygaaygggttyggggttygggtttygatggtygygtygtttygggggagtyggagtygagttggtygtygttygygygtatttattaagttygttgagttttttttygtaygagtattagatgtyggtgtggaaatttttgaagaggaagyggtygtygtyggttttttagttgtagagygygtygttaggggggtygtttttygaggyggtggyggyggyggyggyggyggygggggyggyggtgtygttggtygtggygttggygttygagttggggtagttggygygttygttttggtygtagttyggtttggggattygttgygtgttttggtattagtgygtggtgaggaaagyggtggtggygaatagtagygttagtaggtttagggttayggttaggagygttyggtygyggyggttagtttttatgtygttygygtygtygggaygggattgtatygtyggggagtttygygygygaagttggtagttggygtttygygttagyggtygttgttygtygygtttyggggttygggtgtttgagatyggyggyggyggaygyggygygggtttatgttttttttaatttyggggtgggggygyggygyggggggygtgyggggygggttggyggggygggyggyggtggaggagyggttayggygygttyggagttyggagygygagtgtatttyggttaggagtygttggygtttggtagyggttayggygtagggaygygygttttttygtggggagatatttgtaggyggtyggygatattgtttyggagttygttygtayggggagagggggtygttaygtygggygygggygggggtttgggagtggagggaygttttygaaagaaattygagttagggtgagggtttgagaygtaaggagaattttaggtaaggygtttttgagaaaagatttttayggyggaygtggggtaataaaattygtygggagyg

SEQ ID NO: 6273 - DNA, 5065 bp, synthetic construct
  misc_feature 1..5065: note = Description of Artificial Sequence: Synthetic polynucleotide
  source 1..5065: mol_type = other DNA
aygagtyggggatttgggggttygggyggtygtagtttagtgggttgaggtgtygattagggttaygtttyggagttttgtyggggtttagtttttttttttatattttaaaatgtygtttagggygtgggtatttygagtggtattyggagtygttgagatttygtygagattgttttttgtgygtttttttatagtygagaggttagtatygtgtygggaygattyggggattygagttygggygtygttatatygtttygggygttaggtttgggagttttgaggtyggtatygtgaaatatttttaggagtaaggagggattttaggtgttttttttttgtattttaattttttgttyggattttttttattttttgttatagtttttatatataaattttgttttggatttgtttagttttttygggatttatagttgtygtttttatyggagaaaataagtgtttttgttttaggggggattttattttggttggttattygtaaatttggaaaattattttatgattttttttttgatttttttggaagtagggagtattaygattygtagagggygtatatygattagaaagattttggggggtagagggtgtaagtgttgtgggaagagatgyggagataaattttgygagttagatttygatatttttttygttygtttgtatygttttyggaataattggyggttagtagtattttttatttyggtygtaattttagygggttaggygttggygtttygatattagtttttatttttttgtagttttgaatttttaaagatattyggttttgtttygtaggtygagggggagtgtgygtgggggtaggggggygtagygaatttttttaygttyggagtttagtttagygttygaagtaaatttttttatygttggtagtaaggtygggyggyggaggtygggtygggtgttttggggtyggygtygggagygttaggggtttygtgyggttaggtyggggygatttttattygtatttaygttttatggggttttygggttttggtygyggttgggattttyggaaaagtagggayggagaagttaggtyggtatgttygttttttttttttygggaggatttaataatttyggaaagattttgtygggagatgtgttygtttttttyggggtagygggggaaagtttagtaaaggtatattgaaaattaaaaagaaaaaaaaaattaygtygagtggaagaagtaatyggggtygyggyggyggtgaggtagggggygygggggttagtygygtgtgagtgggttygagtgtgygtgagtgtgagtgygtgtgtgtgtgtttayggygygggtyggagtatttattatttygtygggggagygaggttatttyggggtyggattggaaatgttgaggtttygtttgtttttttygygatatgttggtttaaatattagttggggtagaataaaaaattattaaaaaaaaatttttttaaaattayggaaatygagyggyggyggyggyggyggtttttttygttygtyggttygttygtttttttttyggtttttyggtttygggygtagygygtatgtgttttgttataattatgattattaataatgtattgygattaattatagaggggttttttgaaaggygattggtatygggttagygttatttaaattygttygttttaattaattagttygtgatttgttgtagatttttgttttttygygygttggtttaataagtyggtygyggggttggttttgygygtygygtygttygatattgggttaattttttttgygatygttygggatttygyggttyggtygtygggggtyggttttttttttattgygggttyggygtttyggtaggygtttttygttttttttttttttttttttttttttttttttttttygtttttttttataatttygggttgggtygatttaaattagtatgtttttttyggaattgagtygtttygggtggggggtggggtygggyggygagggttggggattygggttgtyggygygttgygaattttttaattygggggygaggygygtyggttygyggggggagggagtttygyggygggattaggggggagggygtttygtttygtgagtgttttttygtttttttaagagttattagaaagtagtttatttttatttttattaaaaaaaaaaataagygagtggggaagagttagttttaygtyggttygtttttygtttayggttyggtttttttttygtttggttyggygttttttygtttygagttttttattttttggatttygggttygygggggygyggagaagaggatttaggaaaggtttgggaatttgatgggtttgtggttggggggaggggtagttttttygttattttatttttttttygttaggggtattgattttttagttttttgtttgttttttygttttttttttttatttyggatatttttaggataattagggttgaagttttygggagaagtagtttygagttygtgggataagggggyggttyggtttygtttaggatttttttyggatttttttttyggttgtttyggttggttgtagggygygttatttygyggggaggyggyggtagyggtggygtygtagagtttygggygggyggagagyggggatyggtttgggtttygagtttagtttyggtyggggggaggggaggggttgyggtttatattgagygtagtagygagtatyggtttagggagatatagttygggyggattyggtattggattgggttagtttttgggatttttgggtatttygttttggggagggggtygygttttagtttttygggaygaggtggyggygtagagtyggaaagyggggtggggggagggyggtggggaggtgttttgttygaggttgtttggyggygtygaagttygtttttattttttgggtatttgtygagygyggygttygaatttttygttttattattattttttttaagttgagatgtaatttttttattttygttttagagtttagagttaggagttygatttttttgtygggtttaggygttygygaatttgagattyggtaygyggtttagtttagtttttttttttygygtttyggggttttttygttttaaggttttygaagttttgygttygaaggattaaattaaattaaatttyggttgagtaatgggggaggaggggggtgtagatatataatttttgttttattttaygattaggaaaggagagggtttataaggaygttttaattygygagygtttttgagtttggtyggtgttayggtyggttygygygaagtgggtatyggtttttygagtygatttygtgtatttyggatttgtattgygtttyggtagaggattttttttttttttttagttttttaaatttttttttttaaggtgtaaatgtgtgtgtgtgtygatgaatgtttttgttttttatttgttgattttatttttttttattggtataattttttttttttttttttttgttygttygttttttatttttttttttatttattttttgttttygtttattttttaatatatatatttatatttttttygtttygttttttygttttygttaggttttgatgggtatagtagattttgataaaaagataaaygaagttattagtggggttgatgttgaagaatgaagataataatgtttttataggtggtgttttaaatgttattattttttattgaatatttaaagagatttttyggtaaagatggatttgygtatttttggggtgtgagyggttygtattttttagatttyggggaaygtgtaygggagtaygtgtaaatttygtattygtttttattttataaataggggttttygtatatttattaatttatattgttttaggtataygaaygygtttgtgtgtatttgtatatttttttttyggaatgtgttygtgtttggagtygttygtatttttttttaataattttggttttttgaaagttygggtttttygggtatygtatgtagttaggaatttagyggagttggyggtttygtaaagttttttttttggtgygygtygygtgygtagtaggaagttttygggaataattttataygtgtttgttatttggtttaygtgtgatttaagattaagtgtaggaaaaaaaaaaattttttttttttaaaaaaatattataataaataattaaaygaaatgaatatgygaaaagtagttaygygatgtttaattaaaaatgggygagtagagaygaataaattgggggatttaaattttaataatttttttygtttttttgygttttygayggygtagaggygggygtttygatttgygtttggygtttttygttaattttttgtttgttttttttttttyggtggtttygggaaaggagatgggaggtggaggagggggggatgggaggagggggatggtyggaatggyggggagaggagaattggtttttattgttgatggtaatatattaattaygggttattgtttyggttttaagtttygtggttygttggtgygggygttgtagtgttagggygttggygaggtttygygtgtygygatgtaaagaaatatattaataaaaatagaagtagagtgggggttattttttatttttgtgygggtygaaagtaggyggygagygggagtgaggtgttatttttggagtttttttaygygttttgtttattttagagatttgygygttttaygtgyggtagtatttttttaattttgggtggaggtggggtgggggggggattattggggaattygggtagygaagtttggatttgtaggtttygttagagggtttggtatttaggggttgattygtaatagygaatggggatagttygaagtgaggyggtagttgygtyggggtygygattttattggyggagaggaatygtattygggggaggygtttggyg

SEQ ID NO: 6274 - DNA, 2372 bp, synthetic construct
  misc_feature 1..2372: note = Description of Artificial Sequence: Synthetic polynucleotide
  source 1..2372: mol_type = other DNA
tygygattgygtaaatttyggttttgatattttagttttaggttttaatttyggaagggtttaggtttaagtttgtaygtygygttgttatggygatygttggttgtttttttygttttgttttttgagtaygtggtattaggatttygygttttttttagttygagagttaggtttggtttagagtygggtttattagtatttygtttgyggygttttttygatttttygtygtgttttattaggttygtttatttagtagygatagattttygtygttygygygattttatygtttttattttagttttttttygagggttygtagttygttttgttttygagygtgtttagyggttttgggtattggygyggttttatttagttatgtagtgtttttttatatattggtygyggttattggttgtagattygtygyggaaagggggygttttgagtttygttygtaggtagygygtttygagagattygttttaaggtattttygtaataattttgtgggggtatttaattttttygtgygtyggttaagatttttttatgttttttgtaatgtattagattagggaggtaaatatygaaggtatttgtattgygtttttattgggatgygttgtgygtaagagayggggatygtttgttgtaaaatyggatgatyggagaygtagggagttaggagtgggtttttttaggatttattttatgtagtttttatatggtttttagagttttgatttygtggttggagtgtttgtttttttttaagtattggtagtataygggtattttgtattgtaygtagtatatgttgtggttttttagttygtggtttgtgtaggtggagattttgygtgggtttagttttyggtttataygattttgggtygggggtattaggyggtgtttggttaggggttttyggggygggtggtagygtaggyggtayggatygtagtagaagatatygtattgttygtatatgayggtggtttttttgggygttttttygtagagttggtatttgagggtygyggttttgttttgttggtagyggttaattattttttttagtaygygatttttggggaagtygyggagttttyggttatttaggatgaggttgyggtgatattgggggtaggtgatataggagttgyggggtatyggggttagggtyggtgataagtgggtggtyggtggyggtatagtygggggaaataygyggaygtygttgggggatttttggtayggggtagtgggggygttggygaatttttygtaggagttatagtygttgttygtttygttgtataggtttattttgtttaggtttagatagttatagtyggagatttyggagttygyggttygatggttttggggggatttagattttggggtttgtattaggatgttgygggygtaygtttgatataaattgtgagagtagggtaggatgatgggttttygatagaaggagtygtatayggggtattttaattttttttttattttttttatggggatyggtttgggaggagatagygayggttgtagygggtgtttgagttggygaggtggtygaygggttygttttgtttagtattttggttagyggyggyggttgtggtggtggtgttttttygygtagtattggtayggatatttagagaggygttagttttgtgagtygtagtygygtagtygtygygtygygygttagttyggatygtttttatttgtttttttagtttygtttyggtttatgagtagyggtttattgggyggggggtaagagatygaagtttttattggttattagattygttygttttttygttttygtaggttatagggggttyggtagagtttgaggatagggtagttttygttygyggttgtaagatttttgaagggggtyggygtgyggaggttaggggatygggaaggaggagttaggygggatgatttattttygttyggtttattttygattttyggtgtagttttttaggagttgggggygtgagaaattttttttygtagygagtgggttgtyggagggggttggggtttttygttagygtttgygtttggtttttagttttgagtttygygtttatttatygygggygagtgttgygtagtayggaggaygttttttttttttygttgttggtagttttygtaggygttttattygggtttaggtttttgtayggtagtggggttttttttttttttygtgaattygttgaygtygtgttttggagtttttttatttygggagtttgayggygttggygtaagttttggygatatttttggttttttttattttgygtttttyg

SEQ ID NO: 6275 - DNA, 2372 bp, synthetic construct; identical to SEQ ID NO: 6274
  misc_feature 1..2372: note = Description of Artificial Sequence: Synthetic polynucleotide
  source 1..2372: mol_type = other DNA

SEQ ID NO: 6276 - DNA, 2372 bp, synthetic construct; identical to SEQ ID NO: 6274
  misc_feature 1..2372: note = Description of Artificial Sequence: Synthetic polynucleotide
  source 1..2372: mol_type = other DNA

SEQ ID NO: 6277 - DNA, 2142 bp, synthetic construct
  misc_feature 1..2142: note = Description of Artificial Sequence: Synthetic polynucleotide
  source 1..2142: mol_type = other DNA
tygagggtagygtttygygtttgattttttygtaagygtttatttgtttttaggtggttaggaaggygtgggtgggggtaaagygygtagagygygggaagttagygygtatatagygggyggttaggtttagtattgygggggaggtgttttttyggtataggattyggtttttgtygtggttygtgtygatgttygttagaaaaggggygatggtygggaagtyggtggggaaattatagtttatatattgygtttttttggggaagttttgagtggagatgatgtygttggtgtttatttgggagaggagagggataaaaaggtgatagtygtttaagtttaaggaygttattttttygygtagggagggaagggaattgatttaggtaaaaagtttttttttttttttttattggttagggagtttggatttagggaaataagygtaatttttgygattgttttagtttygygttgtagtaggtttaggggttttaaaattygtttatttatttttttattttttttataatttyggagttttatgttttyggagaggaagtttttaggtttgaagagggaatattttagtttygtagaygggtatagttttttygyggttttaattgtaaagttygttggtygttttagtaaygttattttttttgtttgggaygygtaygtggttgygaataatttttgtttttttttttaggttatttttgtttttttatagtagyggggtaggtagyggtatygttttttggtygggtattatygtaagggtgttggggggttttaggagtggggtttgtttttttttttttggaggtagggttttygtgagatygattttagggaagaagttgygggaaaagtgttaggagggggttgaatttaygtagaggttgttgaatygggtttygtagaagtgtaggggattygttagttttattayggttgagttttygtygtygtttttttgtaggagttggtttttttaygatttttygtgtgggaagagttygtttgggtgtagygtygyggttygtaatattagtaayggtagtagtagtagtattggtaaygaygatagtatyggtygttyggttattyggtttttttttatgttygttyggtygtgygtttattygttgtataaygygtttygtttyggtttttagtttatttttygygtygygttagtttygaatttggattttygygggygtttgggyggggygggattttaggtttatttagtaagttaattggttgaggttttyggttggggattaattatyggttttgagaaagttyggtagtggttattatatttggttttygttaatttttttaaggtagyggtygttggagtagyggggttggyggggtaaaagtttttggttagggttgtttggagttgttttttttatttygtttttagggagttttygggttatttttttattygggttgtttygyggtttttaaggagttttattttygggattaaatggttygtaaggtttggggtagyggygttgtaggagatgagtttagygtaaagggaatttygtagyggygagtgyggttgttggtttgygygttgtggttttaataggttggtagggygygggygggtggyggggttgyggtatgagttttgttttttgttttggggtttygggygtttttggttttggaggtttggttatyggttygaaaagtaaagggatattgtygtggttttttyggtygtttygttttatttagagaygttttgaggagaagygagtttttgtaygaaggtagagggttgatttttaagttttgtttttttttygaaggtyggtygttagggaagatttggttattttttggaagtattttttttygggaaaatygtagtaggaaagattatgaaatattattgtgtgtgattygtttygtttggggagtaggatgaggtatttygtttggttattaggtagaaaggggygagtygyggggatgggaagattttgattttttgtttattgttgyggtygtyggagatgttttttttygyggttayggaggyggtaatttgagttgtttygtaggattggaaatygtataatttygaaattagttgyg

SEQ ID NO: 6278 - DNA, 544 bp, synthetic construct
  misc_feature 1..544: note = Description of Artificial Sequence: Synthetic polynucleotide
  source 1..544: mol_type = other DNA
tygaatttgggyggtygtygggtagttttttygttygattatggygattgatagtgagtgygtttyggtygyggaggttaggggtggggggaggtygyggtgtttagggtgggaagttygattttagaygttgtttttgtgttggttygyggtagtagyggtygggttttttttygttttttatttttggttgtttggyggggtttgaaagggtaggtggttttggyggygygtttygygagggatgtggtagaagggygtgygtttggygtygaggyggagggattttygatgtygtgtggtagyggggtttgttatygtagtttttygygggtattgtttttaggtttagagttagtttttagygagtygggtaaaygaaggtattgygygtttttggygttgtgagtttaaggttygtttygagttttgggtygggtttgtgygtttgttttttggggattagggtggtttgtatggttyggttgttyggtggtttaygggttgtattygtagygggtagtataaggtyggttggagatyg

SEQ ID NO: 6279 - DNA, 2002 bp, synthetic construct
  misc_feature 1..2002: note = Description of Artificial Sequence: Synthetic polynucleotide
  source 1..2002: mol_type = other DNA
tyggaggttgtgtyggggttygttaaaggttataaataaatyggaygggtgggaagtaygttttagyggygattggatttttaaaaatttgttggtagagtgaaaataaaaattgttttttaagttggtaaaatyggygttttagayggtgygtaggagggttttgygaggtttgttttyggagtttygygttagttttgtaggttyggttgggttygtagttyggtgttttattygtgggtygggttyggttgyggggttttttygtagtygggatatttaggatagtagyggttggggagtyggggttaggggtttttttgtaattttaatgatttttattattattattygtaaaggataaaygyggttaaggtygggttttatagtggttgtgttggttatygygtggaggagtgtgygttaatttaggggygaggggggygygttyggtgtttyggggagagtttagaaggaagaygttttatygtggtttttatagttagggatagtttgggtgttagaaatttttagagagaattygaggggttgatgttttgggttattagtttttggtgtttgtggggttttttgygygtttatttttatttttttttttttttttaggttygayggattttttyggaggtttaggatagtgatttatagtaagtggtgatagtggaataaygtgatagttygttgtatttgttagttggtttttgggtaggtttattygtygggttygattttagagtygagttttyggagtygtygggtaaagttttttttttygtttyggtgtagtttygygtttttygygttyggygttgtyggggaaaagtggtataataggaaagtttygttagagggttttttttagtyggttttttygttataaaaagttagattttagtygaggttttgattttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaaattyggagyggggaagtttaggggttgagagtttyggttygggtygtaggagttggggagyggggaygygggtaggttaggtttttttatttgtygtyggggttttttttygtagtagtaaaggggttttagtgttygtggtagtgtatgttttagyggataygttggtttttaaatttagagattagaggggyggttgagaayggggygttygttgtgtgtgatttttgatygtggaggaagggygggagtygggagtaggyggtggggttyggggttaggtygyggtygtyggttttyggtaaaggygttttggtyggggaagggggygagggtgggyggtyggtttttgtygtygtagttatatttgggaygttgaaatgggttttggggatagagtttatttttagygygttttataggagaagttygtagtttaggtttgggtygtgtagatygttgggygggttyggggttygaggagagtaatayggygygaggtttagtygygagtaataatttygatagtayggtttttygaagaygtgtttygggtatyggggttgtgagygggggagtttygggttttgggttygtttggtayggggygggggyg

SEQ ID NO: 6280 - DNA, 983 bp, synthetic construct
  misc_feature 1..983: note = Description of Artificial Sequence: Synthetic polynucleotide
  source 1..983: mol_type = other DNA
tygttttttttyggtttttygagyggagtgggtaagggaggggggtgaggaaggtaygygatgttttygtygttyggygttttatyggtygtagyggtttatygttttygygggttgttygtyggtygtagtygygttyggggtatgttagttygtygtygtygttttttygtyggggttygtgggttygtagttgttagggagttgyggggtagygtatttggagygyggggtttgggagggagggtgtttggggttagggygaggggtttygggaggggttttttygtayggattttagaaagagggaaatttygatttagagyggtgattggaatttaygttygggagaggttyggagtttyggtygygggyggygggggatttttgtaggaaggggtaggaaggtaagtagttyggygygttttggyggtttygagggatttgggttygggtttgyggtygygtygtttgggttttttttgggttgggagygygtygggttttygttttgtaygttgttatygygggagaygtttyggtttygtygygygtagaggggaygygyggagaggttggtttttgggygagyggagagttttgtttattaagttgtyggaagaagttaaattaaaaagttaatttttaagtttttaaayggaaygttattttattagttgggagatagygtygtattgattgataagtygygtatatttattttygygygyggaggggagatttttagaaygtttttygattagtagygaggaagtygagttygtatttygtatttygtatttygtatttagagttttygagggaygaatttagatttaatttttgtttygyggttatttattttagtygttggagtttggygttygygtttttyggtyggtagtaygttaaaayggyggygygttttgatttggatttygtygagttgggagttttaggtagtaggygggygygyggtatyg

SEQ ID NO: 6281 - DNA, 947 bp, synthetic construct
  misc_feature 1..947: note = Description of Artificial Sequence: Synthetic polynucleotide
  source 1..947: mol_type = other DNA
gyggagygygttagagygygagggayggagggagaggaggagygygggagttgyggaggygatttygygaatttattattgtaaatatattygggggtgttaggaggggtaggggtgggggtygyggygtttatattagttyggtygygtyggattgaggtagtagtgtggtttgagtagtttttagatttaygtygggygggygtagtatttggagygagttttgygttygttttygygtagygtygtaygttyggtttygagttgttygtatataygygtyggaggagagttygtttagttttttygtygagtttygggattttttaaattygaggagtttyggygtygyggggtagttttttgtygtttttttygttygttgtattttttttggggttygttggtttggygaagyggagagggggaggyggaggaggagagaaggygggggtygyggyggtygaagttaagagaaagtggtatgttygaattttggaggyggtggtggyggaggaygggggaagaygatgtygtagtttygtaggggaygtaggygagagtaagygaggygagttgggygtttyggtttyggttygttgyggggaggygygygtygttttgaggtttyggttttygtattttygygtttygaygttgygggygatagggtttggttttagtagtygtygtygtygtygtygtygttattyggaggatttagtaaaagtttggatttgggggagggygyggygttgagygggattattattagggttggaaggagatttygagaatttttgtaggtaaygygygtttttaattttttttttttatgtttygtygttgygttttygtttttttttagagttttttttggttttygygggtttggtagaaagtaagagggaggygaagtttaagatttyggggatgagtatygagyg

SEQ ID NO: 6282 - DNA, 1362 bp, synthetic construct
  misc_feature 1..1362: note = Description of Artificial Sequence: Synthetic polynucleotide
  source 1..1362: mol_type = other DNA
gygttttttttattygygtttttaggtttttatgtaygttaygtgggtgggagygtgttttatatattygygygtttaaagttatattygttaygttttygtyggggygggtttatygygygtttttgggtgtygagtttttataggttatatagtygttatttgttgttgtatttttattgyggggataggggtatttagtgttttttttygtttttttygtttygygaaggttttttattttttagggttaggyggaggttaygtttttttygggttttttttttaaygyggagagggaagyggagggaggagtttggttygtagtygtyggtttttttygtattggagttttttttttttttttttttygtttttyggttgtygtagttyggttygtagygygygttagygggggtttttyggagygagtygttaggtaayggggttggtttygtagaygyggggtyggggaagttygygygygttattagtagyggygtygyggggyggggggygtagagattttttttaatttyggtttgttattatttggttygygygtagtttyggtttagaatgttttaatttgygtygattgttgtygtygaggtgttttttttttgtagggatttygaygtygttagttttttttttttttttygtaggtgygtattgttgtgtttgyggtygggtgggygtttygtygttgyggtygyggtygtygttggtaagttgygttttggggtttggggtaggaagtagtggggggygttygaagagtagggtagttayggttatygtggtygtyggatyggttatgtgttaaagtttttggggttyggygtttygttgggygygtagygyggggagtagaygygtygtgggtggggtagygyggtgttgttggygttyggttttygyggggtgtagttttgygygtttttatgttgttttttttttttttttttygygttgttttttygaggttttttygtygagtttyggygyggggtatgaggagttttygggtgtygtttagagattagtaggttgygygtatatttagttagyggtagayggggatatgagtagygygtayggggtttygygttyggyggttagttttattyggyggyggttagygggttaaygttgttygggagaatgaggtaggagtyggyggtagtttttttttttttttttttttygtttttttgyggtttyggygtttygggttygggtygggttgyggttttgttgygtgtttygygygttttttaatygttttyggatgygtttttyggtaagttaggtttttygtttygygaataaagtttttttygtagggttyggaggtyg

SEQ ID NO: 6283 - DNA, 1092 bp, synthetic construct
  misc_feature 1..1092: note = Description of Artificial Sequence: Synthetic polynucleotide
  source 1..1092: mol_type = other DNA
tyggattttgggaggagygttggygtggaaagttaggttatttygattttggtttttaggttygggataaygtgttagttttaagagagygttgtttatagtttygggtgggttgggtttaattgtayggggyggggygttaatagtttaggatttgggttgtaggttggtttttgtattaattagyggggyggtttygggttttagtttttttatttygtttaygaagggaggygattgygagygtttggggtttttgayggatttygtttygggggtggggyggggagtggttaygtggaggggygtttygttygtygagtttygttttatttygtttygttygttttygtgttyggggtttttygtttagtagagatttggagttagaagtttagagatagtygagtgygtygtgyggttttyggaygttygttgtttagttygattttygttaattgtgtaggyggttgattygtagyggtagyggtagtagygaggattygagygttggttgtagygatattatggattttttttttatggtygygtaggtaayggggygttttttttaygygtttygggtygttaagtttggggaggttyggggttayggtttygttttttaygttggggttgggtagtggygttygttygygattygygtttyggttttttgtttygagtyggatatttttatttggtgtaygygtygggggyggygatygyggttttttyggggtggggygggttgygygtttygtattttygyggttygagttgttttygttygggtttttttygttggtaggaaggttgygaggagtttgggtagttygagtygtttttttttgtttattttttattgttgttttttttttggggtttyggagttttttaaggtygggttagtttagattygygygaaygtggatgggtatatagtttygtttttttttattttgttttttygaggygttagtaatttgttttttgtyggtgatttygggygttttttttgtygtygtttgaggaaggttttgagattygttttgtgatygtgattygttaagygtygaygygtygyggtyg

SEQ ID NO: 6284 - DNA, 1092 bp, synthetic construct; identical to SEQ ID NO: 6283
  misc_feature 1..1092: note = Description of Artificial Sequence: Synthetic polynucleotide
  source 1..1092: mol_type = other DNA

SEQ ID NO: 6285 - DNA, 1092 bp, synthetic construct; identical to SEQ ID NO: 6283
  misc_feature 1..1092: note = Description of Artificial Sequence: Synthetic polynucleotide
  source 1..1092: mol_type = other DNA

SEQ ID NO: 6286 - DNA, 580 bp, synthetic construct
  misc_feature 1..580: note = Description of Artificial Sequence: Synthetic polynucleotide
  source 1..580: mol_type = other DNA
tygttygggttygyggattgtygggtyggtttttagttatygtataggtgttttggagagtgygattattttttgtttttygtttygygtyggttttyggtttagtgtttygttttttttggagtayggtttgygtatgygygygttttagggtttagttttgtttttgtttyggtttttgyggggatggatgttttaygtagtaagygagtaagygagttttggagatyggggttttgggtgtgyggtyggtttagtgttaygyggtgagataggtatggttattaatttaygttaaggyggttgtgtatttggtatagaaaatattgttgttgaatgttgtttttatagttattygttagygtttattgatgagaggtgttattayggatattyggttttgtttygtygaagttttggtttattaggattaaagttaggttttagygggtttttttgttatttttggayggtttygygtttttttagagtttgatttttttttatttttgtagtttaagtygyggaagygtagatattyggtttttttygygtgttttatygggtttttttggatayg

SEQ ID NO: 6287 - DNA, 888 bp, synthetic construct
  misc_feature 1..888: note = Description of Artificial Sequence: Synthetic polynucleotide
  source 1..888: mol_type = other DNA
tygtgggaggttagagygggygttgttyggygttatttttgtagygttyggatygtttygtataggtaggggtggtgtttttttttyggggtatagaaaygttatatttygggggygtygtttagaggttgtttttgtttttgtgtttttttatgaggttttgttttataaaggtagtttgagttaggattttaaagaggtttggttatygggatyggagggagtttygttttttaggtyggttttgtaaaygygagtttgygttaaggygttttgygggtttgttggtggtatygaggggtagygyggggttagygttgggagtttygaatttataygtttyggttagttgttygggaagygtttaagtataygtttygagttttagattggattaagttgtttaattatttattttttttttttttaaggagaagtttaattggagaagattyggtttttttygttatggtaggttttttttttttgattygtagttgtaggggttgagggtaggygtaggttygttttggggtygaagttattatygggtttygaggttgtttttttaatattyggtttgtaygtttggygggggygtaatagtgttttayggttygggagttygtttttggtttttgagtaaggtattttttttatttgtygtgtgtttagttgaatttagtatatttttttygtatttttygtttttttttttttttttttgaatttgtttttttgttttgygggtttttaatttttttygaatttygggygttyggttyggtttaggygagygttygyggttggggaygygggtggggaygyggyggtttgggygttgtaggatgygtttggtygyggaggagaygattagggagygggtyg

SEQ ID NO: 6288 - DNA, 1483 bp, synthetic construct
  misc_feature 1..1483: note = Description of Artificial Sequence: Synthetic polynucleotide
  source 1..1483: mol_type = other DNA
tygaatattgatatygttttaaagttgtaatttttyggtttygttayggttttttatgtataaagagagggaattagtygtyggtgatttygayggttttyggattagggatgtttygagttygagygggtagggtgtttagtagggttaggtgatgggaattatggggttatygagtayggattttggttttttyggtggtttttgtgagttttggggttaggyggggattggaggagygttygygtygggagggagygtatygygttaygtgttygttyggygtttygtttttatttyggttaygtttttygygttttttttaaagtttygttttttagtttygttattttygttygtttygtttttygtagttttaagtttagygttttyggaggygyggayggtggggtttygygttttttgtgtygggttttgatygtygygygygtttatttattttagyggtygygggyggaggggygtaygygygygtagttttttyggagggyggtggggygaatagtaaygygygtattttagtttttggttgttgtgttgagattagttygygygttygygygtttttttttygaggattyggagtygttygygtattygttaggggtygtygtttygagttttaggyggaygygtaygygttttygtygttyggattttagtyggttygtttttygtttttttatttttyggyggyggtttttaggtaygygttygygtataygtyggttygggtaygygttygttaagatggtaggggtyggggtttagttgttagtygtygtygtygyggttttttttygtagttagyggtttygaygtttattyggagaagatgagttttygttgtttttygtagtttagttagaygyggagtygtygygttyggggtyggttttttygttagygttygygtttygygtttygtygtygtygtygtygtygtygggtygtttttggttyggygygttygttttyggtagygataatgaggtgagtyggggtyggygtttygtgggaggtggtagyggttagygtyggaggggttgggttgggggttygyggtgttttygagggygggaggggggttttaygggygygggggtttttagagaatygygggggttttgtagagattygggggtatttagagygygggaatggtttygygagagtygtgggggygtttggagagtygggagggtttgtagggtttgtggggggtagtgttttgtaaggggtaggyggygttggttttggttgtttgtggggtttttttaggtttyggggggtttgyggyggtttgggaggtagattttygygggtaggtgtggtygtgtttygatygygygaggatygaagttggyggaagtttttgtgyggtgttttttagttyggaggaggttggtttgaagtttttaggygttgtygaagtttttttttgttagygtttagagtygyg

SEQ ID NO: 6289 - DNA, 3714 bp, synthetic construct
  misc_feature 1..3714: note = Description of Artificial Sequence: Synthetic polynucleotide
  source 1..3714: mol_type = other DNA
gygygygaggttggggtagtttataggaggagygygggattygggtttgagtttgtatttaggtagagygtttattttygtttttagtttyggattttgaaagtaaagtygtygtgttyggtagttagttygaattttttagtttttagggagtyggggtyggggtagggaaggttaygggtggyggtataatygggattttggagtggaggygtagattgygggtttygttgygtaygtttygtggttyggttggggtgggttttggaggtttataggttaaggttgaaygggggttttggagygtgggyggggtggagtgtataggttattgggttttgagygtttttatgggttaggattttaaygygtygtgtttttaggatagattggagggggaaggggttgygattatgttttagtyggaagggttttatagtagtygygttgttttttttttgtyggatattyggtagtagatatygaygtttgggggttagygaggtaggtgggygyggatygygattygattttggtttttaattttygtttagtggygygyggggtygtygttttatatttttagttygygtggttggtgtttggttygtygtyggggyggaaggggygttgtyggygtaggtgggyggggtyggagygygggggygygyggygyggagygagygtagggttygggggygyggggygyggaggatygggggtttgaygggyggttttgygyggtgyggggygyggyggyggygggygygyggttagtgaaygygygggyggggyggyggtggygggaggtattaggggtygtttttygygttttttttttttatggygttgttttagtygttygagtygtttygyggygygtttygtaaggtttttagtttgttggagatgggggygttttgtttggattyggagattattttgggttttattagttattttttgyggygaygaggtaaggtgagggttgtygggaggggggygggyggygtaggygtygtttygttattttgtygygyggttygygyggtygggggtgttgygtygggaaggagayggtaggttyggagtygygtttygtagttygggttgggattygttgtygtatttttttttattagygttgtttaagtttttttttgtttttaaggttgtgttttaatyggatttattyggaggttgtggttagggyggagagygtagygtagggattttygggtttattttgygttttgttaggatgggygaagtagggggtyggggtttttgattgatygtgagttttygaggtgattttagttttgtgtatttygtgttttgyggatatgggatgtgagtttgtgtttttygaagygtygyggyggtagaagygttgaagttgygggtgtggttggttaggggygtaggatyggtgttttygatygttgygtgtttttgtgttgygtgtgtgggtggggggaygggatatagagagtgtgtgtttyggagtagtggagyggygggaggyggtgttgtttgtyggtagtgyggggtggggtttgggtgttgtttttagtatttagatttagatgtgggttgaygttygtttttattttttaggttgygaagagaygggtaggggaagygttttyggttttttaggttgggtggaaagygattgtaggtttayggattttagaaagagtggagagtttttgttattttattttatatttttttgygttttygaatttttaaggttattaaygattyggaaagtygggaggggattatttattttattttttggggagtgygtgygtgggyggggaggtttatttaagtaaaagggggtgggtaaaayggaaagggttattttgaygtattgagtttttgygaaggttttatygtatgtgtyggtagtygygtgttttggttttygtygggttaygattttyggagttttygagtgygttttaggtttgggaygygyggygttgtttttttagtttyggagtygtgtgygtagyggtyggtagggggtattygygttayggggagttygttygtygygttygtttggtttgattygggttttggggttgattyggagtttggttyggagttgtttgyggtygyggatgtyggygatatttggggttyggttaggtatagagtaattggtygttagggaagggygggggggyggttttttagtyggagataaataagtaattaatttyggagttgagtttttatttgttaggtttgttgataataggttyggygtaygttygtaggatttttygtttttygggyggtayggygygtatatttatttgygggtataygygyggttgtaaagataygtgtygttygtagaygygtygaggtatagataygtyggygyggtygttgttyggttygaggygtatatygyggygatattaatttaygygygatagttagatttaaagtggttygygatatgtagagtaygttgggtttgttggaaaggygtttgggagtttyggggtyggggtttygtttttttttyggtttatttygtygtgggttttgggtaagagygtttttttygtagttttagttttttygtttgtagagggaggggygtyggygttttttgggagaygygtagttttggtgtttygggagaggggygggaggygtatgygygygygtaattagattttygtygtygtttttagygttttttttyggggtagggatttatttaataggttggggtttttggagtgygyggggtygygtggggaagyggggattttattttttttaygygtygtttagtattgggtaagggyggggtattttttgggttttygtttttygtygttygtttygggagttygagtttygttttttttyggtttygttttygtttttygagygygtttatyggagttatygygtttttygygatattygtaggttttgygaattttygagyggttgggtygggttatgggggygtttyggggtyggattaygtagtygyggygttttyggagagttagygtggtygggagygtttgtygggtttttttygygtttyggttatggtyggtygyggygtttttttgtgygttgygtagttygyggtaygygyggttyggtttggagagggaggygggyggygggggttygggayggygaagatattygyggtgtgygttggatttttgggggtygggttttttgttgagggtagyggattygtaggygggattttyggggatggagggagtgggtgagygttagggtygtgtttagggtttttaattttggtaagagygttaygttggggtagggygygtaggggtttggattygayggaygttttaggtttattgttygttttygtttttatattttgtaggtggtygagggyggttyggttygygagtygtygtygttgttggaggtgttttttygaaagaggttattygtygggttygattaggatttatgyggtagtygttttgttttygaaggygtyggggtyggtttagagtagggttattyggtyggyggaggyggttggtgtygttattgttataygaagttggtggagtttaagygataggygtggaagttggttagygggttygggattatttttygggtaagtgatatttttttaggtygattttttygagtagggttaygtyg

SEQ ID NO: 6290 - DNA, 1266 bp, synthetic construct
  misc_feature 1..1266: note = Description of Artificial Sequence: Synthetic polynucleotide
  source 1..1266: mol_type = other DNA
gyggygaggagggttgtaggtgaagygyggggagagggaggtygttygtttyggttttttttttaggggttttgyggttggttagygtttyggttgtattttttggtgygygtygyggyggygttataggtttttygattttttgattatygttttygggtygygygttyggtagtygggatyggtgatggygygggattgayggtygtttttttttagatttttttgtttygtttggggttygttggggttgyggygtygtttygagttgtatgtggggygggygygttygagtttagagygagyggttttyggygttttygaggyggtgtttygtygygttagagtaygaggaggagyggygggtygggttaggttttttaygygtygtagtttyggagtaygggtttttyggaggggatttggggygttttagtttaggaggaaggattyggaagtagaagyggagtygygagtygagtygagttattgttttygttgttygygggygtygggtgggggtttyggyggttggatgggtagyggyggygygggtygygggyggygatgggygaggagtagagtayggtgagyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagagggaggggatgaatagtaggaggygtttttyggygaagagttggagtttaggattygygtgggggtygtygayggattggttttggaygtgttgggttagyggygttygtttttygttaagagataagttttttgtttygtgtattgygtggagagygatttgttygaggttttygtttyggagtagttttygtygttygygtygttatttggggtttygttagtgttgaatttttttagtattygtttttttttttttagttttygattgttttttttaayggattttttttttttygayggyggtagtatygagttggagttttatttggygttygagtyg

SEQ ID NO: 6291 - DNA, 1316 bp, synthetic construct; identical to SEQ ID NO: 6168
  misc_feature 1..1316: note = Description of Artificial Sequence: Synthetic polynucleotide
  source 1..1316: mol_type = other DNA

SEQ ID NO: 6292 - DNA, 10783 bp, synthetic construct
  misc_feature 1..10783: note = Description of Artificial Sequence: Synthetic polynucleotide
  source 1..10783: mol_type = other DNA
tygyggagatatttygagtttygtaggtgtttgagttgygttgygygttttagtygggaagtttttttttatttaatygygtygtttygyggaaagtttgggtattgtagaygtttttatyggtttatygatagttggttttgaagygggggtttagaaaagtaaaggggatagtgtttggagttaygatgtttttgatgtgaggyggttttatttaataattaaygaattaagttggaattgtaggttttatttttgttggggggaggattttaaggaatgttatttttttgttttttattttttgttttaygtttagttttttagaaggtattaggygtgagtagagtgygaggygtttatattttygtgttttttttattttyggatatttttgtattttagtygaggttttagtayggagtgagggttgtttggggtgttttgttgtgtgtggggygtttttgtttttygggttttgattttayggtttgggtyggygaggygtttttttttggygtttggattgtgygtttgtttygtttttaggygaygaayggtaggagtygggggttyggygggattyggatttagggygggyggaaggygagggtttttttttttyggaattttygtttyggaaatttgtaattaaatygggtttttttttygtatygttttygygttttygggtygtttttttaygygggtatttatttttygggttttygtagtatygtttttttygygtttattygygyggtygaygtygttaggggttttgagatygyggagatagygygttttggygtttggtggggtttttttagtggttagagygtttttggattagtyggttgtggtttgtgtttaaataygatggaaatyggggttgggaygggyggtggtaygtaygtggaggagaagaggtatggygggaaaattatagtygaatataggtygattygtattttttaggtattygtygtygtttgattygyggttttttttaaggtttygattygtygttattttttggtattatttatygggtttygattygggtygygagttygttgatgygtagttgttttyggyggttttygggttttgttyggattygygygtagagaygttygggaaygttgggttygggygttttttggyggyggtagtaygyggtataygttyggtttttyggttygagggggygygtggagygtaygygggattygygygygggtttgggttgttggtttatattttttygtttgttyggatggyggygttgaggtttattygtttttttattaataaygatgtttygggagggaaaaaatagagtttttaaaaattagagtgygagagaggagtgtgtgtgtgtgtgtgtgtgtgtgtgtgtgtgtgtgtttyggggygttggtgaaagtaataaaatttagatygtttttttggygagatagyggyggttataatgygtyggggggattaggggtttatttgtagattttggataaaagatgatatatygatayggtttagagtgttattgygtttggttttttagggagttataagtatatattttttgaaatatygtttagtatagtatttaattygttygttatttaatatygggaggggaattttagtagygtataagygygttttyggttttttggttttgggtggggagagtttaaatgagaaggatttggtatgtttagaygtttttttttttggtttttgtttttagtttaagtaattatttagygatgggttttaataaataygtttgagaattgtttttatgttyggtaaatattggattagttttttaatgattaggtttttgaaaaggttygagaaatatatattaggttttaattaagtttaatagttaataggtaaggaaataagttatttttttatttgaggtggggaatgttgggaagggggatttttatttttattaaattatttgattttattaaatatgatygttgtattaaataggaaagggggygtatttaagttttttattagtyggaatttttattagtttagttttgtttattaagggtygagtgattttgtggggaatatatttgggttttagtttttatttttatagagtttagtataaattatttttgtttagtatatatggtttatttggggattgtttatgggagttttgatttggtaattgtaggggagaaggtatgatttaaattattttygattgtttygygttaatttggatygtttagaggaggtaaaaaatgggtaaattttttggaagttttgttgtgtttttttggtattgaattttgtaagtaygygatataggagatattgaaaattaaagaggaagtattttttttttttaatatggggagagaygttgttggaagaagtttttgaagtggttttttatygtattaagaggttagtgggatggattttygygtataatttaaaggaaygygygygtttttagtttttyggggttggtaattaagtggttyggtygggygtaagtygttttggaatyggttgtagtttaagtttagttgggttygggattgagyggtatttttggttttttagaatttttttygyggtgagtggaagggyggtttygygygygggygtttyggggtyggtyggttgygaaattagggggtggatttttatttatttaggagtygttaagttygtaggggatygagtattatttaggttttgggtattttgagttgttttttgagttttaggayggttygatggtgtagagtttttaggtagaagttagttttttgatatatatatagtagtgagtaaagtgygtataagtgagttaaattttgaagaygtaggttygyggatttttattttagygttagagttaaggagatagaagagaggaaggagagaagtgaggaagggagagagattatgagaaaaagagattatgaaagtagagaaagagattatgagagygagattatgagaagagagaaaaagagagattttgagagagagagatagaatgagagagatttaatttttagtgttayggggtttaggyggggtaagygtttttygaagttattaaagataggggtggttttttttttttttttttagttttttttttaatagatatagtaygaatttttaatgygttttttttttatagataataatatagggtttgaaagtyggatataatttaggttttgtgygggttttttttygygttttttyggtttagttggttatatggaatttagtatggagttygtggatgataaagggatttagtgataggtttaataaaattttaaggagatttttgtttgatttygggatttattgtyggygataagygygttgaatggtgyggggtggggyggggggtggggggygggttttttttttttttttttttttttttgttttygygattttttttttgtttttttttaatatgtaygtttttaatattttyggtttttagtttttttattgtgyggttttgtatygttygttgtagattgggygaagatagattgttgaagyggatttygygtygggtgygtttttagggygttggggttagggttatatagggtttygtaggygtttttattgattttatggggattygaggatagagagaggygggygtygggtttatttttygggttttyggtyggttataggagygtatatttagattgtaggttygyggttttggttatagttttaaatttgtttttaatgagtaagtggtggaagtttgttagggtgaggattttttaygtttttttttttttttttggaaatttgagggttttttgtgattatttttattttggaagttttggggtttggaaaagttaaaatggttttaggttttttgatagtttygttttaagagatttgaaatttttatttttttttttaagaggattttgggattaggggaagttgtaagtggatgttgagtggttagtattagggtaggttgggygtttaattattgtataataaattatttgggagaaattygttggtttttaaaaatagtaagatataagtttttaaatattgttaagttagtgtggagaataaagggagattttttagtatttagaaaaattgtttttttttygaggatgagttyggagatgggaaaggatttttattggggtattagaaagattttygagtttttaattatttaggggyggtgtggaaygygggaataaagtgttatygygtttttgggttgttgygtagagtgttatygaygtatagatttggtygtayggataattatgtttgttttagatattgaattaaatttgattattaattatagggagygagaaagttagttgggatygttttttttgttyggtttttttattgttatttaattttttagttttgatggtgtagtttyggagagaatagagatataatttttaaatgygtygaygtttagttttttagygtttgtagtattygttgggttttgagttagagttttaagtatttttagaaattygygagatagaggagaaaggtttattttttagttggttaggttttttaagaygttttttygygtggttaagtgtgygttagtatttgttaaggagatttttttttagtaataagggtgggayggaattygtttttygtyggaaagatggatgygtttttttygggygtgttyggggttgtgtgtttattttttattyggggagtttattttatttttaaatttttattttttagtaatttatttagttttaygtttaagggttgatttggggggatygtatattttggttyggatygtygaaygttggagggaaggaggttygggatttagttttyggagagaggtttggaagttyggaaaggatgggagygtaagggaagggagaggtatggtttgttgggattgttaaagattttygttttttggttttttggggttaaagattttagggagggttgtagtattttttttttttttygagtttagaatttygygtattttttttaagttttttaagttaaagtttygygygttttgatygtttttatttttagttttagyggttttttaggttagtattagttygtagattttgaaaaggagtggggagtggggagaaggtagttagttttaattttagatttttatttatttatttttttagygtgaggtaagttaaatgtaataaagtgaaagttatygagtgtagtggttttaatagttttttaggttgaaggagttatttatagatttgggttagygaggggggtttgtttttttygtttttgyggttttygaagttattttttttttygtagtyggaygttgtygttyggggtttagatagygygygagattaggggagatgygggggagggtgggyggttttgggttttyggtygatygttygtaggtyggaggtygagygttttttttttygttttaattttaggygyggggtgtagtttgtggtyggaggggtttgtatygggagtttygttygttttagggtttyggtattttyggttttttygttygagaggaatygtttgtgggagtttygygggyggtygggttyggtttttaggtttaggttttyggttyggygtagtaggataaaygggagggtagggatttttttttttttttttttttaaatataggatttttattaaaatttttatttaaaaaatygaaagttttttgygttyggygttgttggggaatygygtygaatagttgagttttaagttyggggttgaaggttyggaggatagggtagagggttttttgtttatagggtttttttttttatatttgagaaatgtttgtataataaaataaaaagagaaaggaagaaagtaggggaaaaygtaaaaataaaaataaaataaaaaataaatttaaataagttataaagaaaggagttggatttagaygggaaataggtyggttttgaaggttattttggtaataattattatygatatttataaygaaaagygaaatttgttattagttgttagaaygtttatatggttataaatatttagtatttttttatttttttttaaaaaaaggaagaaattttttgtatttttaaagtgttttttatttgttttagaagayggttgataatatygttatttatataaatatattttataaaatgtaygaaagtaggggtggggggtyggtttttttttygtttttaagtgaygatattaaygttgggayggtttggttttttyggggagaggtaaagaagygaagttgygtaaatattttgtaaatayggygtagagtttagtttttttttaaggtttagaaggagaggtatgggtagagttgggtgggtggaatttgttattttaaggagaygtaggtaatttttyggygtttttttagtggagtygagagttaattygattttataataataattataataataataataattattataaggatygaggttttttygtygttatygtygtyggggtggggtttgggtttggggtygygagtttygttggggyggygtttattaagtttattgttgggtttggattagggggtgtgttgtygggtattggggggtgttggtygagttgtattgggygttgtattgtatgtgttgtagygattgygygttgtaggtagaaaagggaatgttygtttggaaggtggyggttgttaggttttgggttttgagygygtgatatggtttgtygtttttgattaagaygggtayggttattyggygyggygagggtaggggygttatttttatatttttttyggttygggygygttttattttgtagyggtggttttggaattagattttgatttgygtgggygtgaggyggatgaggttggttaggtgttygygttygggygtygataggtatygttgttgtygaaagygtygttttagttygtaggtttgygttttggagaaaagtattygtygttttygttttttgtyggygtttttttygtygttyggggtttttttgttattgttyggtgattygtyggtygagggtttyggggatttggagtttgagttttgagggggygtttyggtagttagatygtgtattggggggagggggagagagaagygygttaggygtttggaggtygygygtagtttgtattagattyggagtattttggatttttygtgygattttggattttygygtttggtagtttagtttygttgtttttgttatgatttttgtttttttttaygtttgaygaagaygtygggattttttagggtaaagagggaaattygtaggagtgggggttaggggttygttttttaaggggtttatatagtgtgggtgagaatttggggggggaagtggtattgaagattatygygggttaagggtttyggygtttttaagyggtttttttttyggygagaygtgggtagatttttaaaagaaatattttataattttagtattgatyggttyggttatttaaggtaggtttttgggggttttygtttttgttttygggttttttagatattttttgtattgtataaagygttttttatgatygygtagggggtagggtgagttatttatattygggttattygaagtttttttattttttattygtattyggaygaggttygttggttatttttagggygttaggttagttttttttagyggtyggagttygggggttgyggttggagttatyggttygggttgatattatatattagtttttgggaggtatagtttttttttttttttttttttaatttttygtattgaaaaaaattttggagattaagttttttttyggaattaaggaggtttgaagaggagggtagaggatattttatataggtgttaaaaatttttttayggattygagtgagggggttygggtttatatggttttttttttttttatttttagygtttaattygggttgyggttgtaggaatggaggggattayggtttyggtagttaagttttgttatttaygggagtattgaaggttttyggtgttggttagttagygygtgtaygggttgtygttgttgtygtagaaggggttttttaggggtaggttttgtatygygtttagggygttttgttttagyggttyggtttttttggttggttygggtttttygtttttttttttyggattttyggttatagagttttttttatygttggtgttyggtaggtttaagatgtttttgatygaaaatttygtttttgtgttggttagygatatggttygagattttaaaatttatgtygtaaagttgtagttttatttggttaattygtggygtttttttgttttggygggygggggaggggggagttggggggagggattgggggaggggaggggggaattggttttaattattgggataattattatttttaaaaagagaaagaaattggggatggggaggaaaaaaatgaagtttaatttagtgtttttttttgttttttttgaaagtaygyggaaatggaygtaggaagtygggyggtttgygygtygagygtygygggtttyggttttagtttttaattttaggaggggtgttaaggyggygttagttygggtttyggyggtygttyggygygyggtggyggttggtggygaggaaaaaatgggttattgttygagygattagtttatataaggttgggttttatttaygaatttggggaggyggggagagggggagaaagagagggagggagggaaagaaagagggagggagggggagygagagagggagygggagaagggtggaaaaaagggggaagagatattaaaaaygtaaaggttggttaygtgtgggygggttttgggagttaagtggatgaagatagtatttgtagatgtgaaattgtgggttttggggagtttygygtttttagttaayggttttttagagtaagatgagaggtgtaaygtgttaattaattgtaaagayggggygagtttttttttttttaaatttagtatttatatataaagggttatygygtygttygygagtttatatatttgaaagggtygttttaataaattgtattttaaaaaaggtgggggtggggaggaggaggggagaaaataaaatagaaattaggaggagggaaaaaattttttttaatatttatyggtttttattttttygttttygygygtttattttyggtaagtyggaaaattggygatttgtggygtttttggaaaagggggagggggygaaggtygagttgyggaaattttttttttttatygttggtggttgtttaaataagattyggtttaaatggtaagagtttaatttttgtaagttttttaggttaatattttggttgaggtttaaggatgagtgttagaaatgataaggtaagtaattgattttagttaatygygagagagtttaaaatttaggagagagtttygtttygggtyggttagagttattattaagygattygtttttttttagtygttttttatttgttaaagatttatttattttttttatttygtttttttttattttttatttttaatttttygtttttatttttttgyggttaaggaggaygygtagtttattttttgttttgygggyggtttyggggagggyggggtaagagtgaggagttttaatttygtttggggtyggattttggttttgttgtttttgggttttgygggttttttttttygggtggaggaaagggtagayggttttgtttttttttgttttttattattttttttttttyggttttttttttttttagtttttggttagaggtggagtagygggaaggyggyggggygggattgygggggtgggggtgggggttgtgtttttagtttgggtgaagatttagaaagttgygggggaggggggtygttgggtggttygaygatgtttygttttttttttagttttttttttttaygygagttttttagtgtggtttttttttggaygttttgggtgygttyggagtaygygttttaygtttttaggttaagttaggttagtgtgaagtttttagttattttyggttttgggaattgaattttttygggatttgtatttttttttyggygttggggttggaaaagattaygtygtatttgttatttttttttttagttaaaatttttttggggggggggtgtaggggtgtagattggttatttgatgttygttygttttagaggagtgttaggaaggagttttgtttgggggyggggaggggtatagaaggttatttttgyggggtttaggtttagtttttttataatttgggttttttygygygggttaagttgagygygygggtatygggtttttttygygygtagttgtagyggaygtygtygygttttagttgttttygggttgttagygttgggtgagggtattttttttygagtygttyggyggttttttgtagttttagttgtttygtttttagtatgtgaygtgggtgataatggtttaggttagagtaagtttttygtyggygygttttgggtggtyggattygggtaaatataaatataaatygattgttaagttgyggataatgagygaaatgtagataaatgtttygttttygttggaagtttttgtttyggttyg

SEQ ID NO: 6293 - DNA, 810 bp, synthetic construct
  misc_feature 1..810: note = Description of Artificial Sequence: Synthetic polynucleotide
  source 1..810: mol_type = other DNA
gygtaygggtyggggagggggttatyggatttggatttygggatatttygggggtttggggggygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyggttyggggtygggtygaggtttygttgyggggttggygggygyggyggggtyggygggygggttaggagttggyggygygyggagttygaggygygttgtgttgttggyggyggyggyggyggyggyggtggyggyggyggtggyggygtagygygttttggttygyggygtttttygtyggtagygygaggygggtttggagyggygtygtagttaattygtgtygtygggggagggggygtygttgyggggygtgggagttyggagggygygggttgyggttttttttagtagttttygggttyggtaggtgygygyggggaggtaggygtygggygaggttgtttgggttttggttygagggttgttttygatttygtttyggtttttatttttagtyggtygatttgyggagaggtyggygtttagttttttatttagataggttttttttagagatattggygygttyggaggggatgygtttaaagggtttygtttaggygggtyggtattyg

SEQ ID NO: 6294 - DNA, 1142 bp, synthetic construct
  misc_feature 1..1142: note = Description of Artificial Sequence: Synthetic polynucleotide
  source 1..1142: mol_type = other DNA
tygggggagaaatttyggtttatagtygggatgygttttygtyggggttatygyggyggygaaygtttyggatttygtatttyggtgattttttgggatgaatygaagtyggattygtattttggtygtaataagygygttttaygtygttaygtattagyggtgattttygagttttttgtygttttggttttttygtaggygggtttygaggttttygtagggagtttagggttayggttaygtgtagtygttttygagttygagtttgtaggttyggggttyggttygygttttggtggygttyggygaggttgtagygygtaaagtttttattttaagttttygtygyggygttttygtttyggagttggttyggtygyggttttygtttttttyggttgtttaygggttyggggygaggaygygagaggggtttggaagtygttyggggagttygttttgtttttyggagtygtygttaaatttyggtttyggggttyggtttagttttygttttyggagttayggtygtttygtttttgtttttyggttttygtygggtttygagtgygtygggagygyggygtagtagtygtygagggagggagygaggtaggaggygggayggagggaggggattgagygyggggyggggagaaggggygggtagtygaaagygtagygtttggtttygtttygtttygggatagtggtagyggygttatygttayggggygtttaggygtttaatygggatttygtattttggattygggggttttggygygtttgttggattgygtttttygyggttagtttttgagttygygttygggattgttygygttaygttttttttttygttgttttttttttygtttgtttttttaggagygattattttgyggttttttygtttgtaygygatagtttttaaggttttygygtttygttgttttggagttttaygtattaggyggygyggtagttttttagggtygygygttttgttagtttttttygyggtgtaagtgtttyggtggtttygggttygygtttttagtagtatygttttagggtttatatgtgttagatattaaaattttatttttygttgtttyggggtygygttttaygyg

SEQ ID NO: 6295 - DNA, 2885 bp, synthetic construct
  misc_feature 1..2885: note = Description of Artificial Sequence: Synthetic polynucleotide
  source 1..2885: mol_type = other DNA
aygttgtagataggygygttgtagggyggyggttttttttttttggtattatygatagtygaggaaattgggttaataaagtyggatattgyggyggggtygyggggygtaaatyggygyggatagatgggttttygggggtattttgttyggttttttggatttyggatggtggtagagttgggagttgygtaggaygggtattgygtagygtattttygtttatattyggyggggtayggggttygtagtagtttatttattygtagttyggttttttttttyggaagggagaggggatyggtggggagggggtttgttggatattagggttagayggggtttttttttgatygttagggttaagtagggygygggttgtgaggatttttttttaygtagtttttygaggtagagggttygtaaagyggtttttatttaattttatttygyggaygttttaggtagyggatggyggygggggggggaggttaggggatatttaggggataaattttttagatttygaggtagtyggygayggygtttaatttttaaataaatagaataaatttttatttggaaaaggtttttttyggggtttttttgygttygyggtttagtttttttgtagayggttatygtgggtttttygtagggttgyggagtttyggagttatygaggtgggaggtgtyggttaygygygtttttaggaatagagtattgttttgtagtttagtaygaagggtyggttggagygggagygygaggtttattgtaagaggattaggagttagtaagttyggttttttttygtttttatttttygtgygttyggggttaggatygtttgttyggaatttgattagtgttygttttygtygtggttttgggatttygyggtggtttttttttggggaygaayggtagtgttygaaggatgttttatttattttygtttttagatttgttgggtttygataatatttagtgggtgtygygagttttygggygtagagtttagygttyggttttygagtttaatttygygtttygayggttttggygtttttygttgygttaaattgtttatygygtataggttggaagygaagtygggttttttttttttggtttgtagggtttttttaggttttttttgttygggtagagagatagttataggggygatyggaggaygygtgygggagggtygggggttygygyggttayggtttttygtgatagtgtttgtaaagygyggagggygtttyggagaaggyggygtatttgttagggtagggttttagggyggygtttgyggagaaggggtatatagtggtttggtygaagggygttaagggygyggygtttaygggygyggttaggttttggttttggttgaggaaggttattaggygtygtatttygtttagggtttgygtttgtatgaggatatagtttttggygagtagtagygtggygattttggagagtttgygtatygaygggttgtgygygtaggggatgayggttygtagttygtttagygygtygtttaggtygtgtatgygtygtygttygygygygttgatgttgagtygtagagatygttgttttygyggtygtygtygttygttygtygygttttttggttygygtygtygtygtygttgttygaaggygtygttttygttttygttttgttygtygttgtttttygtygtttgagttggggygygaggtgtaggygtygyggggaggtygtygttygggttyggagtgtygtagtygygggtygtttygggttttygygtygtttygtaggygagattygtagtygtygtygygtagtygtggtttagtgttaggtaygygtttttygatagygatttgagttyggttatggtygygtygtttgggttygggggttygtygggtgggyggatgtttatgtgggtgagtagttttygaggtyggttygagttygtygttgtygttgtygttgygatgaggttttyggttttgygygtyggtttggtttgtttgygggttttagagtttyggygttygttgtttttttygtttttttttttttttttatttttttttttttttagtygygaygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggygyggggyggygyggggyggygygygyggttttggagygttagtatttgtttttygatttttyggtygtygttttyggtygtttyggggatttygttattaaaygtaygygttttaggtgggtattygtttyggttygtttttgagtttgattttagygtaagagtttttggygataygtaggggttagagygggggggygygtygtaatagtagtagygttagygttaatattttgtttygttgaggggtygtttygggtyggggttagggtygtgggygttttggtgtagtygyggygtagygtgtattyggagttygtatattttttgttyggggygttttgtggttaggtttgaggggtagagtgagagggagtttttagaatttgttgaaaaaygttaygagygttgtaggtyggggagggygggaaggtggagggtagygyggtttggggtttttygggggtgggaggggagttttgtgagttgtaggatygttttttttttgttagtygttttttgggtatttattagygaaaygygtgaggtttggtgggttttttyggagttttyg

SEQ ID NO: 6296 - DNA, 1460 bp, synthetic construct
  misc_feature 1..1460: note = Description of Artificial Sequence: Synthetic polynucleotide
  source 1..1460: mol_type = other DNA
aygygtatgagagagtagagyggtagygaygyggtyggatyggtygygggggttgygggaggaagygttgtagggattygggyggygtyggyggtttagtyggagatgtaygygttgtaatagatygygttgttggygttygatagygyggagattaggttgtttttttttgggtaggatatggygygygggtttagtttggttagtgttaygtggtaygggagttygggggygtygggtygagttyggttgtagttgaggtattggtygaattyggtgaggtttaygtyggtttatagatyggyggygggttttagyggttyggygttttttagyggyggggtttygggyggyggygatagygggtyggggtaygggtygggygtgtttagggtgtygtagtataggttagygagyggygtygyggggggygyggttttgagygttttygttaggggagtttygtagtaatygtyggggtttygygataattyggtgggygygtagggygygyggaagggtygtagygygtagttttygggygtygygggyggtgggaagaaggtagtttygtygggttttaggtygtttagaggygagygttygggygtgggtagttttaggtygtygaattyggygtttagygggggtagttygyggaaggygygagtygagttagaygtygyggggaaaggttygggyggtggttgygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtygtygggygggtgggygtygagtttttygtgygttygggaygtttygygagggtttggygtagttttygtatttygyggttygggatttttgtttttttygttttatttyggttygagtttttttygtttttttttttttttttgtygttttttygtygtttatttagtattttgttgagtatygygttgtgtaggttygggttttgttgagttagtygtttgygttygttttttgtttatattatgaaggygtttatgggtygtyggatgygygattygtttgtygtttggygtttttygyggtyggtygggttgaggttatagygtttyggttyggggttgygygggggattgygttgygggttgggyggygaggygggygyggygggygyggygagggyggyggggtyggyggygaggtygygygtgttagyggyggtttygtgtttyggggtttatgtatagtygyggygggygggygggtygttttgtgygtygtagtygggyggygatttttgtattttagttgggygyg

SEQ ID NO: 6297 - DNA, 1560 bp, synthetic construct
  misc_feature 1..1560: note = Description of Artificial Sequence: Synthetic polynucleotide
  source 1..1560: mol_type = other DNA
aygttttgtagtgtygggttttgyggygattattgagttttttygttttygtttttagttttttygttttygttttyggttttygtttttttagtyggtyggggttygtygtttaygatttygtaygtgtygtygaygtygttttgtygatttygtygtaggaggtggaattgtagtggtgtyggyggttttttttttggggyggyggtggygaggygttygttggyggygggtagyggttggatgaaataygttttttttagtaggtagaaggygtygygtaygttttygtagaggttgagggyggtagtygagttgggatygttatttayggtgtyggagtagaagtagtgygttaggtyggttttyggaagyggygtttyggattyggatttgygttttaygttttggagygtgaagtygggygttaaaaagttgttgtygggtygtagttttagatttagttgttggttaaaggygtgtaggyggaggygygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattygttggaagggygygtagagtyggttatagtygaagttttyggagttattaaaaggaggygttgtagttttgtyggygygygggaagttttttttttagygtaaagttggagatattgagaggtaggygtaggtagagtggttttgttgggataagaagygttttggggygttttyggggttgaggtaaygyggagattggtgtttggygttttttttyggttttygttttggttgygatgttgtttattttgtttagggttttttttttttygttyggtagygtattttggttttgtaatagtttttggttyggagtygttttttagygagtgtaagaatygggtagtygagyggtttttttatagtggattagtgaaatttttatttttattttattttttttttttggtttttttttattttaaagaygtygttttyggtttygttggtgttaaatygygtttygygttgygggttygggagggggagggggtagttttygygttggttttaygttattgttygttaatttaggggyggaaggggygttgtgattagtattttgtattgttggggtygttttagggagaagatttttttttttatygtttttttttttygtyggttttttggattattttttttttttatygttyggttgyggtaatttagttatygygttgggttgyggtttttaggagggagggttyggttggagaayg

SEQ ID NO: 6298 - DNA, 5118 bp, synthetic construct
  misc_feature 1..5118: note = Description of Artificial Sequence: Synthetic polynucleotide
  source 1..5118: mol_type = other DNA
tyggtgtygggagttttgtttttygtygttatttttggttagttttgygtaagaaygtygttttgtttggtagttaggtygagaygtagtttgaatgtgagtaggaattyggagaagggaagggagagaattagaaagaaggttygggagggattygggaagtagtgggaggtttgygttttggagtttygygagagttygtyggtttggtaygggtttttttygggtygttyggyggtttaataaaggtyggtttygataygtattyggttttttgtgggagagaaatataaagaagagggaaaaatayggaggaggttaatagtattaggaygygggggttaattaggaattttyggagtyggggtttattagtttttgtaaatgagtattttattttttaggaaggggttttagttgygygygttggtgggaatygtagtgtttgggattygtttaggtygtttatttygggygtygggygtaggattyggataagttttggggaygtttttaggaygtattagggtaagtttgggtatygggatttaatttttagttatttttgggayggggtggggaggtataggagatatatygagaggtatttagtattygattggtattagggttaagggagtttaggggygatatagattttttygattttttaagttatttyggygaygggaggatgttgagggaagtttgttaggtgaagaaggggttagtagtagtatagagttttygattttgttttttaggttttagattygygttatgttaagaygggtttttygatttttatttttgatttttaattttagttattggatygagygygtaaagaatttgagatygtttgtttttatygtygtaagtyggtygtaggatagatattagtgggtagtaataaaaaaagaaatygggtttygggataygtgtyggyggttggattaattttagyggttgtaattaaggagygygtaygttgygtttgttggtgtttattagttatattggtaggygtataatttygygtttygattggtggttttatagygygtattatatatggtttygttgttgttggyggggtaggttygaaggaggtatttataaatgttygagttttttttgatttttattttttygttttttgygtygttygagtgatagattttattaattgaayggttatgggttatttttgtaatygttggaygatataatattaygttttagttttttatgttttaaatatatatttaayggatggttgtagagttagttgggaaataygyggattgaaaaataatgttttagaaggtaygagattggggygaaggygagagygggttgggtttttagyggagatygtagagggagatatattttagaattaggggtaataaygtgggtttttttttgtatttgtttattttgtaattttgttatttgaagattaattatttattatgttaatttgtttgtttgtttttaaaatygtatttgtatagtaaaagttttttaataayggaagtaattygaygttttttatattttttaggagattgtgtgygtgtgtgttygygygtgygtttatagtgttaagtgttagtattygagatttgtagaaataaatgtttgaattygaaatgtatgggtgtgagaaatttagttyggggaagagattagggattgggggagataggtggttgtttgtattataaggaatygttaaygttagtatttgtagtttaagtagggttgttttgtaaaggtttagtaattttttttgtaggtttgttgtatayggtttttggttttttttatttgtaaaatgggtgaatgtattygtattttagttattttygtgaggtgtttttttagttygggtttaattttttatygttaagagtttttaggttttagagttagtttgtaatyggtaaaatatgttttaaygyggtygygagtggttttatttygttgtttggtttatagygtggagaagttttgtttaggtttgaaatttttttttgtagttttagaaagtaggygattgggayggaaggttttttgttaattttttatagyggagttttgtttggattatagatgttagygttgtttttgttttaaggygtgtggtgattataaagaygatattgaaaatatttattattattyggtttttttgttaataaatggaggggtgtttaattataggtaygattttgtttttgtgttagygyggttatygtgyggaaataattygtttttgtatttatattatttttaatttaaaggagagttgtgaatttttttaaaatatttttttggagttygttttttttttttttgttygttttttattttttaagtttttgtttttagttgggggygttatyggttgtygtyggagttgtagttayggttattttttagaygygygagtagagtattaagatagtggggattttgtgtttgggtatygtttatatttggggygttaaatgtttaygtgttgatgaaattagtgagatgggaataggyggygggaaattagatagaggaagagttagggaggagattttagtttyggattttgggtygttagggtttttygygygtattttaaaaggtgyggttgygtggggtattaggttagtttgttagattttgtagagtttttaaattattttattttttaatttgattttgtggtggtygtattttttatagaaatttgattaygtttttttttttttttggttttaagygygtttagttttttttttattttttttgagtygttttttttttttttttygttttttygggttttttttttagtttttttttaagaatttttyggttaygggygtttattggttgtgygtagggaggaggygtgtgttyggtttggygagttttattgagyggaattagttyggatgatattagttttttagtttttyggygggtttagtttattggygaggtagtttttttaggataygtatattgtttttygttttygttttygttatygttgtygtygtygtygttgttatygggttataaaaatyggtygagtttttaaaggtgyggatgtttattatagatygaygygatattagygttyggtgttaggtttttttttgaggtttttyggagygagttttttaaatygtatttagagtaagtgttttygttttatagtagtygtagtttagattttagggatagattttttttaattyggttgtgatttagaatgtttygatatagggggtttggatttttattttgygggttatttttttagagygattttgtttttttgttttttttatatttatygttgtattttttttattaaaagygagaagtyggagygataatagttttttttgtttaagttttagttagttggtgagtttttygtggtttttagatgtagtatatggattttgggtttygygtyggttttgggtgtatgtgygtgtgygtgtgtttgttgygtggtgtygatggagataaggtggattygtttgaggaattaaattattagttttttatttagatttttattttttttaaagaaaggtttttattttttattygtttattttagttygggggtttagtttttttatatttaattgaaagttygaagtttttagaatgttattygtatttygagggttattaaygttttttgaaataatttgttgtatgagagtagaggggagatagagagagtttaattataggtattygygtgtagttaaaaggagggttagagatagtagygagggggaygaggagttaygggttatttgtgtygggatttygygttgtggtattgyggtgtaggygggagtagtttttttgttttttattgatttatttttttttttttttttttttttttttttttattttttttttttttttttttttttttggaagttttygggttygagggaaggaggattttgygaaagttgygaygattatttttttttggggttatggattyggaygttagtttggtgtttagtygttygtygtygttagagttygatgatttttttttgtyggttyggagtaagggtagtagyggtagygtttttattgggggtatygtgttttygtttatttygagtgattgttygtyggagttgagygtygagttgygyggygttatgggttttgygggygygtattttggggataagttaggaggtagtggttttaagttattttygtttagtatttygtygtttaygtygtyggyggttgygtygtttattaagaaggataagaagtaaatgatagagtyggagttgtagtagttgygttttaagattaatagtygygagygtaagygtatgtaygattttaatatygttatggatggttttygygaggttatgtygtaygtatayggtttttyggtgygtaagttttttaagatygttaygttgttgttggygygtaattatatttttatgtttattaattygttggaggagatgaagygattggtgagygagatttaygggggttattaygttggtttttattygtyggtttgyggyggtttggygtatttygygtttttgttygtygttatygygtattyggtagtagtagygtaygtygtatattatttygyggtgtattattttattttgtygttygtygtygtagyggttgttgtygtygttgtagtygyggttgtgtttagygtttttttgttyggattygggttgtygtyggtyggttttattygtttatygtayggtttatttaagttttygtttgttgtygyggtygtttygttggggggygggggyggyggtagtggggygagygggggtttttagtattggggyggtatgttttgtttttgtagtatgtgttaggtgtygtygtygtattattaygtgtyggttatgggygtyggtagtttgtygygttttattttygaygttaagtgagtygattggygtyggygygttttggygataggggagttaggggtygyggggaagygaggattggtttgygttgggttygggagttttgtygygaggaggggyg

SEQ ID NO: 6299 - DNA, 1423 bp, synthetic construct
  misc_feature 1..1423: note = Description of Artificial Sequence: Synthetic polynucleotide
  source 1..1423: mol_type = other DNA
tygtattygattgtaygygtttttttgggatttygtattggygagtygtttttttyggygttggaygttttatttgtttyggygtygtyggaagagttttgtagagtgagtttttagggttatttygttgttttttttttygttttygtagtygttgtagttagygtgggagtygggtaggtygygtggggygttggatttatygagaggttagygtygtygtygggggagggygtgtttygtaygtgtgtgttygygygtgttygygttygygtgtgttagygygygtgttttggtygtgygygtygagtygggtygtattaattttttyggygtygaygggtttagtttatggtgtgggygtygggtttagggaggtttyggttttygttaatygyggagtagggyggtygtttygaygygygatttgygaattyggagtgygygtygggggyggggtagggaygygtgggygggaatgtaygygygtggttaggtgygygtgggtgygagygygygggagttttygagtgygygygtgttygtgtgygygtgggtgtgggtgtgttygygtgttygtgygygygttttyggggttaagagygygggtygygygggtaggtttggatattaygygttttgttygggtttaggaygyggttggyggtttygggaggaagaggaggaggaagaggaggaggyggaggaggaggaagaggaggagggaggyggaggagtagaggttgggayggtyggaggagagagttyggttttagtaggaaaggaatttagtaygygattattggaggggygaggagtaagggaaggattagaggggaggagagggggttaggggagggaaagtgtgggagggggagtygygggggtgygygttttttttaattyggggtygtttttagygagaagtgatatttttttagttttattgaaaatygttgtaaatattgaaaatagtaaaagtgaaaayggttgygatattaagaygtttataaaatgatygyggattgttttygatgttgatgagaattgggaygaygtygygtagagygttyggagggagaggygyggtgttygggatttyggtygtggggaggagtyggatatagtygtygggaygyggggatgtygagggtatygyggtttggtttgatygaygtaygyggtgatagtygtttttgggagaygayggygtttgtaattagtagtttttaaagggtgtagttaggaggtttagtttgttygttttyggggttyggggttaagttttttttagaagttttygtttttaygygaatttygatygtaaaatttagtttatttgagygtygtttttttttttttatgtttttygggggtygttaygatygtttyggagygatttttaggaatttgtttygtagyg

SEQ ID NO: 6300 - DNA, 1384 bp, synthetic construct
  misc_feature 1..1384: note = Description of Artificial Sequence: Synthetic polynucleotide
  source 1..1384: mol_type = other DNA
gygtygygtatagaaaaggaaattttatttygtttgttaagggtagggtygggttagtggtaggagaaggttagttgygggygtaggtaggagyggatttaggagtygygtyggggygtagagtyggaygtttygaggagtttgygygtygygttattyggyggaagtygyggtttatgyggggttttttaggtttatttaaygtttygtaggygtggttggtaggaggggttyggtygtgtttagygtttttagaygtagttttttttgtygtagtygtyggtggtygtgggtygtygyggygttgagtattttayggggaagttgaggtygggayggtyggtgtagatttaggygtygtagtataagaggtagtygtttattatgagtagygyggtggtygtttagtygatgtatagygttgygtttagttygtatttttgygataygggtatagaygggtygtaaaattygyggaygataatgttggygaattagtagagtggtaygagygttagtagttygtaaaataggtagagtaygtttttygtgagggttataygygttttggtygggttyggggttaygtaggtggtgtattgygygttygttagggttaygaagagygtaaygaaygttagtagtayggygtttayggtgagygttygygtygtttgtatttyggtgtttagagttagtatygagtygtatattttgtattgtatgtgttyggtgttttgtattaygtaygatatttatagttttttttaggtggtttgygtygttaygatgttgtggtttaggaaggyggttatttgttatatgggtagttygtaygttaggattagatttttttagtttattaggtatagtattaggtttaggatttttaaygttgyggattttatggttagaggygagaygygtattygaaggttygtagaatttttaaggtygtgttgygyggygttttgggygggttttggtgtttttgygttygygttttyggtttttggttttagttygtttgtttygygggtttgtygtattttttgggtttgttagtttttgtyggggggtattttttttgaaggttygggggyggattttgtttttygggttyggtttttyggttygaagtagttaattygtgygygggttatygtgtygtagttaattatagagtttttggtagttgaagttagggaaataayggtttttgaggggtagttgagggygygggatygtttttygttyggtagtygtttttagttttattygtygttgttttagtygyggtygagygtattttgggttggtttagggygygttttttgggtygtttttttgygygtttyggtttygttattttagaaggygttyg

SEQ ID NO: 6301 - DNA, 1361 bp, synthetic construct
  misc_feature 1..1361: note = Description of Artificial Sequence: Synthetic polynucleotide
  source 1..1361: mol_type = other DNA
gygttttygattttygtygttgggatttttygtygtagtttttgttttagtttgtgttgygggtggggtygggttgagtagttyggygttttttatygygttttttatygtatygttttygatttaatttygttttygggygtttattggtttgtagtattttttttttagtttgtgaagtgagtagggggaggyggtggtyggtygtttttttttagygtttagtttggtttygyggyggaggyggygtttttttygtaggayggagttaagttggattgtygygtygygyggggygggtaaagggggygttgygttyggtttygggtagggagtgayggyggyggyggyggtttygggygagygtggttttygygtgygtataygtataygtygtygygtagggatatayggatttyggtygttagtyggttatataggygyggagattyggttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggagagygggygagggtyggygttaggtaagttttttagatttgaaatgaagttttttttygtygttgygttttttttgygygttaggttgatattttttaatttaagtgtttggygttgygttyggggyggtygatygtygtagattgtyggggtgggggtygatttagttattttaygttttttttgatgyggagaagggagattaggggggtaggtaagttatgyggtyggagggattyggagggatatgtttttttatttttaggtggayggaygtatttaygyggatygggaaggtagggttggagggtttttyggggttaggtatygtaattygtayggggtttgaggggtgggtaagtaatgtgttaggtgggggttggggtaggggttagtgtagaatgtttttttgtggtgatatattygggattgtttaaaagagtgtygttttygtttttygtggygyggaggggttggggttggggatgttagggttttagtggtttttagaagaaaygttttgyggggtttgtggggaaaygtatyggtttttttaggttgaagtgggttygttgagatttttgtttgtygttttagaggtagaagtttttgyggyggttgyggggggyggaggttatattttyggyg

SEQ ID NO: 6302 - DNA, 1175 bp, synthetic construct
  misc_feature 1..1175: note = Description of Artificial Sequence: Synthetic polynucleotide
  source 1..1175: mol_type = other DNA
aygttgtttggtyggagygttttataattyggttaatggggagggagtygttygttaagygtttgttaggtttygattaaygggatgggtttttttygttagagtatattgttttaatttaggagyggttgtaggatttgagttaatgagaygtaattttygttagtygygyggtgttyggttaataggaggtygttygtgttyggtagygtgggaggtgtggggtggygggyggygttgygaagttgagggagttgygygyggaygagttatagtttgttatagggtgggtgygttygttttgtttagttygttygtygtttttyggttttttttgygyggyggtttttggatgggggttttttttyggggggttttaggygygggtaagtyggtygtygtttttttaggtttyggggtttyggtygttgggggygygygggygggygaggttggyggtayggagygtttggttttttgtgggggygtyggtttttttttggggttttgygygtttagggttatttyggygyggtttaggttgygagttttgtygygtaygttagyggttaatatggaggtagtttyggygygtttygygggggatygtyggygttygtgggttttaagaggtyggggygyggygygygttygggttttgggyggygagggygtagygagggttgtygttttttygggtagtttyggggggygyggygttgggtygygggttygggggttgtygtgttygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyggyggttttttgygttygggygatggygatagygataggtttttaatttygtttygggttygggtyggtygggtttygygtygggttaygygygygtatagagttttttygggtttttttaygttggaygtygatygttygttgtyggaggaygyggggaggggtatygttttttyggyggaggttggygtggttaagggtataggggayggygtyggygtttyggtagggatagtggggatttyggggtttyggtttttyg

SEQ ID NO: 6303 - DNA, 1087 bp, synthetic construct
  misc_feature 1..1087: note = Description of Artificial Sequence: Synthetic polynucleotide
  source 1..1087: mol_type = other DNA
tyggtattygygtttttgtgtttttggtggtttyggygttttttyggagygygyggtatgtttgtttttataygtttagtatttttgtttttagagtaaatttattttttagggtataygtagaggggtagttaggtatygtttttattttgttttatttaggtygygygtatttyggaaatttggatttygygattagtttttttttgttttttttygaggattttagyggtagtgtgttttggatttatttgtagtttttaagtttttttatttttgygttttttttaggygtttttgagtttgtagagtttaygatttttaataggttgtttygaagtgtttttttttatatygttttaggaatgatttttttatattygtttttygtaaaaaaaagttggtttaagatttaggygttttaaggattagtttaggtttttattygaygygggttagggggtgttgttttggtagtttyggagtttyggtaaagagtaatttgtagggaggygttaygygyggtttttattattygttagagattyggtttatggggttaaayggaggggtttgtgtyggtygatattttaagttttgtygygtttttttygtygtttatygtatgggatyggyggaggagaaggygyggtygygggttttttgaggtagygtgtttygtttygggaggaaagtttgtgttatatagaggaggyggygyggggaggatttgggygtyggtgggtggaggygtgggyggtggygtygygtggtygtgtgtttgttttttyggygatyggtgygtttgtttttygtyggagttygyggtygtygygttttygttygttgygtttagygttyggygygtttyggttttagtttygaygygttttygtygtygtygtygygygttygtyggttatattttttttttttttgaatttatgtgtaaaatatgttaygttgtatttttagggaaagtttygyggtttttgatagtagtygttggagyggtgggttygtttagtttttttygygttttttyggagtttygttyggttatttttaygyggtygagttgtaagyg

SEQ ID NO: 6304 - DNA, 693 bp, synthetic construct
  misc_feature 1..693: note = Description of Artificial Sequence: Synthetic polynucleotide
  source 1..693: mol_type = other DNA
tyggtagttaaygtttagttttygttttttttttttatttyggatttygtaatygygaggygagagagtagygtyggygaggtattggttgggttttgattgttaygttaattttttgttgttttttttagtttttagtygtttygtttttttttttttatttttagtttgggtttggaggygatttttttttattgattgagtygattgtatttttgggtaagyggygttttgttttttttttgtttttgtttgttttttttgtaaggttayggygtttggagtagggtttgtagyggtygtygtagtaaygygagttaagtygtgtttygtayggtygttyggggtygtattttygttyggtggyggygttygaagaygttagtygygttaygtattgtttgygtttygygttttagtygtygygtattaaygtygtygttttygtygggagttaagttygtygggtyggttyggttttaggtgggtagttyggtttgtagttggttggaggtggyggtygttgtagttttggtagygggtatatttttaagtataygtatttaaygttttttttttgagttaygaggatggagtagttatttyggttygggattggygtaaggtaaggtgtagtygtttgttgtttttygtagagygygggattatttttttgttygggtatttaggtyg

SEQ ID NO: 6305 - DNA, 5065 bp, synthetic construct; identical to SEQ ID NO: 6273
  misc_feature 1..5065: note = Description of Artificial Sequence: Synthetic polynucleotide
  source 1..5065: mol_type = other DNA

SEQ ID NO: 6306 - DNA, 307 bp, synthetic construct
  misc_feature 1..307: note = Description of Artificial Sequence: Synthetic polynucleotide
  source 1..307: mol_type = other DNA
gygygggggtyggattatgagtygttgagtygggtaaattttaggttatygagttagyggattttyggagygtagttttgygtygyggagtaggttttaattaggyggygaggyggttataygtatygagttagygattttygggygaygygyggggttagggagygttaygatggaggygttaatggttyggggygygtttaygggttttttgagggygttttgttttttgggttgtttgttgagttaygtygtygtygygtygtygtttattattaagtttttyggygatgtygtttttaaaayg

SEQ ID NO: 6307 - DNA, 1563 bp, synthetic construct
  misc_feature 1..1563: note = Description of Artificial Sequence: Synthetic polynucleotide
  source 1..1563: mol_type = other DNA
tygggtttygaaaayggggggagggggaygaygttttagaggtttttgagtttttggtttttttygattttaagggtttttttttttyggtttttaggyggygayggygggtagygygaagtagtaggygtaggggygttgggatggggatgtttttgtaggtttaaggttttttttgggagtttaaataaagattayggtagygtygttttttttttygggaattygaygtygygyggttatagggggtttggaggggygggtagggtttygtagygtatttagtatagttygygyggyggagygggtgagaagtyggygggggygyggatygatyggggtgttttttaggtttygygtygyggttttygttygttttttygttygtttatygggtattttagtygygtagaaggyggaagttaygygygagggatygyggttygttygggattagttttaggttyggtatygtttygygggtygagygtttatattygttaaatttaygygggtaygttttygyggygtatygtttttagttyggttttygtttttgtagtygygggtaygyggaggggtttttggttgttygtatttgtattygygygtyggyggygtygaagtttygtttttygtttgygygtttgtttygttygtattttygyggtgagtyggyggygttttygtttttgagtttagggttagtttttttygtygtygyggttgttgygygygttttygtttagtttagtttagtttygagtaygattttagttttaygtaygattttagtttygygagtttygtatygattygttttygttttatttygttttygygggggyggygttttttttttttygyggttttygtttttttttttygttttttyggtygygttggggatttttagtygtygttygygattttttatygygaygttyggaggyggyggggtttttttgttygggyggygggtaygggggattattttttayggtgttatygtatttatttygygtttttttttygttttttggagtttatygggattaggtggyggygggtgtttttttgggggtgygyggttatgtaattggtggatttttttaaatygttttggaggggggagygyggygttgggggygggagagygtttttggttgtgagttgtttttgtygtttygtttygygtttttttgtygtttygtttygggtttttygygttttttttttyggttyggtygagygygttgtttygaygtygttatttagagtygggtygygtygggygtygagatgaaggtgttgggatatyggttggagttgtttataggtatygttygtttgtttygtagtyggtygttatttttygagttggagyggatttygggygyggyggtyggggattggggyggttygggtttgagtaggaaggggtgyggattttaattaagttttagttttgtgttatttgtttgtgtgyggagtttagtttygggagaggatttgaggttgtggygagtttttggygttggygttygggttgygggagtatyg

SEQ ID NO: 6308 - DNA, 512 bp, synthetic construct
  misc_feature 1..512: note = Description of Artificial Sequence: Synthetic polynucleotide
  source 1..512: mol_type = other DNA
tyggtttaagttagygtatttygtygattttttgtttagtttaaatttygaggttgggtaaggtattggatttayggttggatygattyggggtagtttttgggtgaatagtagygtgttygtyggtagagaatygagattagygagtygattatgyggttgtatagattttaygygyggtygagygyggtggtttgtgggtttttgttgttttttttttagggttattatgaggttttygyggaggggtgatagggatygggtttagatttgttaaatgttgyggaggtagaatttgatagtgygggagggtaggygtttgggaggtaggagttggtggagatgatagygtggaattygtgagttttaygtaaygtttttttgtygtttagggtgggtttttagaagtatagaaatggtygggttgygggatattatagygaggaattagyggagtataggggttttaggagygtygggatatgttaggtygggtagatagtttygggtyg

SEQ ID NO: 6309 - DNA, 1070 bp, synthetic construct
  misc_feature 1..1070: note = Description of Artificial Sequence: Synthetic polynucleotide
  source 1..1070: mol_type = other DNA
tygygagaagtataaaaggggaggggygggtygtgtagttaagaggayggttaaayggggaggttttttttttgttttygtagatgttggagtagygattggttygggagattygtgttttggagagaagtaaggagtagttgttttyggagagtgagtttttygygttaggtgggyggggggagggggatgtgttygggtttyggttttgtttttgaygttygtttatygatagggaggttggtgygygttaagttgygggaggtggagyggyggttgtattygtygtttgaggtygagggygttatggyggtgaatgaygggtgagaggggaagggaggagtgggygaggagggtaggggtagggyggaggggaattygtttaggtttttygtttygttttygattgtygttttttyggtttgtgtttttttyggygtygtygggttttygygtttyggtggtttttttttygttttttggattttygtttttttttttttgttttttyggtttttttttygtaggttgaaggyggagttggagatattyggggagtaggttyggagygttttygaggtyggggtyggygagggagaggtagggagttygaggaagggaggyggggygggtagggatygagttaggagagagygggygggggttttgggagyggttttygagagtggggtttgtggggagtagggyggtttyggggatagaggaagtygyggtggaggtttagggtagaygygggyggaygygaggagygtaggaatttggttygtagttttatttagttttyggtaggtyggatttgagttttttygygttygygaygaggaggatttygagtygtyggtggttgtttttgaygttttttaggttagtaggattygttygttttygattttttttygagattygttaagaaataaaggygatgattttygattatgttygygtttttygyggagtttgtgttatatygtggagyggggyggggygtgttgggatttygaggyggggtttttgtyggattttttttattagtygagtttygggygtyg

SEQ ID NO: 6310 - DNA, 766 bp, synthetic construct
  misc_feature 1..766: note = Description of Artificial Sequence: Synthetic polynucleotide
  source 1..766: mol_type = other DNA
aygaattattatttaattygttggygtygttgttgttgttattggttaaggtygyggygatygaygtatagtagaggtagtatagttggagygtttgtaagagaaaaggtgatatygygygtgaggggygyggyggggttggygtygggygttttttgttattygttttyggagtttygttyggyggtatttgttttggttaygygttttagtttygttaggtttttyggygggttygaattygtagtygggaaggtataygygagtaggagggygtattttatggttaggtgyggaygyggyggttgygggtggttagaygyggtaggyggagygtaygggyggygygtatttttttygyggtttyggagttyggygttttaggtgyggttttaggtgagagtygtygtygtttatatygtagygggggygygttgggattttttttttttyggtygtttgygygtttttttttttttyggygygggtttgtygagttgtagtttgyggtattttagagggtayggggggttttttgggtygggattggagygtaaayggttgggagattgtyggtgtttgttygttygtttgtgygtttgtttgtgtyggtgtgagygtttgaggygatggggaagatagygttagttggtttttttagygygtyggagtygagygttygtttttttatygygyggtgattggygattagyggttttygggttygttygagttttygggttggtgtaagggygtgggattttyg

SEQ ID NO: 6311 - DNA, 363 bp, synthetic construct; identical to SEQ ID NO: 6084
  misc_feature 1..363: note = Description of Artificial Sequence: Synthetic polynucleotide
  source 1..363: mol_type = other DNA

SEQ ID NO: 6312 - DNA, 2919 bp, synthetic construct
  misc_feature 1..2919: note = Description of Artificial Sequence: Synthetic polynucleotide
  source 1..2919: mol_type = other DNA
tygagtyggattttygyggagtatttattagggtggttagttggaatygygtgttagatttatatgaaaaattygggagaggaygggttgtygttgttygagtygttttttyggaagtygttgtttattaatttttygtatttttttttgtaygygtttttttygygtattagtttggagattttttgtttgaggtggtygatttgttgtagtagttggttttttttygattttaggaygtgtttttgttgtatttttttgaagyggtaggattgggtatagtygyggttttttagggttygttttttttgttttagtyggattattttttttttgttgatttygygtagttgtyggtttagttygygtatagatatggttattagttgttygtyggagaagyggtygtygaagtgtaggtygtyggyggygtggtgygggtgtagggygtttttygttttygtygygttttygtygttttygtygtygtygtygtygtygtygtttttagygttggtygggttatygtygttygygtttttagygttatyggtygaggyggtygygttgttygyggygtygggygygtyggtygtygggtggtggtggtggtyggyggygtggtggtggtggtggtggtagtgygggttygygtygttttgygyggyggtygyggygattayggyggatattayggyggyggyggggtttattttttygtygttgtygtttaaggaggygtyggtatyggtttyggtygtygyggttagttgttgygtttygygygygtagttatygaagtygttttggagttggtggttgttgttgatgagygtttygatygygttttyggggttgaagtttagygtttyggggtttagttgttgygggtagtyggttatttagtagtagttttttaggtgygttttttgttygttgttygagttygggttgggygtygagaagttgggggaagggggtatygagttgtayggygtgtttatgggggtggaggatagygagttttyggygatgagayggtygtattggttgatgatgyggtyggtttttatyggttttttttttattttaaattttattagatygaagttattaatatattttatggttaggggattggtgggtaggtyggagttgtttattgttagttttgatgttatttttttgtygtygtygtygtygtygtygtygtttygttagatgggttgtaggagaggggttagygggttgtgttgggtggttagygggtgagttagtttgtygggttggggygtttttagtttgygyggyggtggttggttygaaattttygagygygtttatatatatattttttygttttgttygygtttttygygttygtttttttttttttttgtttaygttaatgtgttttttygttygtttyggtttttttttgttygttygtttttttgygygttgagtyggyggttttaggttygggaagatttttygygagttgyggtggyggyggtggtggttgyggyggygaagttggaggagttyggttyggtgygyggygtttttygttygtygtttygttgygygttttgtataaggaagggttygtttygtyggttygggttgtaggtagggygygygyggygttygttyggggttggaggygyggygggygtttgttygggyggygygggttttggtaygggggagttaatattttatgtttttygtttttttttttgtttggttttttttattatttttttttttttttttttttttttygygygttttttatttttgtgtaaagtgtaaggtagaggtgtagttygattggaggagagggaggggggagtttagtttttttttgtttttttttaaaaaagtaaaatagygaagttttggggaaagaygaggtagagagtaaaggggggagggggaggttaagtygataagtagttygagttatagttagaagatgaaaaaagattttaaagtttttgatttagtaagaagagtttaaagtaattgttgagttttatagtattygtgaygttaggtttaaatgagaaattgattggtatttygggttaatgggaggyggygagagyggtygygattagtataatagtatagaaataaggaaatttttyggagttgttaattagggtttaattagttgattgttagttgggaygggttggtttaattttttttgygtygttgtttattygggagggaaygaggttyggygtaaagtttggtgtaagaggggaaggagtttttttagaggggtttyggtaattygggyggatttgggagggyggtttgtttttttttggagygygagataggttttttattyggagttttagttygttgggggtttattyggttgggattggtttgattttttttttttgtttgttttttatttttaggattgtgaattygttttttagtttttttttttygtattaattttggtatttaggtgtttgtyggggattttttttttttgagtttggtygtgttyggygtttaaatttggttttaattttttgttygtttttygggygttygtgyggggaagggatygggaagggagggatgtagtggggtgttyggatyggggttgygggttgggygtygttyggttatgygtttgtttagaaggttgggtattygtggagagggaaagtttattttatttttttttttataaygaggtaaaataagttgtttagaggttattttttayggagatyggttgttygttggygtygygtgtttttggatagagygagygtttatgygagataatttyggggaagtttaaagttaggttagtygggtttagtttttyggtttttgattggtyggagtttggtttttgagatttatattgygygttyg

SEQ ID NO: 6313 - DNA, 2267 bp, synthetic construct
  misc_feature 1..2267: note = Description of Artificial Sequence: Synthetic polynucleotide
  source 1..2267: mol_type = other DNA
tygaaaaatyggttttygttttttattttyggtygattygttygtygaggtggttgttttgggaattttttgtttttygtttaggagaggaaaygtatattygggtyggaygtatagaagtygtattttggttggggttataagtttgatagttatygataagtttttatttataggagtaygygaygtgttttttttttaagggaaaggtttttttttttgggttttggaatgggtttgaagttagtyggttttagtttatagggtgaatgaggggtgggtatagttyggtygyggttttagtatataygggyggaygtaggggygggggagygttagtttygtagtgtgttyggagtttagyggttttgagtygtygttattagtttggtygttttttgttttaygtaagtgaagttagtygtttagggttgygtttttagttatttgtttttttatagaggtttatattttttttttygttgtttttatagtttggttyggggtttgtttaatatagatggaygttttttaaaggttgtgygygttatygttgttattyggttgtgtygaggttygyggtygttaggattttagggatygtatgttaggtagggtttaggatttttagygyggattatttttagtttgyggggtagygtyggggattygggtaggagggagaggagtaggagggagttttggatttttttttttagatyggtygtygttatttttgttttttttagggtygttttyggtttttttattttygggttttygttaygygggtygyggggtttttgttaggaaaatygggyggttttaggggagttygygagatttttagygttygggygygtygtttttttygaagtttygtygtagttttygtaggttaggttttgtttayggggggttgygtttagttyggatgggtgggygttgggygggttggttttattttgtygtgggtattaattttgaaaayggttygtgygttyggygyggttgyggygtagattygggaayggtagtygygggyggagtyggggtagagyggyggyggygygyggggyggatayggtatttayggtyggggggttygggggattyggygggyggyggayggygtatattygygattyggttygggagtygttgttttttttagtttggttttygtttttaygatttaggggyggttgygygttgttttttggygtygtatygggtttaggygygyggyggggttggggygygyggggyggtygtttgggttatgtyggggattyggtttyggttatttygygygggaataaagygygtatttygttyggggyggttttyggttttygyggttygygtygggtttagtygtygygtttgtggttttaaygtygygygttygttygagagttttayggggtttygyggttttygtttygygygtttygttttygttttttgtttttygtygtygtygttgygttatttgtttttygttyggygtttatggygtttagtttygtttyggggygtyggtttggagaggggtttttygtygtygagagtygtttttaaygttttygttatyggggyggygttttaagaattggttgtgggggtyggggttgtgyggagygtygggagtagggagaggggagaggggygyggggagggggygaygggygygtygttttttgyggggggyggygyggggaggygtaggygggggygagygaagaggttgaggggtgygggygtygtggagggggygyggttttggggggyggttttygtttgygtttatttttttttttttygtaggtygygtatatttatttygtagtagtyggyggtygygggtttygtagttttagaatygyggtttttggyggtygygygggaggttgaaygggagttggggggtgtggggggggtggggaggtggggagttgggggggaggtygttttttyggtygtygttttygttttttgtttygygttygtttttagygyggygtttggttyggtttggggttattttygtgygtggtyggtaggggtygygtttttttygtttagtttttygggygggttygatgygaagttttygtttttygygggtttyggggttaggttatttgtatatattttgtatttatttgtatatygtgygttttatgtttatttgtagaaaygtttygagtygttgttttgtttttttygtattttttttgtyggtaggttttttttttygttyg

SEQ ID NO: 6314 - DNA, 265 bp, synthetic construct
  misc_feature 1..265: note = Description of Artificial Sequence: Synthetic polynucleotide
  source 1..265: mol_type = other DNA
tygyggttygygtgggttttaggygygggatggyggygtttagtagygygggttygygtagggygygtagygttgggggtaatagygtggggttyggtyggtagtggggygygggttgygyggtaagtagtttttyggagtttagtattagttttagtattatgtagggtatttaygaggyggaggttagtaggygtygggttyggttaaagtygttygtagtttttagtattygygttttttgttttatyggtygtaggttgyg

SEQ ID NO: 6315 - DNA, 374 bp, synthetic construct
  misc_feature 1..374: note = Description of Artificial Sequence: Synthetic polynucleotide
  source 1..374: mol_type = other DNA
tyggggagggtagtygttygtttttttyggygttgggagttttyggttggtattgygggaggagttttygggtgattygygggttttgaaatygtygttygggagttyggggtttgygttgygtttayggggygagygagggagaattgaygtttttygttyggattttttttttttttygagaattaggtaggtygygtttatttttaagttygattgttttygyggtaatatttgtgggaaatattayggtggattttgtgggtygttgagttttttgattttyggtttgttttattttgttttgttagtgggttttgygttygygttaataattygaatgggtaygtttttgygttttagaaygttgttyg

SEQ ID NO: 6316 - DNA, 1133 bp, synthetic construct
  misc_feature 1..1133: note = Description of Artificial Sequence: Synthetic polynucleotide
  source 1..1133: mol_type = other DNA
tyggygygggtygttttygtttttagttttaatgttgttgygttttaggtygtttygtttttggtaggttttagtttttgatttagtttttygtttagtttttgagagtagttttttygygggattggtttgtgygygygygtttgyggtatygtyggattaggggtygttttygagyggggagtttaggaggayggttaggtggtttgaggtagaggygttagggaggatggagaagggatatttagggtttaggyggggtgggggtagggagggyggygggatagtaaggaagtgggtgtatttgggtgatttagttgygtatgagygggtaggggttyggggygygyggattttaggygttggattgyggygtggagtagygttggggaaatygygtygggtttagygaggattgttgggyggggygygygaggagygaagttggtygggggyggggtttgagtygtgtyggggyggggtttagattygggttggtygtggtgggyggggtttgagtygtgaaggggygggttttgtaggggyggggtttygaggggyggagtttgyggtgattagygagggggyggggtttagagttattaagaagygggatttagtgagggttaaaygtggggygtygggggygtggygyggggygtaggtgtaygtaggttggtygygggygygyggggttyggygggagtttyggggtggttttygygtggggtygggggygttygygygggyggggygaggtyggggagggtagttgttygtttttttyggtattgggagttttyggttggtattgygggaggagttttygggtgattygygggttttgaaatygtygttygggagttyggggtttgygyggygtttayggggygagygagggagaattgaygtttttygttyggattttttttttttttygagaattaggtaggtygygtttatttttaagttygattgttttygyggtaatatttgtgagaaatattayggtggattttgtgggtygttgagttttttgattttyggtttgttttattttgttttgttagtgggttttgygttygygttaataattygaatgggtaygtttttgagtttaagaaygttgttyg

SEQ ID NO: 6317 - DNA, 2358 bp, synthetic construct
  misc_feature 1..2358: note = Description of Artificial Sequence: Synthetic polynucleotide
  source 1..2358: mol_type = other DNA
aygatatttyggtttgttgttatggaaataggggyggattaaggttggagygtggagygtagggattaggtttttyggttatttgagttttygttttagtygttttygtagggtyggggtagttagtygtaggygtygyggttttttagttttttggtygggttaggygygggggggatttyggyggggygttatagtttgttygggtttgggaggggagaggtagaygtagaggttggaatagttggtggyggggttygtgggttttyggygtgattatttgtttttttagggttygggggayggygtttygygtggtaattaygtgggggygyggygggattttttyggtgttygtattaattttgtygygtttygtatygggtygggttgttggggygtttagttayggtggtygygaagttagttgtttttaagttgagttgtgtatyggtygygtatattggyggtayggttttygygttttttygtttttagtataatgaaagtttgaggaattggatattaggygttggtygttttttatttttagtygttgggtgtttagagtttatttttagygattagagtagaattgtagagaagaygttygygttygggtttygtttggggagttagggygygyggggagygttygggtygygyggttattgatygttggttgtaygggggygtygtgyggattyggtttttataaagyggtagaagtaagggygtgtgttygygtagggaatggaggttgtaagtgtaaaattttattttagtaaagtaaaggttttaggaggtyggttttttttttattatyggtygtttattttggttttygattgattttttygggtyggatttttaggtttggttattygatttatggagaaaatttygtgttttataattggtygttgaygggagttgagttttagtagtagtttttyggygggtgygttyggtaaaatttattagttygtygggggttattttttagatygggagtttyggygtygggyggygttygggttygyggtttttttyggagygtatttaattttaatttgtttttgyggttttaatttatttttgygaagtatgttggttayggggtygtygtttygaggtyggtttaggygtattttttttyggggtttagatttaaatttttgggygttagttgtagttaattygagygygtygaggygggggtaagtyggggattygttygtgttyggtggttyggtttygtaggggtatggtgagttttagtttygygtygagggtatyggygttygtaagtaatygtggtgttgttyggtagtttygygygtttgtttagtttyggggygagyggtttgtttygyggagtyggyggtttgtttttgttattyggagtatttygtaggyggttttgaggggggaygtygttttttggtyggtyggtygtagttttttttttttygttttttyggattatygtygtygyggttgtagtaaaagggygttygtaygtatygtygagtttyggggaaagygttyggygygygtttgtaggatygagygatyggyggagyggggygttttttttttttttttyggtttttttttttttttttttttttttttttttttgttttttagttttttttttttygtttygtttttygttttygtttayggagygttttttatataaaatttatgaaagtgtttttagttygtagtgtygagygtygttttatttttaaggtagtagygtttagtygygyggygtygttttttaaggtgtttttattgygttygttttyggggaagatgttyggttygygttygtttaggtatttgtttttagtttttaagtyggttttyggattattttaygttttttttyggtttygtaggttttttggagttygaattygtagtttagttttygttygttygtttttygyggttggaggttatygggagaygyggttgggaygygaggatygtygtttagagtayggatygygagttygttttttgtttygttttttttttggttagygtttttttttttagtttygayggttttttttygtattgaatagttttagygaattyggttgtttygtatttygagttttaggatattgttttttygtggggagaggaggggagtaagtattyggaaagggttagttgtaaattttagggagaaggaaggattygtgygggttygggtgggtygttttygtttgggtggggtggyggyggggggtttttgattttttttggtttatatagatttygtyggggggttygyggaaaatggaggaggygtygtttggaaagygggtttyg

SEQ ID NO: 6318 - DNA, 1050 bp, synthetic construct
  misc_feature 1..1050: note = Description of Artificial Sequence: Synthetic polynucleotide
  source 1..1050: mol_type = other DNA
gygygygtttygggagagttgtgtttttygygaaattygtgygttttagtttagggttttygggatyggtgttygttagtgggtataggaygtygggtgttygaagggttgtttggagatgtaattgattttggygggtattagaatgaygagtggtagtagtaggagyggggtgaygaataagattaygaaggatttgaatttggagatatagtttagygtygaggttatygygygggagggagattggygggygagaygagtgaggggtagttagaggygtygygggtttaagaaggggttatagttttyggggattggggagggggyggtgataatttygtttygtaygggggygttttttygyggttttggggyggggttatttttyggggtttgtgggaygygtttgtttttaattttgttattyggyggyggtgggaggygtttttggattttaaygtttygggttagttttttaggggtagtttgggttttagtatttygygttgtttaagttttttttgygttgtygaggtagaggtgygtttyggggttgttaagyggggygtgttttggttattggtgttgttygttttggygtaaggygttttttygygttygtatttgtttttttttgggttttgaagggtttyggatgaaattttttgtaggtttttgggttttttaggtttattttttygattttttttttttttttatttttttattttygttttttyggtgttttttygagaggtgtttttttaygtttygygtttttygtatygygggtttygtttttyggttttttttggttttttygttaygttygttttattttaggtgtaggatttttttttttygttygtatttttyggttyggagtttttgggygatygtatagggaagygaggttattgtttttttttgttttaggggttgtygygttttagtggaygttgtatttygtagaygttyggygggtagatgyggataygygttttggaggggttttatygagttttagtagtygtagttgttygttyg

SEQ ID NO: 6319 - DNA, 1731 bp, synthetic construct
  misc_feature 1..1731: note = Description of Artificial Sequence: Synthetic polynucleotide
  source 1..1731: mol_type = other DNA
tygggttygtttygtttatyggtattaggygaggtttttgtygtagttgyggtygaagaagtggggttyggygtttayggygygtaygtyggggtgtaygygtaggaattttagtagygttygygtgtygtttttttttatttygatgatgatggtttgyggtagttgtttgttgttttygtttaggagtagygttagggttttyggyggggtttyggttayggtgttttyggtttyggagtygttyggattttttgataggttaggggatttttttttttaggtygttttttygtygtygtygyggggygygggyggtyggygttttygttattgyggtagttgtaggaggygttttttttgtgtygtygtyggttatatygttagttttttygggttttyggttaggaygtygttattaggggttttygttttttygtygtygtyggatagttttaygayggggtyggatagggtttggtagygttyggttaggtagtagaagaygtaaagggaygtgagtagggagtagagtattagtaagaattttyggaagatgttgygggatagyggttyggtygaggtggagagggtattggtygggttyggaggggttattttagtyggaggygaygtygggtaaygygtyggttatgttaggtttggatttygataggtgttagagtattttttyggygggttagygygttggayggaggttatatygtygtgygtttttgtggtygtgygaattgtttygggaggtagyggtyggggtttygyggggaaayggaatttygggggtttygygtaggatttttgtttttagtygagggagygggaaggggaaygygggttygtgtttaagaaattatygttttagattygtttaagttttgagtttggggtagttttggtttttyggtttttygtaagagtygtyggaatyggggttttggtagyggtgtygaaggygtgygttttagtttyggtttygagagatttttyggygyggattttygtttagygattttgtattattggttyggttttygtgagggtaygygyggttgtygggtttttgygtttygtgygttttagatagtggygagygatagtgatttttagtttyggttttttttggtttttttgttygtttgggygygtttttttygttygagtttaggtttttttagttaaggagygaggttttttygagtttttttgttygagygggagataggaggttygtgtagagtygtttattttttttygtagygtygggttgttttaaattgtttttggattttatttgtgagtygygtggttgggttgggttgggttgygygggatttgttagyggttttygttattttgttygtaggygtttatyggttgttttttgggtygtygttggtygtygttataygtgggaygtygagggtagtaaatttgttggtgaygttaaaggttygggtyggattagttttyggaygagygtagyggggygyggattagyggttaggyggggttagaygggyggggtgggatggagaaaaggtggygygggtttygtagtagtygtttaatggtattggagagggygggggyggtaggggygaygttttttttttagtgttttttattttttttygyggtttygtttttttttagtggattyggtgtttgyggyggtttyggggttgtttgagtgatagttaaggtyggtyg

SEQ ID NO: 6320 - DNA, 3535 bp, synthetic construct
  misc_feature 1..3535: note = Description of Artificial Sequence: Synthetic polynucleotide
  source 1..3535: mol_type = other DNA
tygtttttttgggttygttttttgtttygaagttaatagtaatttttgatygttttatatygtttagaagtttttttatattttttygttttgggagygggttggttgttgagttttyggagaagygtttgtatttgtatggygttyggggtttttggtaggtagagtagttygttattttggaaggtygggatygtttattttatttyggtttatagttttttttttgygtagttygtttttgtagtttttgyggggaagtgtyggggttgttygaggtttagtttttaggattgtaaggaggtagtttyggygtgyggyggtgygtatagtttagagtggttagggygygagagtgtaaygtttttttggtttygagygygtygtygygtttygggagtagattttygtttagtagttatygtygtttygatttttygttttagttgtagtttttgtygggtaatatgttaagagtygtygtygttatagttgtygtygttatttggggaagagtagtagtagtagyggyggtygygggtataygggggtaataaatygagttattygggygtttagygtgtyggggaattttttttgygtttattgttyggygggatttaygttatgtgttgagttatgtttttggtygygttygygggtagygtatggggtagygtttgagtggyggtagattttgtttygatgttttyggtyggtttttatygtagtygtygtygttttygtygtyggtgaggaggaagttygygttgtttttygttatgttttgygtttggttttatatgtttttgtattygtgygtyggtttttgygtygtygygtyggggttgttgtttttgggttttgggtttygygtygtataygattygttagttttggttatagtttyggaygggaygttttttaggttgtygtttygggygtygttagttattttattggttttaggtaaggagatggtygagggygttgygagttyggaggagtagagtttygaggtgtyggattttttaagttttatttttagtttttttagtgggtttgggagtaagtagttgtygtaggttattattatyggygtgaagaagggyggtaygygggygttgttggagtttttgygygtgtatttygaygtgygygtygtgggygtygagttttattttttygatygtagttaygataagggtttygtttggtatyggtgagtttttttgttaggggtagggtttttatygtygatttagattttgagttaagggagatatggygtatgatagggaattggtagggttatagtttyggattattyggggtagggtagggaaattayggtagattgygtagygtattttgttygggtgyggtgagggttgygtttygtttggttttygttataatttatagaaagttttygyggagtattggtgtttttgaatttattaggygatttygtygtaaagaagaagggtagygattgagatygtttttagtaaagygagttattttttaattatgggggtattygattygaatygtattttatgattygttttaaatttttttttttyggagttygagaygttgggaatgttttgagtttttttggtyggttttygtttttaaggaatttttagagtagtttttgttttttagatggggagagggggtgggggtygyggygtttyggygaggtygtagagtttgttaattttttgttatagttygtttggttatyggaattttaagggtgttagattygtttygttygygagtygtttgggttygggagggtgagtygggygggtggttyggygttttygtttggygggygggyggygygyggagygtggagttgtgttggtttttgtygggtaaaggygygtattgtaatyggttggagyggygygaggttttgaaggygttygggttttygggtatygtygttygttttygtttttttgttttyggtgttgggatagggaaagtaaggaygygtgttttygyggggtttttataygttyggagtaaagaatattyggggtttattgattgagaaatgagggttgtttygaggtygyggttttyggaaattttgttttygagtygggttgygggttaggttttaaagggatagtggtttyggggttataattattatttttgtttattgtttttygtagttgttggtttttggggtgagttgttgggttgttygagtttygggtaaggygygagtgggtaggaggtttagatttyggttttygataattgttttygattaggggtttaggtaaygatttttatattttygttggggtttttattygtaattttagttagtaygatatttagatatttttttaggtttaattagttttatagaygtttaagatttgggaaaataaaagaggagaagataattgaatttttttttttgtgtttattttattgtygggatttgggtgggttggagaataaaagagggttgatttygyggattaaaayggttttttttttagtttygttttatttttttttttttgtttttaatggttttttattattgttaggagttgtttaagtttygaggtttagttaatygtgatagttattttttttatygttttygggttgtgatttattttygggatattggtggataagaatggggtttttggagttygaygtttggatttaygttttggttagtygygtgaattttggtgtttttatttgtgtagtgggaataatgtaggttttgggtagggatgggaagagtgaatgygttggtayggtaaggtgtttygtaggtaygtgagggtttttttaatygttagttattgttatygattgtattgttatgatttttattattattattttttttttttttgggatggtgattttagggttaggyggtaggttataattagygtttttttaggtggaattygttagagtttygaggtagtttaggattttttgagattagatatatttgggtygggttgggaggaattggtaggaaaaggattgaatttttaatgttaggyggttttgaagtatttggggtaagttatggaaatttttataggaaggtttaygtagttttttaggyggttgttttttatttgttaygttttttttgattgattaaaaaaygttgaatgaagaaygaagtygygtggaaattttygtygygygtttgtagyggatagygtagttygggaggttyggttgtygatttgygttygggggttgygttgygagyggttaygtatggyggttggattygggyggtygtaagggtttggttgggtygygggaggygggaggtttttygttttttygagttatttttttgaattgataagtaggattttygggtttagggggtatagggttyggggyggtgattyggyggatygggttgtyggaggagtttattgtaaatgtygtaattggttttaaatattgygtttttggattgtattagtagtttttggygyggtyg

SEQ ID NO: 6321 - DNA, 2896 bp, synthetic construct
  misc_feature 1..2896: note = Description of Artificial Sequence: Synthetic polynucleotide
  source 1..2896: mol_type = other DNA
gygtgggyggtgagyggtygggagaggggygggttagttgagygtttaattatagtttyggggttyggygttygttagttgtatttagaattttttttatygtggttttgttttgtggygtttaattaygtgtttttagggttttggagyggttgttgggattgtagygaagaggggttygygttattttygttaggttttaygygtyggttttgagtgygtttttttyggtygtygggaaatttagaggygyggtttggttttaaggttttyggtttygtttttttttgtttyggtttagttttyggttgttttygggtygygatttattttttttggyggtttttgtygtatgtttttgtgttgygttagaattatygagttttagttttygttgttttttyggttagtaggygttttttttagttggggagggttttttaaattttgtgtttttaggatygyggggtyggtaagyggtaggatttttaagttgygtttttgatgyggttaggggaggygygygatgaaggtttttttttttttygttttttttttaygttttatygttattataygtygygttgygtygygatttyggygttgtttgttggygttttaagyggtttttttgtygyggtgygattttygaygttaggaggattaatttttattygttaggttttagattttaygtagatttagttatataygtaatygtttgtagatatttattatagttttttaagttaatttaaagtttygtataggygtattgtttttatatgygtagttttayggttttatatatttattagtttattygtaaataggtttatatggttatataattgttttttggatatttagttttaygtaggtataattttatatatatataatygtatataggygtaattttatttaygtagtattttayggagttatataatttttttataaataatygtatagatatagttttaygtagygttatattatttagttaaattgagatttagaaatatatttattagtttgtatttagatttttttttttaagtttygtgatatttattygtaggatagattagaaatatatagttatattgatatatatayggatttaaaygtatagttaagattttattygtaggttygtaagttattggaaaaatattaaagygttttttttttttttttttttatttttgatatatataygtttgygygygygygtatttttatatttatatttttygtttttaagygygtyggagtttygtagygggtgatttygaggtttygyggtgagagttaagggagygttttttyggygtttttttttttygtttttttttygagtttatttttygttttttygttygttttttttttttttgtttttttttttttttttttttttttgagtttggggygygggttgygygtagttaagtttttttatygygygttttttttygygygygtttygygttagtatygygtttatygagtggatgyggttayggggtygtttttaattattttttgattttyggyggtttgtgaataatggttattgagggygttygtaggggttgttaagaaggaaaygyggggygygagaggygyggygygygygggagygygagggaaaggagygagtttggggtygttgtaagyggttggygagagaaaggattygtgygagygtttatatttgttttttttaaggattttatttggttatygygttttggaagaggygagagggagagygtgygygagaggagagagayggygggggaaagggagayggygagaygygtagygtyggygttygggagatttaggaggagttygtaggtattgttggyggyggagttttgtgttttyggygggttgttgtgggygttagggtttttygagttttyggttygtygtygygygtagatttgttyggagttyggggttgtaggttggggtygtygttygtygyggatatttttttygyggygttaggattttggttggagttgyggatttgtatgtttgggggttttttaygttggttgagggaatyggttttagaagaaggaattttttttttttttttttttttttttttttttggtygtttttggttatagtttggttgtgttggggatttttttttttttttttttttataaagtattggtgagyggttttgaygaatgtggtattggyggaaggtatggggttgagatggyggggttggtggttayggatggggaggygagagatgttagagaaggaaggagttttgtttaagttygtaatttgygtttygaagttggtyggatyggggagggygattygygygttygattttgtttygggtaatygatgggaaatttttygagagygyggtttttttggggattyggygtttttgaygtttttaggygttttttygggtygttgyggttttttttygtygttygttagygtttaaggtygygttttttttattttygtttttttttttttttyggyggttttyggatttggatagagttgtaggagtggttttaaatattttttttggagatttttttttatttttygtaygagagtttgtttagtggtttttttgttttgygttttagttttaygygyggtygagtggttaggttgataatgaaatttygtatttttgtyggggggagtggggtggggaggaggttttttttggggttgttgattttgggtttygggtagggggagggggtttttgggggaggggtttgttttggttagagaygtygatttgggatggygtyggggtagggagggggttggggggtgggygyggygaaggyggtaggtttgggttygyggtygggggtyg

SEQ ID NO: 6322 - DNA, 2567 bp, synthetic construct
  misc_feature 1..2567: note = Description of Artificial Sequence: Synthetic polynucleotide
  source 1..2567: mol_type = other DNA
gcgttgggcgatgagggatcgttgggtaattgggggtataggatcgggtttcgttgggttcggggtagaagcgtcgaagtttcgattcggaacgcggtgattttattaacgtagaagttcgcgtagtcgagtagaggagtttttcgtaggcgattttcggatagacgtttttgcgcggttcgcgtggtttagtttcgttttaggaaatttttcgcgtagttttcgttttatgcgtttttatttagttttttttcggggtcgttttttttttaaagtagtttttcgggtttattgggcgttttcgtaatcgggtcggaatttcgaacggtttcgcgtgttattcggttattttggtaatattattcggcggcgttcggcggtttaattttagtttgcggtttttttcgagtttttcgtaaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttttcgtaagcgggtaacggggtgtatcggtagtcggaaaggggcgttcgttcggagtttggagtagtatcgcggttttggcggggagcggtcgggtttttagggtttcgcgcgttcggggtcggggtagcggcgttcgttttagtaattcgggaagtggggtcggttaggcgcgttcgtagttttaggagttagtagcgtagtgttttggtcggttgtttcggcgcgtttttttttcggggttcggggcgaggcgtcggtcgttgggcgcggcgggcgcgggggtcggggttgtcggggaaagttaaagtttcgggtttttagcgagagtttcgtaggcggagttggaggaaattatagttaaatagttatttcgttttttttttttttttttcggggtttcggggttgagtaggggttttttaggtttttagttgtcgatttagttgtttgcgggtgattttcgggttcgacgggcgtttatagttggcgggtagttggggcgggagagttggggtttttggggagtttcggcggttatttcgttgtaaatatatacgtatatacgttcgtcggcgcgttcggggtttgtttgtgtttgggattttagggttagatggaagagggggttcgagtttagagttcgtggtgggggtgtttagaaagatttttttcggtaaattttgttagttcgtcggggttttcgggtttttttggtttttgtttggggtggtttagggtttattagagtatagttgtcgtttttgttgggtaggttgtttttgagttttcgtttttttgtcggggtatttatcgagttcgtgtatttgggtttcgggttggaatcgcgagcggggaggatagaggtggaggcggagagtagcgtgcggttttcgagtttgtttattgggatgtattgcgttttcgcgttggggacg

SEQ ID NO: 6323 - DNA, 573 bp, synthetic construct
  misc_feature 1..573: note = Description of Artificial Sequence: Synthetic polynucleotide
  source 1..573: mol_type = other DNA
gcgtttaagaagtcggggttttttttggttacgcgttttcgggggcgttcgcgttttttaggttttggttgtttgggcgtcgattttcgggacgcgtcggtcgatagtaggggaggcggtagtagggatcgtagtagttttcgttttcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcg

SEQ ID NO: 6324 - DNA, 383 bp, synthetic construct
  misc_feature 1..383: note = Description of Artificial Sequence: Synthetic polynucleotide
  source 1..383: mol_type = other DNA
tcggtttttatagcggtttcgggttttcggatggcgtgacggtttgtggggtttgcggggtgcgttgttttcggatttgcggggggaggcggttgagttggcggcgttcgcgggtttagtggtgagtgcggcgtttttacgtttagttcgacgttttcggagcggtcgtcgcgtaggggtgggcgcgggtttttaggagggagggcggttgtgaacgcgttttgtttttcgcgttttcgtagttttttgcgtagttgatgatttttataattagtttcgttagttttattttttgtggatatttgggtaaggtcgagtcggacgttgttacgttcgtcgttacggtgggtgtttgatttcgtttttgtaggagtcgacgggcg

SEQ ID NO: 6325 - DNA, 853 bp, synthetic construct
  misc_feature 1..853: note = Description of Artificial Sequence: Synthetic polynucleotide
  source 1..853: mol_type = other DNA
tcgttttaggggtatttcgtaggcgagatttttgtagattttagttaggaaacgttagtgaacggtagcgtagggaacggggcggggtcgttggtttcgtttatcgtcgcggtgttgggggttgggggtggttttcgggattggtgtggagtttgggtttgatttattgatttggttgagtggggagattggagggtcgtattcggagttgggttcggggacgttcgttggtgggaagggtgtgcgcgcgtcggaggtcgcggttgattttgtttcggcgttgttaggtacggtattagttcggatagtattattttgtatcggtagagtatcggtacggtgtttatcgtggatttggtttcgcgttacgagtgtgtcgcggtggtgttgtattcgtcgtttatttcgggtatgcgcgtcgttttttttgatattaagacgatttattgtttcgacgttttttttaagtgagcggtttgggcggggacggaggcggggcggggacggaggcggggcggggttcgggtcgggcgttaagttttattcgttttacgtttttttcgtagtatcgagaaggtgttttagattacgtcgttcgtgtttattatttacggtacggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgcgtttagcggcggttttaatcggtcggattttagtaataaggcggttttcggattttatttcgcgtcg

SEQ ID NO: 6326 - DNA, 1062 bp, synthetic construct
  misc_feature 1..1062: note = Description of Artificial Sequence: Synthetic polynucleotide
  source 1..1062: mol_type = other DNA
tcgggatgaatgtagttacggaacgcgttaatgtaggaggtttttaggatattttgagcgttcgggagacgttaggcgcggtagcgggtacggatagcggaaaggggcgcgatttcgcggaatttttcggtagggtagggtttttgggtggtttcgggtgtttagaggaaggggtgggttcggggacgcggagggaaattggggacgcggagggaaattgaggtcgcggaggacgcggtcgttggtagttcgttgcgtttgtcggtttcgcgtgggtcgttttattcgggaggacgcgggttttttttgtttgtagcgttttcgtcgtcgtcgttttcgtcgttttttttttttttttttattttcgtcgcggttttcgtttttttttttttcgttttttattgtttttttttttttttttttttatttttttttttttttttttttttttttttttttttttggagcggttggggttgcggcgtcgttgttgatacggatcggtcgcggtcgttatcgggcggaggttgcgcggcgtagatttagacgggcggtttcggagggcgcgcggcgatggcggcggcgggtaggcggcgggcgcggcgggcgaggggttcgggttgagttgcgggtcggttcggatggcgggcggcgcgggttggtcgggcgttttcgcggttttgttgcgtttcgtgcgtcgtttgcgcgaggtgttcgaggtgtgcggtcgcgatttcgacggttttttgcgcgtggagcgcgtcgcggcgttcggattgcgtttcggttagggcgaggaggtaagttggttcgattttagtttcggttcggggattttagtttagtttcgtcgttttttttttagttttttcgtcgggttattcgcgtggttcgaggcggtggttttttttttaatttttttttttcgtcggagtttaggatttcggtttttttcgggtatttttggtttagtcgggttttcgtttttcgtttttcggcgttcgtgtttcgagcgttacgcgttacgtttagggtggtttttgcgtttatttttttttttcg

SEQ ID NO: 6327 - DNA, 918 bp, synthetic construct
  misc_feature 1..918: note = Description of Artificial Sequence: Synthetic polynucleotide
  source 1..918: mol_type = other DNA
tcgtcgtttttatagcgcgtttttaatatcgttgtttttgtttcgcgttttagagcgtttttagtttttttttttattttttttatgagtggagtcgggtttggggcgttttaggcggtgacgatttgtagaagtttttgagaatgtaagattttttggagttttcggttcgttagggtcgggtttagttaggacgtttcgtttagatttttttttagtttggggtgggtttaggttcgtttgtttttattgttttgtgttttaggagttttcgttcggagtttagattcggtgttcgaagatgagagtgtcgttttttttcgtcgggtgagaagttagtttacgtttcgtcggttaggtacggtgtttttcggggcgttttacgggaatttttgtgtttttatcggcgttttcggcggcggggtagttttggcgtttttttttcgtttttggtttaggttcggttcgcgggtgtagttttttttagggttttttttttttttcgggtcgcgcgttcgtttcgtatcgcggcggtttttcggtagtgtttgtttttattggacgtatagtgatcgtgacgggtacggggcgcgagtttttattattataatgggtgtgtatggcgcggggcggggggcgttgtcggtttcgagcgagggaggggagaggagggggtgcgttcgtgttttgttcgtttcgagttttcgagttcgcgttttattatcgtagcgagtcgtttttttgggtcgtttttttgttttttttttttattcgttttttttgtttcggttgttcggagatatgtttggtggcgatcggggatttagagttcggtagtcgtttttgtttttgtttttgcgatttttgttttttttttttgttttttcgcgtagcgtttttcgtcgcggaaatttcgcg

SEQ ID NO: 6328 - DNA, 865 bp, synthetic construct
  misc_feature 1..865: note = Description of Artificial Sequence: Synthetic polynucleotide
  source 1..865: mol_type = other DNA
acgtgcgcgttcgtcggagattagggatgaggttattaaatgattgtttcggttaatttttatttcgtttttattcgtatcgttttttttttaattgatttaattttttaattttagtttttcgtttttggtatcggtttttttttaagtttttagattttaattttggttttcgattcgtttcgttatagtttgggaagcgggagaagtagcgcgcgtttttttgcggatttttttttagggaagattgtggtgttagttgtttagggggattagggggttatcgggatttagcgtaatttttgtttcgttttttaattttcggaagcgttaatagtacggtttttacgtaatgtcgggtttttaagtatttttaattcgtatagttttcggggaggtcgcgtagatatcggggttttttatagtttattattttggtgtttgaagttattttggagtttttatcgtaggggcggggattagtgttaatgggtagcggggtttggtttttttaattagtattttagaaagagggtttaggggcgggggcgggtggatagggagggaacgggtttgggtgaaaggggtttgtggagtttaaatttagtgaatagggttttaagtgtcgtgttaggacgaaaagaaggcggaggttttgggataggagttggttcgggggtcgggggacgtttatttgcgtttcgggaagtttttagtttcgggcggttttagcgtagtcgggcgtttagcgtttattgtttgttaatcgttagttcggtttttaaagcggtaaggttttttcgcgagggggcggaggttcggaggagaggggaggtgaggagaacgcggaggtcggtataattcg

SEQ ID NO: 6329 - DNA, 408 bp, synthetic construct
  misc_feature 1..408: note = Description of Artificial Sequence: Synthetic polynucleotide
  source 1..408: mol_type = other DNA
gcgttcggttgttaggtaattcggttttcggttttttacggcggttttttcggtgtgttttattaagagcgatagggttggtgattcgaggggcgcgtgcgcggtcgttagtttgggatttgtacggatttttttttttttagtacgttcgttcgggggttttttttttgttacgtcgttggggttcgttcgttatttatagttttcgtagagtttttcgggtatatcgcggttggtcgttcggggttaaggatggggcgggagcgtttatttattttcgcgtcggtcggggtatttaagaggcgcgttcgtagttatacggcgtttcgtttttcgtttcgaaaaagtttttgtttttttggcgcggtgtggcgttttcgttagtttagtcggatttttttcgtttcg

SEQ ID NO: 6330 - DNA, 2245 bp, synthetic construct
  misc_feature 1..2245: note = Description of Artificial Sequence: Synthetic polynucleotide
  source 1..2245: mol_type = other DNA
acggtttcggggtttggcggggaggtttatcgttgtttagagggttcggtcggtcgggagggggcgttgtgttttttttacgttttgttcgcgggtttttagtagcgttcgtcgcgttgtaacgtaatgcgcgttcggtttttttttgggtagcgtttagtgttcgtttgttttgtagggtatcgtcgttttttttttattttggggtttttaggtttaaagggtttttagatttagttttttgtttgaattaaagtggttaggtatttagtttgtaagatgaataaatgaaggaaagaaggaacgaatgaataagggtttattttgtagagcgttcgcgttttagcgcgtattaggtatattagtgttaaaggtgttgggggtcgggtttagcgttcggcgcggttggaatgggggcggcgaggagttttttttagttagtcgtagggcgggaattgtttaaacgtaggtcgtagttttattgggtttcgcggcggtttcgtttagtagggatcgttttgttttttagtttttaatagtttcgtttttataaatttatttgagtattttggtttaagttattttagatttttgggattttttaggtttcgatttcggtcgggcgggaggttgattttttatcgcggttttttttttttattttcggttttttttcgggttgcggcggtcgttattgttgttagcgcgtttcgaggattgtcgtaaatttcgggcgtagggaaaggggattttggcggcgggatatagagagcgggtcgggggaaggggagggaacggaggaggcgaggaggagttgggagggagtcgaggggcgaggcgcggaggagggatcgaaggggagcggaggggagagggagggggaggaaggggaggggacgagttgggcgagggggcggggagtcgaggcgaggagcggcgcggatcgtgggggaggtggcgggggcgaggtcggtaagaggcggtcgcgggtcgggttgcgtcgggaaacggcggttagattttttcgggaaggggcgagcgagagtcgggtcgggtcgggtcgggtcgcggggtcgggaagcgtcgagtcgggtatttttttattaggtagcgatcgaggagttcggtcgtttatttcgtgtcgttcgagttcgtagtcgttcgtcggtttttttgggatgttcgtaggattcgggtatttaggacggtagtcgagcgagttcgaggatgggagggtattcgtagtttcgtttcgttaaggtaatagttcgtcggttatttttcgagcgttggcgttttcggtttttggcggacgcgggacggggttgggttgtgggtgtgatgggggcgggggcgttgggagagtcgtgtttaggtcggggaaggttgggtttcggggtagtttaattttttggatttttggagttagggttgggtaggtagggggagatttaggtgagaaaagaaatcgtggcgaagtcgtcgggatgttggcggaggagggggttcgtttattcgggtagtcggtttcgcgttaagaatcgttttaggttttcgggtagacgtttaggggaggggaggttttattttttacgttttttttgtagatttcggtttcgggattggagattttgaagcggggtttttatttcgttttagcgtttttaaatagtttttcgatttcgtacgttttcgttttagttttgggagcgcgttttgttttttttttttcgcggcgagttgcgagttcggagagatgaatgtcgttcgcgtttgcgagtttttgattaatatcgtagtttcgggggaggagacggtgtttttggcggtagtttttgtttttcgatcgcggttgggagcgcgacgttcgtttttcgagtttgggtattcgcgattttcgcgttgcgcggtcgattttgcgacgcggatcgggcgttggagtttaggaaagtagttagatcgtacgtttagcgtttgttcgttgaagttcgtgggcggtgggggcggttcgcgggttgtgtgagttagggaagggtcgggaggtcggtagttcggttcgtcgttcgtgttaggcgttatttgtagttttaagcgttttttagagcgttttggttttgtagggtataggcgcgttcgttgtagtcggtcggagaggcgggtgggtttttgcgttgttgtcgggatatttcgtttcgcgttagtttgggtatcgttttattcggggttcgggatttcgtagggttcg

SEQ ID NO: 6331 - DNA, 2972 bp, synthetic construct
  misc_feature 1..2972: note = Description of Artificial Sequence: Synthetic polynucleotide
  source 1..2972: mol_type = other DNA
gcgggtcgtagtcggagaggaataggaatcgtagtggggacgttttggttttcgggtttatagtattcgggacggacgcgtagtagcgcgggtcgggaattgggtattagggcgggatgggtgagaggttttaagggataaggtagggagaagcgtagcggggtgcggggaatcgtacgttttttttttgtttttgttttttatttcgaggcggtagggcgggcgggcgcggtttcgggggtgggcgggttgggcggggcggaggcggggtcgtagtattggttttatttagtttttttcgttcgtagttagagcgagtcgagtcgcggttagtttcggcgggtagggggggcgttggagcgtagcgtagcgtagttttattagttcgtaaagcggatcgagttggaagtcgagcgttgtcgcgggaggcgggcgatgggggtaggtgttatcggtcgcgttatggacgggtcgcgtttgttgttgttgttgtttttgggggtgagtgttagtcggagggggttcgttttttttttcgggattagaatttcgagaagagtcgggcgtcgttattaaggaaatagaatagagtattggggttttagatattgagggtgggtggtgggaaaggatttttgatgtcgggattacgaaggagggtttagggttttcggagcgtagaggcgattttttagggtggagatgagggtaagatcggagtacggatgtcggtttttaggtatcgtagggggcggtgggggagttgggaggggttttttaagagggggtatggggtttttcgatgtttaggtttttcggaagaggatattcgaatgtcgggatttcgaagggattttttttttagtatttcggtttttggagagtcgtgggatagaattaaggcgagagaaggagggggaattggacggggattagagatgagaggggcgagttgggttggggcggggagttcgggacgacgggatggaataatggaggaggtcggagggattggaggtagaggggattcggtaaggataatggggatcggttagataatgggggggaggggcgtcggagggagaggttggggagcgggagagaggttgagaagtgggttagggagggtagaagaggggcgacggcgagggcggtagagagatggaagtagaaggaaaggagatagagcggggcgcggattttgaagtggtcggggtttcgtttgttcgttgagggatagtgagacgagaagagagagtagaggtttggatatttttagcgtttgttttcgcgtttttgttcgcggttttttttagtttcggaattggggttgcggatttaaggttgggaggggagtgtttatttcgtcggggcgaattcgttttcggggtttttttacggtcggcgggttttttcgacgcgcgtgtttttacggtttgaagtagcgtagcggatcgcgagggacggagcgggtgtgtttttattcgggttggcggtggttacgtttcggggtgtagagcgtcggggcgtattaggcggggattttttttggtcgcgcgtagttttggttacgtaggcgggaggcggtaggtagggggcgttgcggggcgaggtaagtgtagttcgtcgttgtttgtttgcgagtttggggttgcgcgtcgttttttatttagttgcgcgattcgagcgtcgcgtttatcgcgtttcgtgggttttcgcgtttcgaagggtcgggattcggtttgagttttttttggttttcggtgtaagtcgttgggtatttaacgagacgggggcgttcggacgtttcggattttgtagcgcggtatttcgggttatcgattcggtaaaggtcggcgggtttttcgggtggttcgacgagattgttagatgtggtttgttttatggttatgaatcgaatgttttggaaggtttggtaacggaggaggcgtttttatttttttcgttagtattttttattagagtattgcgttttaaatttcggttttatagatacggagattgaggttttgagagtttaaacgatttggttaagattttatagtaagttgggttagagtcgtggttagatttttcgatttgatttttagttcggtatttttttatttttttagggggtagtcgttgttttagttcggggttacggttgcgttttttagtagggcggggggggttgatattgtttttagagttcgtcggcggtagagtttgcgggtgaggtgggtagagattttgttcgggtgcgggttttagttcgaaagtttagttttagttttttggagttgttaggatttgtggttgcgttcggggatttgggagcgatcgcgggtacgtttgttgattaacgtcgttggttagagacgttgtttagacgcgggtgggcgagcgtagattaggagagcggggaggagggatcggattttagaggggtaacgatttgggtttcgggtttgggtaagagcgagggttttcgcgcgaagatttaaggaaggaggggagttgggcgtggaggatttgggcgtttgggaaggtgtatttcgataggaatttgtcgtttgtagtttttgcggttttcgttttcgtttcggcgcgcggttgttcggtttgggatggttgtgcgcggttcgagtttttttttgggtcgcggtgagagagagagggttgaaattagagcgcgtttcggcgggtcggttggcgggtcgcgtcggtaatggaggtattttgttatttagacgtttgtaattagagtcgtcgggttggttaatgcgtttaatagggatggaacgagggtagtaaatgggcgtgcgtgagcggtcgggttgagttgggtggatggtggatggggaggtagtttcgcgggggacgggtttttatcgtattgttttagtttagtttggtttaagcgtttcgttttttttttgggggatcgcgtggggaggcgggaataatcg

SEQ ID NO: 6332 - DNA, 1026 bp, synthetic construct
  misc_feature 1..1026: note = Description of Artificial Sequence: Synthetic polynucleotide
  source 1..1026: mol_type = other DNA
gcgggcgagtggagtgttttttagatttcgcggattcgacgggagggattttgtaatgtttaattagaatcggttgttatggcgatagtttttaggtagcgtgggttgagtttttcgtaggaataaagggtgggtcgtcgttggattttgcgcgcgttcgttattaattttttttttagattcgagaggggcggcgcgtttcgttttcgggtcgcgtacgtcggtgttcggcggcgcgtacgtttgcgggagttttttttaggtaatttagtgttgatcgttcgtgtcggtgcggtcgttaatcgtttttgtcggagttttaggtttaaaagtagttttttattttttttgggttttttttaatttttttttcggtttgttttggggtatgagtagcgatggtcggttgtatttttgaggagaaaatttatcggcgttttttggagttatttttgggcgagtttcgcggatcgtgcggcggcggcgagtcggagtcggaattcgaattcgaattcgaattcgaattcgagttcgagttcgagttcgaatttgaattggtagaagttgaggcggtcgaggtttcggtagaggaattcggggaggaggcggttacggtagtcgcgatggaggagggggattaggagtaagattcggagttcgaggaggaggcggcggttgagggtgaggaggaggaggagggcgcggcgacggcggcggtagtttcggggtattcggtcgtgtcgtcgtcgtcgttttagttgtcgtttttgttttcgttttcgcgatcgttgttagagcgtattattcgcgaggaggtggagggcgaaagtttggatttgtgtttgtagtagttttataaatagttaagtagttgggtttggttggtggtgggttcgcggtttttatcgcgtcggtttcggacgcggttttttcggttttttaaattgtttttttttttgtttttttttttcgtattcgcgtttgtcgtcgttgaaagcgttttcgttgttcggattcgggcggtcg

SEQ ID NO: 6333 - DNA, 10207 bp, synthetic construct
  misc_feature 1..10207: note = Description of Artificial Sequence: Synthetic polynucleotide
  source 1..10207: mol_type = other DNA
gcggaggcggtatagttggagttcggattgtggtacgtcgttatcgtgttgtttcggggaatttcgattcgttttttgcgaaagcgttttcgaacgcgaatttagagtttgtgaacgcgtcggtaagttttttatttttttatcgtcgttcgtcgtaggtgggttcgttttaggggttttttttgcgttttatttcgttttttaagttatttagtcgatcgtttcgtttacgttttcgtgattttagatatttataattacgatttcgtttttatgtatatttaacgtacgacggtgtatagacgtgtatttgatttttgcggattaggtgttttaagcgtatagcggttattcgcggaatcgcggttcggggttagtgagtcgtttgtagtttttcgggttaggggattttttagaatttcgggaaagttattcgaagtttattcgggatgcggttttggttttcggtcgcgtgatttcgtttttaggtgtagaacgacgtttttttagggtttatagttgttaggttgggttttgttttcgtatttttcgggaagattagggacggggttatataggtcgtggttgcggagacgttttttcgggttatttcgcgattaggagggagtcgagtcgttcgtttttttcgcgtttttcgttttattttagttagttggttttattttgcgcgggataattgggacgggagggaggcgacgggagggcggcggttttagagagattgcgcgtttgttagcggtaatttgtttaagtggacgggacgggtcgggtcgttgcgggttggggttatcgaggtcgcggtttttattttaattagatttgggatcgcgggggagttcggttcggtcgttaaatcgggttggttggcgttagggtttcgggaggtgcggttcggcggggaagtcgtgatgggaagcgattttgtttagggagtgttttttattattatattttttacgtttaggtagtgatcgacggtttggcggtatttttatagcgggtttatagtacggggttatatacgttttttgagtttagtttgggtatattcgtttgttatcgagggtttaagttagtttgtagttcgcgtttcgttattcggacgtaagttcgtcgttcgttttgttacgcggtcgtatagttcgagttttttgttgtttattgttcgcggggttacgtaatttcggttttgtatatagaggaggaagcggcggggattttttgttatttggaggtttaattcggggaaggttttagtagtgttttttaattttgcgagaggtgacggggtcggaggacggaagggtagttacgttaggtttaggatcgcggttttattcggtttaggtcgttttcgttttcgttttattttattgttgcgggaagcgcggggcgtatagatcgcgcgttattagtttaagttcgttcgacgttttggtcggagatcgtttgcgagagggaggggcggtcgagcgcgcgtttttcgtttgtttgcgggatttggtcgatgcgaagtgataggggtcggagttttgttgtggagtttcggtcgtttggcgttagtcgttttcgttcgcgttttttttttttagtttcgggcggttcgcgaggcgtttttcggggttttttaaaggaatacgtatattcggttttcggggtttcgttaggggagggggtttttgggaagggggagggggtcggtttaggtgggggaggggtttagcggaggttttacggcgtcgttttagggttttttaggtttttttagcgttagttttcggtgagtttcgggtatttttagttggagagtttggttgggggtcgttatagattttttagagcggttgtagtaggattttagggtgatcgcgggatcgcggggcggggcgagtggtgggattttggttcggatagagtttcggaaagttagagggaaggtcggtgttattgtaggtggggtcgtcgtttttagatgtagtcgttgtattgtcgtcgttaggtttttcggttaaataatttaggtttgagtgttttaaattttttaggtttcggatttttggattagttatggatggattaatgaaatggattaatgtttaaaacgtatatatttagatgtatatatatttttataaggataaaagtatgtgtttatatatatatatatatatatatatatatatacgcgcgcgcgcgcgcgcgcgattttgcgaatgtatttacggatttttaggtcggtatttgggttttcggttaaggaaagttgttttggttattatttggttattttatcggttgcgtaaacgtgtttataacgggttttttttcgagaggttatatttcgtttaaggtggagttagtaggtatttgtttgtggaaaattgtagtggattttgtttcgtttgcgtagattgcgtagttcggagttaaagattcgttttggttagagaggaggtattaagagaggtgcgatttagttaagaacgaggtcgtggagaaaattttgtgggggcggcgtttatatatgcggtgatgaggagttgtgagggttttggggtcggtttcgaaaagtagggataacggtcgtagaggttatattgttttcgtcggtttcgaattcgtattgttaggagagattcggtttttaaacgttgtttttaacgtttaataacgaagtgttttgcgatcggtgtgcgtagtgggcgggcgtttgtatgggttaatgttggatgtacgcgtttattacgcggttgtacgggtgggaatgttattcgtggttagtgtatgttttgtttttttttttagaaaacgatttttaggaattagtttgagtgttcgcgttcgagttcgattggaagtaggtgcgtggtcgttttatttttttcgtgtatattttgagttatagttttcgttgcgtatagagggtattatacggggttcgatatatatatatatatatatatatatatatatatatatatatatattattattttatgggggggaaattgaggttgtcggaagatagaaaacgaagattgattatagaagagggggttttaattataggtgttcgtagatattttaatttttttacgcgttatttagtattttttaatttaggagacgtgcgttttcgagagatgagaagaaattaaaaaagtggttggtagggcgaagagaggaagtcggtatttcggaagaaggagattttcgttttcggtatcggatagggcgaaaattcgttgggtcgcgggtggagaattcggggttcgttcgcgcggtgtcgttttgtgtttagcgaaaggtgcgtttatttttttggtttcgaggattcgtttttttcggtcgttggaaagtttagggcggggttcgggtttgcggagaattttaggtttttttcgagtttttcggtgaaggcgggcgcgggtagggggttttcgcgtttttttagcgtaaggtcgcgtttcgttttcgttcgcgtcggttttagtagggttcggttatggttttatttattagttttcgttatttgggattcgttttcggatttcggtcgttcgagtttttcgattcgttcgtttatcggtttcgttttttagtgtttgttgttttttttcggggcgtagggatttttaggcggcgttacgattcggagttgggtcggaggttaggttggggttcgggttagagcggtcgggtttttgggcgcgggagaaggagggcgtttttttttcgttcggggtcgtgttaatgttttgtatttggggtcggcgtgcggttgcgggtttttttttaaggtttcgggattcgggtttttttcgttttaggttttttcggcgggttaggtcggtttttcgcgttttttagttcggcgtaggtagtcgtaggcgcgggcgggcggtgggggtcggggtaggaggaggggtttcggggttcggcggttcgttattggttaatattttattttgttgatatgtttttttattgttgaggttttcgatatttttttttaggttttttttttcggtcggagtttggtttgagttgttaaaatttcgttttcggagatttataattggtttaaaaagcgtaaaattagtaattaaggggggtttggttcgttagcgtaggggattcgagttgggtaggatatgtgagatagttatagttttttagagattacgataagatttaattagtcgcgcgtggttttcggcgtcggagcgggttagtttagttcggtttagttcggtttcgcgtagagttttcgtcgttttcgcgtatagagtcgggtgttttttgcggtgcgtcggacgggaagtttcgaggagtagttgttgcgttcgttattcgggtcgttcgtttatcgcgcgcgtcgtcgttcgggtcgggggttcgagtcgcgcgttttcggtttcggtttcggttttcgggcgtttgggtcggatgtttcgatgagagagtcggcgttggcggttagcgttatggtttattattcgttttacgcgttacggttcgtcgatttttttatgttcgtttttttggcggcggcgtagtttttttttttttcggtattcgcgttgtcgttcggcgcgttggttaagtcgttgttcgattcgggtttggcgggggcggcggtcgcggcggcggcggcggtagtagcggtcgaggcggggttgtacgtttcggtattgggttcgtattcgttcgtcgcgtatttgcgtttttttaagagtttggagttcgaggacgaggtggaggacgattttaaggtgacgttggaggttaaggagttgtgggattagttttataagttaggtacggagatggttattattaagttcgggaggtagggttgtcggtcggttggaaggcgcgcgggcgggcgggcgggttggggtacgggattgtacggattagagtagagttggggattttcggttttcggttttcggttttaggttttggttttgacgttacgtttcgtttttacggataattaagttgatttttttcgtttggtatcggagcgatttttttttaaaataaaaacgttaaaatttttcgaatgaaataaaacgaaaatatattgttaaagaatagttttaatcgttttgagttttagcgtagaggaggtttcgcggtttggttttggcggtttttttcgtttcgcgttttcgtttttttgcgttcgggttcgttttcgagttcgggggaaatttagttttttttagattttgtttcgatttcgaagtttttagtgggatttgggtttagttaattttacgttggttgttcggtttttggtagcgagtttcgggttagtcgagtttttcgttttatcgggttgggagttttttttttatcgcgggtattcgagttttggacgtattcgtcgttttaggttttaaagtttgaagaaagttatagtttcggtttttttatttttcgatttagttatcgagaatttaggtttcgggtttatttttttttttcgaattgtacggttaggatgttttattaggttttgtagtttagtttttaatataaatattttttagatttatttttgggagttttcgttttaagtgggtattttttttgaacgaatttcggggagattaaggagaagcgagaatatttttagagggtttagattttttttttgggtattagtttttattttagattagggagaaagagggtttttagatttgagtataaggtttaaaggaggttgtttaggagagggtttgataggtagaaatgggattttttgggagtaataattataggtggggtcgttcgggtagtgatgagagggtagagtagtcgattataggggaaatagttaggcggtagcggtgtgcgtaacgaggagggataaataaaggaggagtggggttttggaatttagaatagtcggttttaatgggattttttttttttttttttttttaggcggatgttttttttttttaaggtgcgagttagcggtttggataagaaggttaagtatattttgttgatggatattgtagtcgttgacgattgtcgttataagttttataattcgcgttggatggtggcgggtaaggtcgattttgagatgtttaaacgtatgtatatttatttagatagtttagttacgggggagtagtggatggttaagtttgtggttttttataagttgaagttgattaataatatttttgataagtacggtttcgtgagtgttggggtagggtggggacggtgtaggagtttgttgatttagtattgtagttgagtaggagagtagggcggtaggattttttagggggaagcgttgggtaaatttttagagtgtttttgttcgggttattgttttgtggtttacgtgggttgggtttgggtttgggttttagcgtttttttttgtaagtttgggaaatggtggggttagtggttggtagtttataattttagttttttaggtcgtggagggttttttgtatcgttaatagggaggtaggtgttgttaggattgggtttgtagtgttggattacggaggttattttgtttttggtttgtaggtgtcgagtttggaagatttgtttatgattttaatttgtttattatttttttgttaagattcgcgtttttggtttttttttaagattaggggatttaaaagttaaattattttttttatttatttttttagtttttttaagatttttttttttttttataggtagatgtttaattaggaggagagggtttgggggttttttttatttatgtttgagtaaggttttagcgaacgggggtggtgttttatagggtaaaaggaattgtttattttgaggtagggtagttggtgagttttcgaaggttggaattttttttttgtggggttagggggtttattagtgttagaaaggaagagagtgttaagagtggaattgtagggttttgttttgttttattttgtttgggttttttttgtggggaggggttgttttttggttggtttttttgttttgttttttgttttgttttgtttttgttttgttttatttttgtttttaattgggaaattttttttaatggtaagagaaaaagaagttgtgaaaagagaaaagcgagaggaaaagtagaagaaaaagaaataagggtgagaaaagagtagagataggagaaaatggggaagaggaagaatcgatagagagagagagagagagagagagagagagagagagagagaaagtggagaggaagaggttaggtatttaaagaatagaaaagttcgggtcggggttggtggttgtcggttgatttttatttttttcgtagattattttaaattttatgtataagtattagtcgcgtttttatatagtgcgagttaacgatattttgaagttgttttatagtatttttcgtatttacgtgttttcggagatcgattttatcgtcgttattgtttattagaatgataaggtgcgcgcggcgggcggtgggttaagtttttgtattgacgttttttaatacgtgtaggtttaatcgttcgtttatcgtttttcgaagttttttgtacgggattcgcgtttttgcggttcgttttcgagtatcgagtttcgtatttatacgcgtagtatttacggaagtttttaaggcgtttttttaattttatcgcgcgtatatataggtttttttggggcgagcgaatagttgggtcgtcgttttgatggagatgtttatttaataattagttgagatttcgggttcgcgttgatatttttatattttattcgtttattttttggtttaggaatgagaatgtaagtgaagagagggcgttcgaggtaatttgtttaggttttatcgatgtttagaattcggggtttagtttttattttttcggggggagttagagggtgggataggtgatatagttttttaaagtatttttggttattgttttgggttagtttaggttttagattttttgggaggcgtttagagaattattttttaattaaagggttttttttgtttgcggtttttttatttttgttttagtggggtagagtattatttttttaggtttgtgtttttgtgcgttattgtcgagtgaaagagagggtacgagtgttcgtgtcggtcgttgtggttttgtgaattaaggtgtacgttgggttgtgcgtgtttcgtttggggtgtgttggatatttgtggaggtatgtgaattcgtttggtttcgtaggcgtttgttatgtttgtgtatatttgcgtgtgtgcgagttcgtgagtgtgatttggttttgtgtgtatttgtagttttgcgtgtgaattgtagtttttgttcgcgtttgttcgggtgcggagtcgtttaatttgcgtaagttcgcgggcgggtgtgtatgtttgggttggtttcgatattgtggtattgttttaggtttgtgtggggttgtttaggtttgtttagggataatttttcgaatgaagtttttggaggatagatttcgtcgtttttcgcgaggtttttttatcggttttagttcggggcgttttattttaggcgggtgggtattaagtggacgtttttcgggttttttttttgcggttagtattcgttgatttcggggtgttatcgattacgttggaagagttacggtttgatttagcgtcgtttttttggttttcgtagattatatagttgaagatcgataataattcgtttgttaagggttttcgggatatcgggaacggtcggcgggagaaaaggtgagaggtcgaggatagtagttttgtggcgggtgttcgcgggagtagcgagtaggagggatggagggatgggtttttcgttgatttggtttattcgtttatttttaggaagtagttgacgttgtcgtttttacgtttgtacgaggagtattgtaaattcgagcgcgatggcgcggagttagacgtttcgtcgtgcgatttttttttcgcgcgggaattatttattttttcgggcgtagcgtttagttcgttgcgtttgtatcgggttcgaggtgagggtcggatcggaggagggatagggaggtggcggcggggggtttttaggtcgttgggttggttttttgttgagttattcgttaatttgaaaggttaggaaggaaacgtcggcgagtgtttgggatggggttttcgtttcgggatttttttacgagggcggttttcggtagttagaagattcggtcggatttcgagtttggttttttgggcgtcgtgtaattttatagttgtagggttttttttttagggttgggttttttttattgtaaatttggggttttggattaggtgatttgtagttgttttttgttcgattttagtagttttttcgatttggttttttcgagagtagtttttttcgagtgtttttgattttgttcgtcggttttcgtttaggtttttgtaattcgcgcgtttttttttcgtagttgaggagaagtcgtgcgtcgcggatagcgattcggagtttgagcggttgagcgaggagcgtgcgggggcgtcgttaggtcgtagttcggttttagatagcgttagttttattcgtttgatcgaattcgagcgcgttcgggagcggcgtagtttcgagaggggtaaggagtcggtcgagagcggcggggacggttcgttcggtttgaggagtttggagaaggagcgcgtcgaagttcggaggaaggacgaggggcgtaaggaggcggtcgagggtaaggagtagggtttggcgtcgttggtggtgtagatagatagtgcgttttttttgggcgtcggatatttgttcggtttggttttttttagttatttgtacgggtagtagttttttgggtcgttgggagtcggttagtcgttttttttgtattttggatagtttattatgggttttggcgtttttttcgttatgggtatgggttatttattggtttcggtggtaggcggcggtaacggcggaggtggcgggtttgggatcgtcgcggggttggacgtaggcgggttgggtttcgcggttagcgtagtaagtatcgtcgcgtttttttcgttttattttttttagtatatgttggtattttaggtaaggtttgtgatttcgcggtagcgttagcgagggagaaggtttagggagttggcggcgaggttagcg

SEQ ID NO: 6334 - DNA, 2392 bp, synthetic construct
  misc_feature 1..2392: note = Description of Artificial Sequence: Synthetic polynucleotide
  source 1..2392: mol_type = other DNA
tcggattttttgttttttcggtgagtcgttttttttttgtcgtcgggttttttttttttttttttgtttagttaaaattcgaatttaggcgttaggggagaggatcgtcgttttagtttgttttattgttgggggtacggagtttttgtttttttaaggttacggttttcgttttcgcggatttcgttcggattttttttggttatcgggacgtttcgttttttttttttcgtagtaattttttatattcgggttgtgaagttcggggtatttttaggtcggcgataaataatttatagggaacgtggtattaggtttttttcgcgggaggagggggcgcgagtagcgagagttatcgttattcgcggtttaaggatattcgcgatgcggcggcggcggcggcggcggcggtttcgggcggggattcgcgttacgttttttggcggttaagttgagtattacgtattcggcgtttttcgttttacgttgtttttcgtcggcgttcgcggtttcggggtttttatttttatttttttaagttgggtcgtgatttcgagtttcgtagtggggggattaagttagtttggtaggcggttttagtattattttaggttcgttcgggggttttgggcgaatttaggtgtttcggatttgtttatttgtttttggtacgtttttatttttcgggagtttagaaataggtttaaagttattagtatcgttaagatttggacgggttttgaaatatagttagcggaatggtattttttttaaataagtgttttttttcgatttttttgtggttcggggttagggattgaattaagataacgttattattcgagggttgggggatcgagttagaagtttttttggacgattagggttgggaaatcgagtggacgaatggggtgggtattagggtttggcgggaattttcgttttgtttatttagtagttttttgtagggtcgcgggacgtatttgggggtttaggttgtcgggtgtttttgtttcgcgtgttttcgttttgttcgcgtaggtaggaaataggagattcggggtttttttttttcgtcgtcggggattttgggcgaagtttttagagatcggcgtaggcggttggtgcgtagttagggtttagcgttaggttttgttcgtttagtgttttttttgtttatttttttttttgcgttttggaagttcgggagtcgggtacgggttagtatttgtaagatgttattattttggaagtttatttcgatttttttaggtcgtaggaaggagagagttaggttggggtaaaggagatggggtagagttggaaggggaagaagcgggattcgcggcgggggaaggggtttgggcgtcgaggcgagtgcgtagtaggtgtttagtagatttagggaaattggggtattgggttggggagtcgtatagtttttttttattttttcgatttttttttaatttttcgttttggtggattttagtttcggtttttattttcggttttgtttttcgtttttcgtttcggcggtttttagtagtaatagtttgggttcgcggtagtttagatttttttggtttcgcggtgttgtcgcgttaagcgaaggaggaggagggttcggcgattttggggacgaacgttttggacgtttcgttcgcgtttttttttcgcgttcgtcgcgcgtttgtttgttcggtttttttttcgtttttttttcggtcgttcgggttaaaatttaaggttaggtttttgagggttcgggttttttagtcgttttttttttgagtttcgagagttttgcgtgggtttaatttttcgggtgtttcgtttttgttttcgtcgtttttgttcgcgcgtcgcgggaatttagttttaagttggcggcgaagttggtgtttttcgttcgtcgttcgttatttatcgaggggaaggggcgttgcgttcgcgacgagagttcgcgtcggtcgtttttttcgcggtgtttgttttagagtttcggtttcggagggttggcgcgtttagttttagtttcgcgggcgtcggagttcgggcgcggtggggcgggggcgggggcgggtggcgcggtttggttcgttggtttcgattcgtttttgcgtttcgcgattttttcgaggttcgtacggcgttcggtttcgtttcgggttgggttgcgtatcgcgttttttgtttttagagttcgtagtcgattgtgcgggagtttttatcgtcgttcgcgagggttcgtttcgtcggggttcgttattttcgtttcggttcggttcggttcgttgtttttcgaggtttttttcgtcgtattttcgggtttttttttttttttcggaatcgcgtttttagatttgatattcggggtaagtgcgtttcg

SEQ ID NO: 6335 - DNA, 564 bp, synthetic construct
  misc_feature 1..564: note = Description of Artificial Sequence: Synthetic polynucleotide
  source 1..564: mol_type = other DNA
tcgattttttttcgtggtcgttagggtaggggtgggaggaatttggaagttacgtgcgatgttcggagttgcgttttttgttttggggcgtgggttcgcgagcgtcgcgtagtttttcggatcgttttgagttgttgcgttcggcgttgtttttttttttttagtttcgcgtttttttttcgcgattttttttttgttttttcggttttggaagcgttttaagatggggtgggggtatggagggagagaggggaggagggagttgttcgggggtagtgtcgttaggaagtgggacggggattttggcgtttttttaggttgttgcgcgcgggttggggatcgtgtatcgttttgcgcgttagacgatgtattttttggaacggtagttgaggtaatgcggggtgtgaagtggcggcgggtagaggggttcgtaggggttgggattcgcgtgtttttttttgtttcggtgcggagtacgatgtgttcgggcgggggcgaggacgttcgggaggggttgggttgcgtacgttcgcggggtcgtcgtagatgggcggtttggaggcg

SEQ ID NO: 6336 - DNA, 3277 bp, synthetic construct
  misc_feature 1..3277: note = Description of Artificial Sequence: Synthetic polynucleotide
  source 1..3277: mol_type = other DNA
gcggttgtattgttgcggggtgtaagggcgggggaaattatatcgttaggcgaggcgcggggatcgtgttggaaggttcgcggcgcggttttttttgggcgattgcgggggcggtttggtagggagttggggcgagtggtcgtcgcggggtttcgtaggcgcggggaggtatcggtcgggtattcgcgcggttgaggcgagggcgggggatgtttggtcgggtagggaacggggtgggggagggtagaggggcgagcgagtcggagggggaatcggagtcgagggcgcgcgcggatttcgaggttttttaggcgggttttgagcgattgtaaagtttgttcgagttggttgagcgtttcggcggtcggtgttcgggataggtcgtttatggtgtttttgttcgagtcgggttgtttgcggtcgtcgttcgttcgggtttcgtcggtttcggggtttagcgtgttttggttttcgtagcggtttagtttggcggttagttcgcggatggtttttttttggtttaggatggtttttttttgttgtagtatcgtttcgcggagttgtagtacgttgtttcggagtttttcggcgtcgtcggcggttacggacgcggcgtatatgtcggcgtttacgggtatcgaggtgtagatgaagcgcgtcggttcgaaattttgggtttcggcgtttaggaggtagagggcgagtagcgtataggtgcgcgcggcgcggtcggtcggtatggttgcgggtatcgggcgtttcgggttcggttcggttcggttggggttcggtttcggttgggattcggttcgggttgtggtttcgcgagcggttcgcgttttgggcgtcgcgtttttcggtcgcgcggtttatatcgtcgcgttattaggtttttattgtcgtttgcgttgcggagttcgcgttttttatgtcgtcgcgggaggggtttcgagtcgtcgacgttagcgggggaggaatttcgttttaattgttcgcggttcgggttcgcggcgcggcgggggttttacgagcgcgttatcggggttgttttcgttcgcgtttttttcgtttttttgggagttgtcgcggtttttttttttttcgttttcgtttgggtcggcgttgttgtttcgaaggtttcgagagtttagggggaaggaagtcgggtttcggtttcggattcgaggatggattatttgcgtggtgttttcgaattttcgacggggttttaggcgggcgggaaattatcgcgttcgggagatagaattcggttcggtttttttggttgtattgaatatttttgggtcggggtcgtttggagtcgggttgggtgtttaaggatttaggtcgttaatattcgagtgttcggtggttaacggttcggagtggggtttcgcggcgttattaagtttagagcgggggttatcgggtcgtttcgcgttttttagatgttcgtgtgttattgagaagtcgtcgggtagtttgggtatagggattttttacgggtcggggttttcggcgtttttttttttttagttttcgggttttgtggattcggtttcgttttcgggggattgttagtttttatttcgtgcgggcggggcgttggggatttttcggaggtagatttagttgatcgagttttttttgttcgcggcgtcggttcgatcgcgggtaggcggcgtcgtcggggttggacgttcgtagcggcgtttcggaagggggtttcgcgggagtagtcgttcgcgtttttagtagtttttttttgttaggcgtcgcgcgcgttcggtattttcgggtgtttatttgtgcgtggggggttgtttttcgtttgtttagtcgcgtttattttttaggtttaaaggttagtaggaagggtttcggaggtggttgggggcgtttatttgagaagtttcgttttcgtttagatattttattcggtattcgcgtattcgcgtttttatttggatcgcggggttcggttttcgagatcgcggttcgggtttcggcgtcgggttgggggtttaggattagggttggcgtagtcgtttcgtttcgtttcgtttcggggttattagagcggttaaagtttcggaaattttttcgtttacgttttcgtggtatagagaaggaaattgaggtttcgagattgcggggtcgggttatagtcgtggtttttcgattttttttcgtcgttttcggtttttttggtttttgcgttttgtagtttttttttgcgcgtagtcgggggttgggggtttttagttagtagggatttacgggtagtttcgggtgtcgggatcgggcgttcgtttttcgggcgggagtagaggtcggttcgatggagatttttttgagaaatggcggtttttattcgttttttagttttcgagcgttcgtcgtttgcgtttagtattttagtttttaagtttttttgagtcggggttgcgttttcgttgtttttttcggtcgtcgttttttggcgttagagggatttcgcggttcgtacgggtttgttttcggtttcgttcggagggtgtgcgggttttcgtttcgttggtttcgtttgtttattacggcgcgtttaaatttacgcggttcgcggttttttgcgtgttttgtcgatttcgggtcgtaggaggggttagtttcgtcggtttttacgcggggtttgcgtcggtagcgttacgggttggaacgcgtttcgggagaaattattcgcgcggggtcgcggcgttttttgttttaattttcgtagggagtcgttaggcgggtgtttttttggttttagcgttttggtttcgtcgttttttcgtacgcgtttagtggggaggtcgcgttcgttaggtttggagtcggatcgtgtttagtcgagagcgcgcgggcgcgggagaggagttttgttttgtttagggtaggttgtttagacggggcgggaatttttagtttggtttcgcgtttttatttttagtagtcgtggagtttttttagtcgtttaaggttagggattttgtttggttttttttttagggtagtagattttagcggtttggtatttcggtatagaggagcgtgtttttttttcgtagaggaagggagtggacggcgttagaaagggaggggagtttggggcggtgtttggggttagcgggatttttgggtattgtggggttttaggagaggagattttcgggtttagtttgtaattgttgtgtaggaggcgttgggcgggatatttgtaggcgttgtatatatacgcgagggttattatgtcgcg

SEQ ID NO: 6337 - DNA, 5692 bp, synthetic construct
  misc_feature 1..5692: note = Description of Artificial Sequence: Synthetic polynucleotide
  source 1..5692: mol_type = other DNA
gcgcgttttcgtagttcgtcggttacgtatcgtacgtacgcgtttttttcgcgcggggtggcggtcggcgggagttacgtggagtagtcgcggtgttttcggttacgtttggttttcgatgtcgcgaagggggttttggggtaggtttcgtttttcgaagttgtcgttgcggtttttgttagtcgggagacgacgaggggaaggggtgggtcgcgttgggtttttcgtttattcgtttttttttagttttgcgggggttaaattcgtttttaataaatttcgcgaaaaagtcgagggggggacgcgtcgttgttggagaataggttagaagtgatagtagaatgggtcgttgagattttcgttttcgtttcggtttttcgtcggtttggcgggcggcgacgtggggaggggtcgtttagaagtcggggtcgttcgggtcggggaattttttcgcgtcgacgtttattttttacgggtcgtattcgtcgaggggtcgaaaggggttttagtggaggacgcggtgggagttgggtttcgttttagttgtcgacgtcggcggtgttcgggttttcgggagcgtagtttttggtataaagtagcgtcgaagattttgtcgggtgtttcgtcgcggttgtcgttgtgttcgcgtagggtcggttcgtgaatgcgtgcgggggttttcgagggcgttttttttattttgcgcgttcgggggagttgttcggtcgtcgtcggtaggtagaggtttcgggttttatgggtgttttcgagatttcggatcgtgcgttgagaatgtcgacgttttaaacgagttagtagagcgggtcggagttttggtcgggaatcggcgtcgcgtgcgtattggtcggcgaggtttttggttcgtcggggaaggagtttagagcgtttgttttttcggtagaaattaatatatataaataattattcgtattttttatattgggggattgggagtaaggagtaaggataggggaggggataggatttaattcgttggttttttattttaaaaattatatattttatgttacgatcgtttttcgttaagattataaatatttaatttggtttggcgtaataaaattagtcggagtttttttaaacggagttatttcggtgaattaagttgtgaaatttaatttattatatttataaaggagaatgtttttattgtaaatttaggttataaagaaattatatttgggtcgtcggtttttttttcggatttattatttgaaggtttattaaattattttaaaatgttgggttattttttttatattttatggtaataaaaattaaacgtggtaatattttttttaatagtaggaaaggttaaaaataatcgttataataaggggatataatttttaaaagatatttttttttatttcgggatgtttttttcgcgtttggaagcgttttttttatttttttaattaattcgagtttttaaaatatttaaacgcgttacgattttttttaggttttttttcgttttacgaggcgtttgaggcgtagttttcggatggatcgtacgtggggtcgtagattttgggcgttcggacgttagtcggaggcgcggggatttcgtggtttcgttgcgaatttgcgttttatcgcggttcgtatatttgggtcgagtcggggtcgtttcgggagtttttcgttggtttttgggcgttttattcggtttagtaatgttcgggttagataaaggagtcgttagggaggggttaattcgttttttattttttttcgttttttttttcgttttttttttaggcggcgcggaggagagaagatgcggtttttaataatgtgtttggtttaatttgcggggtgtgggtatttgttgcgtttttttgggtgagggttgggtttttttttttttatttttttttatttttgtgtatgatattttggttggggtttggggcgttttgcgttggttagaagttagggttattagggatttttcgttttcgttttcgaagaggggatttgcgcggacggcgaggaggatcgatgcgtttttgagtttttagggaaacgaggtcgcggttgttgttacgtcgcgaggaagatttatgaggcgcgggtcgagtatggttcggttcggcggaggtcgttcgcgtatttaggttaatttttgatttttatttgattatttttttttttttgttatttttaagtcggcgttcggaaaggcgaataaagggaggaggatgggggatgggggcgttaagcggtggcgagggttcggttcggtaatttttttttttagtgggggtttttgggcgttttaggttcgcgtttaatgcggggtttaggagggcgtagtttgaaaggtgatcgggttggggttgtcggagattcgttttgcggggtggtttttttagtcgttaggtttacgataggatttttagggaggggtttttgtaaatgtttttgggcgaagagaggacggaaagaatatttttttttaaattgtaattaagggtgtgcggggcgggggtgtttggggggtgttgcggtaggtcgggttcgtttaatcggaggtagtagtttagttttgggtcgataaggtcgagggaaacgggatttttttgtttttcgtacggaaaagatttatttaagcgggtaagagggaagcgaagtttgtattttttatgttgaaaaaaaaatttaaaatggaaaattattttattggttattatttataagtaaattaaaaatagggataattagagtgtggggatttggagggattataaatttgcggcgttttttttattggaattaggagtttttatggtttgttgttttattttgagagaaatgagatttttggttttggtgtaggcgggtgtgcgtttcgagcgtttttcggcgggggggaggggggagtaggaggggcgaggagatttgcgtagttagggagtcgcgaatttcgagtttcggttttcgaaggcggtaggagaaatcgcgcgttgtgtttcgatttttttcgttttggttaatcgcgatttgggacgagttggaggagtttttttcgggtttcggacgttcgcgtcgaaaatcgggttatgggtattaaattcgattttaggcggttatttattttgtttttatttaaattttgatgagttatttgggagtgcgcggggattgggaagtgagggatttttataatatttttttttcgatttcggttttcgagtttattatttattttgtttttttcgttttcgttttttgttttaaattggggaggggggaggggggagagaaaaggatataaaattatcgttttttcgttaaatttttaaatttttaatttttcgtaaaatggtttggaatttattttattttataggggttttattttttatcgggtggaggttagttttttaattttttatataagtaggatttttttttatttttgaaagtttttaaatttagttattttaaatgtaaatatcgtgtgaaattttattaattaggtaagaaagtagggagagttttgatttagttgtttttaattttgggaggagaaagagaaagtgagttttttttttattaagtattttaaaataatagcgttttttttttttagttcgttttaatcgtagttttgtttttgttgaaagatttttgttttttttaggaaggggggcggggaggataggtttatatttcgaagagttttgtttttaaaattgttcgaagatttttttgtttgacgtgtatatgggggaggggaaggagttcgtttaggttattcggttttttcggatttcgtttaggttattcggttttttcggatttcgtttaggttattcggttttttcggatttcgtttaggttattcggttttttcggatttcgtagaatatttttaaagtttatgggcgttttttaatcgtgtaagttcggggtttcgggggttaggaggggttgttttaagataagggaagttgttcgttagattggggttaatatcgggtttttttaatttaagtttttttcgaaaataatttttttaaaattgagtatttttattagaaaaaattcgtattttttaggaggacggggtgggagagtttcggggaataaagttcggtttttttagttttgaggtcgaggtagggcgtatttttttttgggcgaatttaatcggagttgtagaagagataagtatttttaaattggtattcgtttcgagtttaaggtgagggtggagaagggtttttggtggaagttgtaggaatattttgggtcggggtttatttcgcgttcggcggtttttcgaatttcgtagaaagatacgtttgtagcgaaaggtttttatatattagtcgggattttattcgttttttatcgagagtgcgttttgggagcgcgggaaataaggaaaacgtacgtatttggcggcgtttcgagggcggtttcgcgggtttttcgttggcgaaggtttttagaagttatttttcgttcggttgttcgttttacggttagttttttttttttcggcgacgtatttcgtcgagttagtttataggaagcgttaggagtcggagatttggttcgttttttcgggcgttgcgttcgttttcgatcgttagggttcgcgtttttttttcggttacggtttattagagggatttcgcggcgggttttggttcgggcgcgtttttttgcgttcgagtttttaggttttcggtcgagttgcggagacggacgcggagttttcggggaagacgaggcggcggcggtcgtcgttcgggtaggagtttcggggcgggaggggtgtagggcggaggagcgggcgggattttagcgtttcgcgtttcgcggtcgtcgtttttcggggcgtttagttttatttacgtggaatcgtttcgttttcgtcgtttcgtttttacgagggaaggtattcgagtttcgtcgtatattcgcgtttttcggtttcgggttcgaaatatcgcgttttttttttagcgtcgtgtttttcgtttttttagcgcgcggttttcgttcgattcgcgcgttcgttcgattcgtttttaatttcgtttaattatcgtttttcgcggttgttttttttgtttgagttttcggcgtaggttaatggaattacgcggaggcgcgggcggtttggttaatggaaggtttagggggcgtggttggcgggaggggttgcgggcggtcgggttttatgcgttgagattcgagattgcgtcgtcggcgggtgcgtttaggtcgtttagttagagtcggtaggatttcgtcgtcgggttgtgggtttttgatttttttttcgttgtcgggagaagcgtttgagtggggagggaggtgggaggaggtggtttcgcgtcgggggtgcggggagcgggacggcggtttggatggatacggttagtttcgggtcggagagggttcggtttagagtagtttgggttttgtttagagttttattgtgtacgttttcgcgaggatttgcggagagacgtgtaggcgacgtaggtttcgggaaggaaggagggtatttgggttcggacgagcgataacgttgtgttttgtgatttcgtataaacggattttggagtttagggaaagcgttttaggtttttagttcgggtagggttcgtgggattggcgttcg

SEQ ID NO: 6338 - DNA, 7937 bp, synthetic construct
  misc_feature 1..7937: note = Description of Artificial Sequence: Synthetic polynucleotide
  source 1..7937: mol_type = other DNA
gcgtcgtttgcgaggggcgttttgcgtggattcggggtttcggggcgcgtttatttattcgagttaggagagattgggttttacggtgttagtttcgcgttcgggttcgcgcgtcgtttttagttcgcgttttttttattttcggagggtttcgcgggttttcggcgacgggtttttgtttagggttcgggaattttttttttttttttttttttaagcgttattttttcggagtcgggtcggtcgttttcggtgtacgcgggaagcgggtagttttcgtttgtattcgcggggtcgggattcggaggtattcgttttttcgatatattcgttggggtcgttgttcgttgttttagtttttcgaggttacggtaagagttcgggggtcggcgttatatatttttagtcggcgatcgcgtttagggatttaatttaatcgtttttagtttaatgaatagtcgcgcgttaatcggattttcgcgcgtttcggggatttacgtttttcggttttttttttcgtgtttcgcggttcgttagacgtcgttttcgaaggcgtcggtttggggtttggttaggggttcggtcgcggggggtttcggtcgtcggagtcgggagacgtcggagacgggagtcgggttcgcgcgatcgttattttcgagttagtcggggtgggtttcgcgttttgttttgcgttttcggttcggttcgcggagcgtcggtgtttatttgcgagtttcgggtttttcggagttttttttcgggtcgagtcgttcgaagcgggcgtcggcgtaggtttcgatttaggtaggcgggaaatttcggagttttcgttcgcggttcgtagttttttattttaggtcggcgtggtttgcgggggggaaggtcggtcggggtcggtcgttcgttttttttttttttttagatttttttgattcgcgggtttttcgtcgtatttcggttttcgggttgtttcggtcggttcgcggggattttggaaacggtttttagtttatttttttttattaagcggttttgggtcgttttgaaatcgcggagttagtaattgttttttttaggaggtttagtgcggattggataatagttaattagcgttttgtttatattcggtgatggatagtttattggcggagtgttaattaattttagcggtttcgcgggagcgggagtgggggcggggaaatagagagataataggttttgagtttaattttttcgtgtttttgtcggaatgagacggtggagaatttcgaatgcgtgtgaatttgttagttggtttttagtttaaatattttttttttttttagagggggaggtagagatttatatggagaaagaggagtaaaaataaatgtatttatcgttattaagatattatttcgattttttgagaataaatagtatttgggtgggaaattaaattttaatagaaatatttgtttgcggaatattttagaagtggtttgtatttgattacgataaaaattgtttagtggtttgttttagttggagtgaggatttagtagataggtagatagggagtagtattgagaaatattatatatggtttattatattatattcgttttttttattattaaattgaaaatattttttaaatttaggtgtagatgaagaaagggtaatttttgtttttttaataaatttttgatttttattttagtagttgttttgttgtaaagtgtggtagagggagataaaattgagagttagtaatgtagacggttggagatttagaatttattttttagggtttgatttttaggttatggggaggagagagtcggacgggttatttaaagtttttgttgtttaagtagcgggcgtgcgtgcgtgtattcgcgagttcgggttcgggtaggtagtagttttagagcggtagatgggttaggtaatttggggaggtttttgggtttggaggtttggtttatttgttatttgttagatagattttagggagaaaaagtagttatttttaaggggtggtggtgtttttttttttggttttttgtgcggtagaagttaaacgttagatttgttggattaaatatatatgtgtgtgtgtgtgtttgtgtttgtgtttacgttttttttttcgtcgggatacgcgtattcgttcgttttagttttttttttcgttttgcgttattatatttttatttagtagtaatgatttgcgtagaggagttgcgtagtcgtcgggtttgaattaggcgttatcgggtttggtagtagtttcgttgttttttgattggtagttttttggttcggcgttagtttattgggaggtttgtttacgtcgaatgagtggtacgagttttcggtcgtggagggttgcgcggttaattagcgcgttggttgtttcgggttgagtggtacgagtttattagtatgtagggttcgtggttcgtcgcgttaggttgtaggtttgagagtcgttttggatgggttcgttagagtcgttgttgtggaagcggtgtatttatagtgtaatagttagtatattgaaaatattaataggaatataaaataaagttatatttattgatttaattgtattgtatttagttgtatttaggaaatagtttttagtaagtaattgaaattgtttttattttttttttgtttttgtatttttattattattttattttttattttggttttggggttttatattttttttagtaaaagaaatttaggattgtgatgttaagaagtatatatttttttttttaataaaattcgttaaaatgttgaggttttttttttttttaaaaaatatggattatgagcgatttttttttttttgaaaaattttatcgatcggtttaaaattattttcgtaatgtatttttgttttgttttgagcgtttgttgtttcgatcgatatttagtattaaaaataaatattcgaagataggatagggatcgttaggttgcgtttggcgcgagtcgcgcgggtggtatcgggcggatagtaggcgaagttcgggcgtcgttagcgtgcgtttagttttgggtgatttacgaacgaattttaatattcgtttttttattttgttttttttttcggaatagttttgggttggttttgttcggtcggttcgcggcgaggggaattggtcgggtcgtggtatttacggtcgttgttttgaggggtttttcgggtcgaagttaggggtcggggaggggaatggttatggcgagtttttcgggttttcgtttttaatttagaatttttttttttcggagaagtgggggtggaggagggggatcgagtaaggtcggcgtagcggggcgtttttatcgcgcgcgttcgggacggcgcgcggggttcgggttacggttcgtgtggcggggttcgcgggttggtttttttcgggcgcgggggttaggcgcgattttagtttttatgatttttttagggagcgggtgcggttgtttcgtagggagcgggttttgcggcgacggtcgagttattcgcgttttaaggcgcgtttggttttagttcggtttgtaggttttatcgcgttcgcgttttcggagacgacgtcggagggaggtagacgggttagagttttggttttcggtaggcgggcgaggagagagcgggtttttagatgtaaaagtaggaaataaagtaaatttgtagaagttttagattttggagcgcgttagttacgtttggggtcgcggtaagagggatcggcggttttagggttacgttttgttttttcgggagggagttttgtgtttttaggtttagtttttttcgaaatgttttcgttagcgatttttcgttcgttcggggttttttgttcgtcgttatttttcgttttatttttttttttattttagttcgatttggcgttgcggcgtcgttttcgcggtttttcggcgcggttttttttggagttgggttgggagtgggtttcgggtttcggtattcggcgggtggcggcgtcgtcgttgcgggattgtgggatttttagttcgggtcgtgtggtcgttttttttcgttttattttttggtcgttttaggttttttaggttttcgaagttcggcgcgggtagacgcggaggcgcggcgcggttttttttcgggaggagagaatataaagaaaagttttttttaattcggttagagtcgtggcggcgtaggtaggcgatagtaatttattttttgtttgtttaaaaagtcgagtaggttggtgagaaaggaataatcgggtttgcgattcgttcgtagggggtgggagattaaaattgttgtttcgtagtcgagttcgcgtttcgagaatcgtcggtagttcgcgtttttttaattttgaaattttttattggagagaaaaaaaaaaaaaaaaataattataaaataaaagtatagtatatacgattttttggaggtcgttaggaagtttggtattttcgcgtgcgtagttttcggttttttttcggttttcggcgtttttgaagttgtaggtttttgatttttttttttttttttttttttttttgtttcgttcggcgtttttcggggttcgggaggcgtcggtcggggttgggggtttttacgtttttagtttagttcgggtagttttttttttgatttttgcgttcgtagttttttcgttagagtatttttcgggttttggcggtcgggcgttcgttttgtaggtcgggatcggggtttgggagtcgagttatttgttagattcggggagagagttggcgatttttagagggaagggagttttaaacgtttttgtatgtagttgttagataaagagaattttttgtgtagatttatttatttataatgtaaaagtttttcgaataaatattaaaaaagtttattagttgagtaaatatgtatttatttaatatattatgttttcggttatagattaaattaaatataaaatagtttgtaaataagacgttttagaattcggattataaaatatcgtaatttaaaaaggtatttagtagatggaaaatattttaatcgttttgttgttatggtggaatggttataaaaatataaggtttttcgtaaagtttttaattaggaatattaagtttatttattttttttttgttggaggtgataaatattaaaataatacgtatttagaagatgaggagtaatatgtgaagtgcgtttagggagcgttttcggagggacgtttgggagtacggtggtgtacgtagtttttattattggtttcgatttttcgtatttagagtttaaaattgtttttaatttcgtttgagtggatgtttcgcgttgggtgggggtggaagaaaatggaggtgagggttattttaggtggtcgaggttcgggtagggtttgttggtagaaggttgtgttgggtcgggtttatttttttcggttagagggtcgagttgggcgtcgtagatttcgcgtatttaggtcgttcggtattgttcggagcggagatcggtttttgttcgcggttttcggtaggcgttgaaggaagaaattttagggtcgatttgggtcgttgagagagagtattttgattttgaaagtattttttttatatatatttttaagtttttaattcgtagaggaagattttgggcgaatttgattggggggcggggtgattgttatagttttaataggaagttttcggtttcgggatagtaggtcgggtattgcggcgtggcggtttaggtgatgtcggtggcggttgcgggttttcggggttttgaggagtcggtttggggttttagcgcgatgttggggataggagttggtttcgttggggttggggaggggggattacggtggatttagaagaatgggtcgaaagatgtatgagggggatgggagtggggagaaaaggaaggttattaaaaaaaaaaaaaatttttgagttataattaataaaattattcgtttaattagtatggttattcggttaagcggaatgtagtaaaagttggatttcggtatgaggtggggagagggggagagttagtgtggattttaggttttttttttcgagatatttttgggtagcgggggaggggagagggtgtgcgtgtgagtgtgtgtgtgtgtgtgtgtgtgtgcgagtgtgcgtgatggtttcgtagatttgggtttttattatttagtagagttagtagttttttcgtcgcggcgttttagttgtagggattcgcggggacgagaacgggaggcggcgagtagtgcggttgggttttttcggttgtttcgggttaagcgtggtcgggacggtgcgtgcgcgcgcggggtttcgggtgttgggttgcgcgcgcgtgcggcggggagatatcgagcgtttcggtttcgttattcggtttggtcgtcgttcgttcgggtcggcgggggtggggggtggggggagtgggtgagcgggcggggcggggattttcgggcgagtcgagttttttagttattcgtgttttttttgtttttgtttttatagattatggattcgtatagcggtcgttggttcggtgcgcggtcgttcgtcgagaagtttagttttttcgcgtgttgatcggtttcgtcgttattatcgtttgtgatttcggacgtcgtcgtttttgcgtcgttcgcgcgtcgagtcgttttcgggtttcggtcgcgttgtttcgaggaagcggcggcggatcggggtcggggttcggtatggatggtcgcgattttgcgtcgtcgtcgtatttgttgtcggagcgcgggagtttgggttatcgtagcgtcgttgtcgtcgcgcgtttcgtttcggttgggttcgtcgcgtagtttttcgtatatttttagtcgggaaagtatttttcgtcgtcgttgtttatggtttcgtatataggttagtgttcggtcggggcgggcgcgggacgggagcgttcgagagcggaatagggcgtttattttttcgttttcgggagtagagaagttttggttttatttttcggtttcggtcgcggtggttgtttgggcgttgagcggggtcgcgcgtttcgttagttttttaagttgcgtcgtcgcggtttagagaggtttttttttggttattttttttcgggggtttcggaggggtagtttcggagtcggttgaaattaaagttttttcgcgtttcgttattttttttcgtttttttttgtagatttaaattttacggaaattttttttttgtattttgtatttatttttttaagacgtttcggggttgggataacgaggcgttttttgcggaaataaaacggttgttgtggcggggggaggggattagggtacgtcgcggtttcgcggattagagtggtgtgtgcgtcgggcgagcgttaatagggattgttggtgtaagacgagtaaattttgtttttatataaagttttaaagtgttagggcgagaatgggtttgtagggatgtatttgttttaacgagtgtttttggtatttcgttaaagtcggataaagcgtggttagagtgcggtttagttttttagtttgcggttcggggaggagggtagcgcgggcgcgggttgggggtggcgcggggcggcgtttaggatttcggtgtaggcgagagtgcggcggatttgttttaagaggagagcgaggcggatttgttttaagaggagagcgtggggcgtcgtgttgggtttcgtagggacggattttttcgggcggttttttttgattttttgttcgagaggattagtttttggtagagcgggtttaggtttttagggtagtttttttttcggtggttttgatatgagtgtcgagggaggttagggtaggggtagttattacgtttgaagttttagaggttattaggcggcgcgggtagattcgggggaagcgcgtagggttgcgttagggattcgtcg

SEQ ID NO: 6339 - DNA, 1408 bp, synthetic construct
  misc_feature 1..1408: note = Description of Artificial Sequence: Synthetic polynucleotide
  source 1..1408: mol_type = other DNA
tcgaggtttttcgacgtggatatttaacgtttttggaaagggagtgaattggtaggatattatcgtttcggttagtttcgcgggagttgttttttagaaaaaaaattttttagagttaaaagttattttttaagcgttttggggtttttcgggcgtttttttcggacggtaattttagaagttaaagcgattgtatcgttaggtttgtggcggttggaagcggggtgatcgcggttagatggtatttcgtatttacgtagggttgtgttattttagtatagaattagtaatttttatacgaagttttgtgtaaatattacgcgggtttatttttgaacgattttttgatgttttcgttgcggttatttattttatatataaattaggatttcgttgataaattttcgtgtttttattaaatagaaggttgttttgtagtttttttcgtgtttttttttaaagtacgataatatttgatatttttataaatcggtttgtagaggatatcgcgtagggggcgattaattagttgaggtgtgttattttaaaatattagtgggtatattttaaggcgggtacgtggaagggacgcggaatcgagggtaattattttttagtcggtgaatttgatggagaaagatgttaaatgtatttttcgagttagttgaatttttcgggtatttaattattgttagatgtggcgagggcgtacggagaatatttttagtttcggagaaaatattcggtcgttagcgcggggatcgttcgggtcgggaaacggttagaggcgggaggagagaggattgggcgagcgtggggagcgttgcggcgtggaaaagcgatcgggagggatggcgatgtttttatttttttcggtaggtttttttaattaaaaagttggaaacgggaattcgtaaataacgatttagggttttaaattatttgtaaagacgcgatggggaggggaatatttgcgcgttttaaaattttaatttcgaggtttttagtcgcgtttgattcgggagtcgggtgcgtttttagtgttcgcgtacgaattcggcgttttggtagtttcgatttttcgggttcgtagtttaagggaaggttcgcgcgggaggtattttcgtggtttttcgcgcgtttcgaagttcgtttttttcgtttagagtttcgcggagttgtcgtcgttttattttttatggtgatcgtggggacgtatcgtcggtcggggagtttcgcgcgagcgtcgcgtagtcgaggaagtcgtttcgagcggttgtttatcgtacgtttatggtagtcgcgtcgcgcgtcggtcgtttgcgttttcgttttttttcgtcgtcgtcggttcgcgtttttcgcgttttcggtttcgcgttttgttgtttcggggttgtcgcgcgcg

SEQ ID NO: 6340 - DNA, 208 bp, synthetic construct
  misc_feature 1..208: note = Description of Artificial Sequence: Synthetic polynucleotide
  source 1..208: mol_type = other DNA
gcgggcgtgggggggaaggggaagaagttcggcgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcggtttcgagggcg

SEQ ID NO: 6341 - DNA, 805 bp, synthetic construct
  misc_feature 1..805: note = Description of Artificial Sequence: Synthetic polynucleotide
  source 1..805: mol_type = other DNA
tcgttttttgtttttcgtattttttcgggggaggggtcggttcgcgttcgtttttagttcgaggggtaatttaaaatatggcgtttcgggcgggggatttgtgtaaattggcggagaagggacgcggggatcgagtcgttttttcggttagggattttagggaggtttttaggtcggaggtcggggtttaggttttgcgcgtcggtttagttattattgcgtcgtggcgggcggagcgggcggggggcgcggcgcgtaggttcggttcggtgggggtttcggcgagcgggagggcggttggggatttcggtcgcgtcgggcgcggggttcgggattcgggagatcgcgcggcgtcgaagttacgcgttagttttattgtttcgcgcgtttcgttttaggtttcgggtttttttttcgtatttcgtaaagtcgagattttttcgtagttttttatttcgagaggcggaaaagttatttgggattagtagggagttcgggcgcgtcgcggcgtggggattaggttcgggcgcgcgttttcggcggcggtgcgtaggagattcgggcgtggggaggaagtcgtagtttagggttgttcgtcgttgtttttttcgttttttgttgtaggagatatcgaggtttcgcggagttgcggcgggggtttacgtttagagatcgtgcgaggaaagttaatttcgttttgtttgtttttttagtcgcgggggagggggttatcgtagtattttaggatagttatatgggtatagtttttttcgttttggcgtagggttaggtttcgcggacgacg

SEQ ID NO: 6342 - DNA, 2462 bp, synthetic construct
  misc_feature 1..2462: note = Description of Artificial Sequence: Synthetic polynucleotide
  source 1..2462: mol_type = other DNA
tcgcggtttagttttaatttatcgtattttagagggaattacgagggagttgcggattggcgggggcgggggtttgtaattaatattaggtgtttgtgagagagttttaagggcgggggtagtattttttggttgggttgggttcgtttggtttcgtttcgttttcgggatttttggcgtttagcgtcgttttttcgttattgcgttattcgttagagttcggcgttttttttttttttgttttgtggacgtcgtttttcgttttcgggaggatttcgtttttagtattttaggtttttttggcgtaaaggtcgttagttcgagcgagtttaggcggcggttttatttttgtagagggaaagcgaaagacgcggtcggcgggtcgagggggcggtcgaacgcgtcgcgtggttgttgttttcgaattcgtagcggcggcgttagggcggttatcgagttttgcggatttcggtttaatttttagcgttattcgggtgtttcgagttcgtcgtagttttcggcgcgttttttagtcgcggtacgtagtttttgacgcgttcggggcgttttttcgtagtattagttaggttattttatttttcgcgtcgcgttttttcgttagtcgtcggttaggagtttttcggtttttgagtaggacgcgttaaagggagttgggaggtttagtagtttttagcgtcgttttttcgggtgacgtgacgttttttttggagcgcgggttcgttttcgttaagtttttatcgtaggtttttatagtcgagttacgggaagatgtaacgtcgggcgaggggcgtttttcggattttgaaaaatagttttattcgtttcgggaacgtttcgattttttattcgtattttttggttagatgattttaattttgggatttcgcgttggtcgtgggggtatcgggagttggagttggaggagaggagtcggtagcgcggagttgtcggggtgtagttgcgcgtagttggcggcgaggggaggcggtttttgcggtttcgtcgggttgggggaattggtttttgcgtttttgtttttcggaggatcgtattcgtttatttttatatattatatatatatatatatatatatatatatatatattgtcgttagcgttttttacgttataagtcggaatgcggaggttagagttattgtttatttgaaagtaggaaagtaggggttgaaacgttgagatggaggcggaggttttggttttatttgcgaggttcgtattttttcggaaggtttttttttttttcgcgtttttttagggcgagtaaggtttagtttttgagatttcgttttttgggttagcggttcgagttgtaggggggcggggacggattcggagggagtattagagagagagttcgcgtttatttttgtttttttcgtaaagaattggttagttttattcgcgtttagtttataattaggttgtcgggatcggggagttagattttaggtcgttttaatttcggcgagggcggggaggggagtgatagtagtaattagcgcgcgttggtaaaagtatagagtttcggaataggttaaacggtcggcgcggaggggtggaggtaagagggggcggaggaggagttgttcgagcggagagggatgacgttttttagggttttgggtttcgaggaatcgaagattggtgcgttcgtcgggtttcgcgtattagttttggggttcgtagaggcgtcgcgttcggttttcgcggtagttttaatatagcgcgtaggcggtcgatttcggttagtttaaatcgggcgtaagttttttgttttttttaaagtatttttttgttcgtttttagtttttaggtgttcgtttgagagtttttgtcgttttcgggcggattcggttaggtagttttcggtcgggttagtttcgtttttttttcgtttttttttttatcgatttcgagttaagggtaggcggttcgtattcgcgtttttgtttacggggttaggcggcgttttcggtttacgttcggttgttaagaagagaaaggcgtttatttgagttatcgaagtttttttttggggtttttttcggagtttgttcgtagttcgtaggtataattttttttggagaaaaaaagtagcgtaagggtagagagaggtagggttgtttataggttttttcgtaggggttttttttttcgaatttttcggggtttagtttcgggttcggcggcgggaaagagtttttggaggttggaaggggtcgttagattcgggtttttttcgtagttgcggtggcggtatttttaagttgttatttgtagcgcgtttcgggcgtttgtgatagttcgcgtcgtttagttttcgcgggttcgtttttttcgttcgttcgttggttgcgttcggtgttcgggcggttttcgcgttttgtttcgttttgagttcgttttttagtcgcgcgttcg

SEQ ID NO: 6343 - DNA, 990 bp, synthetic construct
  misc_feature 1..990: note = Description of Artificial Sequence: Synthetic polynucleotide
  source 1..990: mol_type = other DNA
acgtggtgtgtgtgtgcgcgcgcgagtgtgtgagcgttaggggtcgttcgttcgtcgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgttcggggttgggatgcgtcgggggtttagtggcggcggcggcgttggcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcg

SEQ ID NO: 6344 - DNA, 2274 bp, synthetic construct
  misc_feature 1..2274: note = Description of Artificial Sequence: Synthetic polynucleotide
  source 1..2274: mol_type = other DNA
tcgtttttcgtgtattgtttgcggttcgtttcgggtttatacgggatatcgaggtatgatgaggacgtagaatagtagaagcgcgttttgtttttcgggcgttagtgttcggggttagcggcgtgtattcggcgggttcggtcgggagcgggttggcgatcgcggggttcggcgttttcggttttcgcgttatttttcggcgttcgttaatttcgtttcgttcgcggcgtagagaagttcgtagtttttcggagttttagcgattttttggttcgtttttttcgtagtcgtcgagtagcgtaggttcggcgatttcgggtgtagttggttttgtgcggtgatatcgtcgttcggcgttaggttcgaagtcgtttggtcgcgttcgcggggtcgtaggtcgttggtttcgttcggtcgcgtttataaattattcgcggttcgtgattcgggataaatttttggcggcggcgtagttttttttatagttattttttttagagttagttattaaaatagaagacgcggtcggggcgaggaggtgggcggggggagttcggtggtcgttttttttcgcgcggttgacgttcgtttcggcggcggtagtggttgtggtcgcggggtcgtttttagtcgagttttcggaggcgttcgggcgcgggtcggcggggtacgggcgtttacgttttttagcgggtcgcggcggcgtcgggcggtcgtgacgtgagcgttttttttagtcggtttgcggggtatcgttagttagtcggggagtaagagtttcgcgcgtagtcggcgcgggttcggttatcggcgcgtcgtcgttcggggttgggtttggggttgtttgtggagaggcggcgggcggaacgcgcgcggttacggttacggttatcgttacggttacggttggtagttcgggtttcgggtttcgggtaggggaaggggagaggcggcgagtttagtaatcggaatcgagggaagattttggtttcgcgggttcgtttttcgttttttttgttagcggcgttagacgtcgagtggggttagggataggggaggaggatttaggattttgtgttcgcgtttttggagtcgttggagttcggatttttgtaattgttggtattttgggggtttggtttagcgttttgttgtttattcgttttttttcgttgtttcggaattaaagttttcggtttttttcgttttcgcgcgtttatttatcgtcgtcggggagcggttcggttcgtatttagtattatgaggggatttgggatttgtttggcgattttggtcggatttttgttaattgcggcgggcgagacgtttttaggtaagcgggatcgtttttgtcgttttcgaggcgcgcgggtcggcgcgggacgttcgggacgtcgatagttttttggtggtagagttttaaggttggcgtcggggtcgggcggggggcgcggcgggtcggatatcgtttttgtttgtgagtcgggcgttgggcgaggggtcgtggggttggtaggtatttagttttcgggcgggcggagcggacggatttcgagggcgagttttttagtcgggattgttagttcggtcgtcgttttttcgcggtttgggttagtgtttaaggttgggcggtttgtatttttgagtttttggtcggttgtaaaaggaatagtagaaaattttgtttgaagtttttagttgtagtcgtcgggtcgtttggcgtaggcgttgcgcggttttcgtcgatttcgagtagcggtcgggtttaggtcgttggtgttcggttgcgttcgtagcgatcgtcgggaattggcggtcgtttcggcggcggcgatttttcggtgttttgttttttttgtcgttttttgttcggcgcggttggcgatttcgggaggttttcgcggtcgtgtagcgtttgcggagaggttggggggagtttttcgtcggttttagcggtagggtttggcggtcgcggagggaagcgggtaggtttttaggttttggttacggttttgcgtttcgttgggttttttttttttattttcgtttttttagcggagcgtcgcggttagttgtaatttgtttatttagttcggttgttcgggggttttaggtgggaaggagaggtattggcggtgtgcgagtaagcgtgtgagtgtgtgcgcgtgtgtgtttgtacgcgcgcgcgggggcgttttaagtttagaggaattttttacggagaggatttgtggatcggagtcgggggttcggcgtgggggcgaattcggtacg

SEQ ID NO: 6345 - DNA, 882 bp, synthetic construct
  misc_feature 1..882: note = Description of Artificial Sequence: Synthetic polynucleotide
  source 1..882: mol_type = other DNA
gcgaagtgattttttacgtttggataaagcgttcgaaagtttaggttcgcgggttagttttagtcgttgggtttgataggggttagggaggcgggtcggttttatagttaagttatagttttagggtttggtcgtatttgagtagcgcggtttcgggttgttgttggcgttgtaggtttcgcgtttgattttttagtttgcgtagcgggtattcggtcgggaagaatttttttagtaggcggtttagtattacgtttacgcgttcgcgttcgcgttcgcgttcgtggtcgcgcgggttttagttttacgtagcgtttatagatcgtgagttcgtagggtagtgttatcggtttgtgtagtagtttcgggtagttaagtaggtcgcggggcgcgtcgggcgttagggtcggttttttttagttttgagttcgtcgttcggttttttcgttaatagtggtcgttcgcgtaggtcgggatatattaggtcgttcgttagtttttttagttttttcggtcgtagcgtttttagtttttcggttatacggaacgcgtttagggttatcgggaggcggtcggcgcgggttagagcgttttttagttttaggtatcggtcgcggtcgggttgcgttagtcgggttagtatggagcggaagagttcgattgttttttggtattcgttcgcgcggaaggtttcgtcgtttttttttaagcgttgggcgattggtttttcgtagtagtagttcgttattggggcggcggcgggatcggtttagtgttgattttcgcggggttgagatcgtgcgggtttggagcgaaggcgcggagtaggggcgatgagttgttgttgggaattggtcggcgggagcgcggttatagttttcg

SEQ ID NO: 6346 - DNA, 4359 bp, synthetic construct
  misc_feature 1..4359: note = Description of Artificial Sequence: Synthetic polynucleotide
  source 1..4359: mol_type = other DNA
tcgtgttttacggaaattattattatcgtatttataggtttcgaggggcggatataaagttttttgggggaagtggggtcgtagatttttttcgattcgaatatagattcgtatagggcgcgtttgggcgtagtttcggattttacgtcgggttcgatttggttgtttttggggaggatgtaagtgttttttagcgagggcggttgggggcggtggtggtgggagggatgggtgggggggtggtgggagtggtgtcgtgtcgtttcgtttagagtttcggcgtagtagttttgcggggcgggcgagtttagtttggtgttaatgttcgcgatgttgttgagcgtggcgatggagacggcgtcgatgtagtggttggtgtaggttttggagagtttggtcgttttggagagtatttgtattcgagtgtttagtaagtttttgtcgatggttttgttttcgtattaggttatatcgttttcgttgtagtggtttcggggtcgttggaagaacgttttgtagagagggttgcgtttcgataggtatttgacgaagttggcgtaggggtagaattcggtgttcgttttatatatgcggggtaagtttttttcgtcgttgttttcggcgcgttttttgttttacgacgacgagcgcgatttgtggtagggttcgagggatttgaagtagacgaatttgcgatcgttttcgtttatggttagtttaaaagagtttttttttaatttacgttggttttcgcggtcgcgggtatagaagtatatgtacgtttcgaattagattttgttgagtagttcgaagggcgtgttggtgttgaagacgttggaggtgtatagtttgcgtaggtcggcgcgcgtgatggtttgtttttgtattatcggttcggcgttttgtttttcgagtttgcggatgatcgcggttagcgttaggttggcgttgcgtagttcggggtttttggtgaggtcgagcgtgcggtagtacgggggtttattgaggtagcggttgagggagttgcggatgttgatgagcgacgatttgttgtagagttggtcgtttttggagcgggtttcggtatagaaggagcgtagtacgcggtatagcgtttttttgtttatggtttcgaagttcgggttttgcgttttttcgtttaggtattttcggaagatgcgtacggcgtagcgggtggttagtcgggtgttttcgtttagtcgggttcgttcggggcgttgtagtacgtcggggtttagttcggagtcgttttcgggcggtttatcgcgggttcggggcgttagtagtcgcggcggcgtttcgggttttagcgcggcgttttggtttatattgattatatggatcggttcgggttttagttttttttcggtcgagttttcgggttttaggggttcgttttagtttagttttattttttttttttttttttttttttcgtttttttttagttttttattttcgttttttttttttttttcgtttttcgttatttgtattttttggatttcgtttttttttttttttttttttttttttttgttcgcgttgtagtagtgcggacggttgtggcggcggtcgcggtttttcgcgtcgcgttcgttttcgtttcgttttttattgttttcggcggcggcggcggtagcgttggcgttgtcgttcgcgttggtgttatagttttcgttgttaggtattttcgttatattgtcgtttttttgttagttttcgggtagggcgtatgcgttatattggatcgtagcgttgagagtttttgtgtttaatgatttttagttatcgggaggtaaagtcgggtttttaaaggagtcgcgttttaattgttattttcgagcgtagtttcggaggggtagcggcgcgtaggggatggaggggaggggggagggggggataagttagatcggagagatagggtaaaggacggaggttgattagatttttttttttttttattcggtttttatttttaagaaaattttgaaggaaaaaaaaaaggaaagggagggagagttgtcggtgggggcgaaatatttttaatttattttttggcggagaattgcgcgggttcgggcgggagagagggagggtcggcgagagggcgggacggtttcgtttttttaagtaatgttcgaggagtagtgttttttttattgtttttttattgtttttcggagtcggggggtcggggcggcggttgcgtcgggcgggtcgcgggtgttgtcgcgggaaattcgtgtttggggtcgttcggagcggagcggagtaggtaggttaatgagtagggtggaggaggtacggcgaggtttcgtattttttcggcgttcgcggttagggcgtagcgggcgaggtttgggagcgggatggggttggcggcggcggcggtttttttatttatttgttggcggcgaggcgcgggggtttggggttagtcgcgcggtttttaatttttttttcgatttttgtaaaggagcgaaatacgttttacgttagttatatttttttcgatttttttaatagttatatttaagttgttattaaagatttggggcgtttttcgtaggtttggggtaagttcgcgtcggtttagttagtttcgggaaggagcgaggtagagaagattgggaggggtcggtgggaggggagacgagggaagaggcgtttgggattttaggggttatagggatttttttttattcgtttagggcgtcgttttttttgtttttgagtaaagtgatataattttttcgggcgaggcgttttattaagttggagttgaagtttttttaaggtttatcgggtaggcggaaaaagcgaatttgtgtttcggtcgattttgtcgtagttataattcggtaattcggattcggagcgtatttttatttaaagtttgttaatcgttattcgttcgtttttcgggttgcgttgttttaggcgcgcgggggcgggtatttcggaaattggaaaagtagttaaagagttcgtcgggtttcgtttttttataggagatattgttttatttttagttaaacgttcgttttcggcgcgtttaggtttcgggcgcgtttttgcgtcgtcgtttttcgttttttcggtttaggggtagttttttagagtcgtcggggatttcggttgtttttttaggaggtatagtttaggttattttcggagttcgtgttgtattttaatttttattttttttcgtagttcgtgtgtattttggcgcgcgggttagttgcgagtttttggggtgaggggatacgagggagttaggtttttagtagtgcgtttcggtgttaggtcgttttgttgggaggtagtttcgtttgtttttcgggtgcgttttcgaatttatttttaagttcgaattttcggtagttaggttgtgagagttatgttaattgtttgttttttttttttttggtttttttgttttgtttttaagggaagtattttacgtattaattgaaatttatttattaatttgtattttttttttttaagaaagaatgaaagattaggttttagggtagtgtgggtttttgagtgggagttgacgatgtttttttttgtagcgaacgttgttggtttttcgcgtgtttgttcggttttggacgttattcgagtttcggggaaatcgcgttaggtgtgaaataagttagagtaagtttttgtttcgcgggtcgttttcggttttttagggaaatataagatatatagatatatatatatatatatatatatatatatatatatatattacgtttttattcgttcggtttttcgcggagaatcgttcgggaatcgttttcgaggtgcggcgcgggaggtggtcggttttgtttataatgtattgttcgtcgtattcgttttggatacgtgtagaaaggcgtgttcgttttttcgaggttgcggtgagtagttaagttagttgtatattgggatttttatatacgagttggtatatattagttatatacggttaattttagagggttggttttttgttttgggacgtttttaggttttcgggtcgcggtgcggagaatttaggtgggtgttcggtaagttatttattaggggttgttttttcgcgattttcgttataagcgtagggattcgggggtcgcgttggtttcgggttgcgtttttggtttggtaggggattaggtttacgttgtagtttgggagcggagtcgttttttaggtttttttatttttgcgggcggcggggtttattttttttttattagtttttttttttattgggcgagttgttttgaattgttcgtagtttgtcggaggcggtgtgttgggttggacgtttcg

SEQ ID NO: 6347 - DNA, 2762 bp, synthetic construct
  misc_feature 1..2762: note = Description of Artificial Sequence: Synthetic polynucleotide
  source 1..2762: mol_type = other DNA
acgattcgggaggagagcgtggagtcgggtagggataggcgtgtcgtattatggcgtattatggatagggtttcgcgcggcggcggtttacgatcgtttaggggttgcgggagaaagcgcgagagattgcggaggttagtttcgtttagtttttgttttcgttttagtagtatttatttttcggcgggtcggagcgcgttaggttttgattcgtgaagattacggagcggggtaatttatattatttgtttttattttcggagtaggtattttcgagttgcgttcgtatttttcggggttgttagttggtagtagagtatttttttttttgtttcgagggcgataggtagggggatttttcgtggatttttttgtttcgcggcgagggtgggtacgtttttttttcgtaattttcgagggattttacggtaggcggagatcgatttgggattagggtattgtattcgtttagttagagggtttcggtcgaggttgtgtgaagtggtttttaggtttgggttggttggtcgggaggagtttgggggtattttcgggttggaggcggcggaaagttgggttgttttcgggttgggaattcgtagcgtgtagtggcgagggaatttgcgttcggattggagtaggtgttttttgtcgcggaggagttttttagtagagattaaatgaaaaggttcgttggttttttttcgagggtatgaaaagtacggaaggttttaggtaaaggcgttttcggggcgtatatagggtataggtagtcggatagagaaaggagtagtcgcgtaacggaatttttcgttcgggggagatattaggcgtgagaggttagattcgttttataggtaggcgttgatcggtagagattttttcgggtaagagggttagattttttttttaggtgggacgaatatagaatattgtgagggtaagagaagaagaaaaggaggtaattttagattgggataaagataataggatagtagagtttttgagtatcgggaggcgtacgggtgtagggtggggtaaggtggaggtaagtttcgtaattaagatattagagtgagaatttttattgtaaattcgcgatttatttttgtagaaataaataaaaaaattggagtaaagtattatgcgaggggcgaaaggtatagaaaattgtaaaatttgggagttattttgttttatttttttgttgtttggggatatttttcgcgagtttgttcggtttcgaagaaggagtagaggggattcgtaatttagtttttagagtttcgttaggaaaggcgcgagagatttattggtttcggtaattttgtttcggcgttcggacggagttcgatgtttgcgtagttatcggttgcgcggcgcggcgcggcgcggcgtggtattttttttttcgggtgcgtagttcggtttcgtagcggcgcggggaataaagggattcggcgtcgttcgttttatttcgttcgtggttcggttcgcggggatcgtcgcgtatttgaagtagggtcgttagtagcggtagtagggttcgtagcgttttcgttattcggtatatggaggcggagaggggtcgagcgaagagtcggaggaggcggcggcggcggcggcggcggcggaggaggaggaggtagcggtagtattaatagcggcgcggagaaacggttttaggtagtttttattttttttttttttttttttttttttattttttttttcgttgtttttcgtttttcgttaatggagagcgagttgatgataaatagcgggtcgcggagttcgcgggattcgtattaggagtaataaaatagatttagagattaaggagttggggagggggcgggggaatagggagggagagcgtgtgagcgtttgcgagtgtgtggaggcggttgttgtggtagcgtaggcggttcggtttcggttcggagcgtagcggaagtcgcgagggatgtagcggcggggattttggtcggtggaggatgtggaggtggaagtggagcggatggcgttttttaagagtttcgttacgcgaggtttcgggttcgtggttttgtttttttcgggttttcgttttagggtcgttcggcgcgacgaagacgtcggggatagcgtcgcggggagggcgtttcgggtcgtgcgtgttgtatttataaagagtagtagtttcgttatttcgcgttttcgttgcgtgggggtcgaggggcgtttttcggttttttttttcggtttttcggcgagttggagattgtttttcggtttcggtcgtaagggggtgaggcgaggggtcggcgcggtttttttcgtcgcggtttcgtttcgcgtagttgttgtcgtagtcgtttttgttgttcgcgtatcggtattcgttcgtcggttttcgttttgcgtcgtttattcgcgcgcgtcgtttttcgtcgtcgatcgcgtatttcgttcggttttcgttgcgcgatttgggcgagtcgtcgtcgtttttttcgcgttcgttttacgcgttgtttggttgcgcggttcgttttttttttttatttttttcgtcgtcgtcgtcgttttcgttttcgtttttttttttcgttgagttttttcgttcgcgtcgtggttaatcggaggttattaagttgcggttgtagtcggtcggattcgcggtagtcgttcgttttcgtttcgtcgaagcgtttcgtattttgttgtagttcgcggggggtcgtcggagggaagtttagagtgcgtcgagtatcgtttcg

SEQ ID NO: 6348 - DNA, 338 bp, synthetic construct
  misc_feature 1..338: note = Description of Artificial Sequence: Synthetic polynucleotide
  source 1..338: mol_type = other DNA
tcgcgggagtcgcgtaggcgggcggttagggggagtgggcgtcgttcggtagcgtttcgcgtcgaggtataagcgttcgcgtcgaggtataagcgttttcgatttatcggtttcgcgcgttttttcgcgcgtttttcggattcgcgtttgtttattttttcggttttgttgcggtcgaggttttaagtcggttatttcgtgtttaggtaatcgcgggggcggcggcggcggcgtgaggagcgggcggttgttgtttcggggttttttggttcgagtttttagttttcgattttcggcgtttcggcgttcgattagcgttttaggtcgttttcgtttcg

SEQ ID NO: 6349 - DNA, 1435 bp, synthetic construct
  misc_feature 1..1435: note = Description of Artificial Sequence: Synthetic polynucleotide
  source 1..1435: mol_type = other DNA
tcgcggtaacgatttttgggagtgatcgaggtattcgggttgtttcgtgtttttcgggtagcgatttaacgataaaatttgatagtgttttggggaaaattttatatttatcgttagcgttatattcgggttttatgttaataaggagatattgtagattatcgattagattcgtttgtttttagagcgtgcggtcgggtttttagtttggtttttaggcgcggtggcggcggtgggatacgcgttaggcgtttagagaaggatatgggataatggtttagttcgaggacgttagacgtcgtcgttcgattcggggaaggaagtttttgtagtcggttcgggaattcgaggcggggagggaggttagttttggaggtgcgttgtcgttttaaaataaaggattataaagattgtatagtggggaaaacgcgtttggttaatgcgagtggggacgatttggggagggggttgaggaaggtagggggtatacgagttaacggcggtttacggttttttttttttttcgtttttttttttttttttttttcgtcgggttgtttcggtagataaataatagaggaaggcgagttatttatcgtggttttgataggtacgtagagtatttgtttggcgtcgtcgtttttttcgcggatttcgttcggttggtttagttggaagtttttcgatttgatttagaatttaaatttggcgttgttcgtggagttcgattcggagttattgaggagttggacgattcgttcgtattttttacgggttatcgttttggttttgtttgagttttcgtaagttttgaggtattagttttggaattggcggtatatgtcgcgttcgttttttatgtttttcgcgttcggtcgttggtcggatgtttttagcgtatttcgtatttgtttattttaggtttatgaaaaatgtagtttcggttacgttgtagggatgcgaggtttcggtcgtagcgggagtttgttttgggtgggggaagggatgggaagaggggaggagggttcggttgggtattagtaattaatgtttcgtgttattaagtttggtttattcgtaattgtaacggttgtttcggacgttttttttgtttttttagcggtcggtttttttaatattttgtgattaggattattttaatattattttggtttagaggagttgggtttttaataattaaaattttattttttggtttattaaaaattttaatattgaattggggtggtttttagacgtttcgttttcgggttgcgttcggggttgggtaggtggagcgtagcgtcgttttttcgcgcgcgttttagaagtttttttagttattggtttcgtggtttaggagtgagggttgcgtttttttcgaaagtagtcgttcgtttagcgtttttgagtttcgaagggtatacgggtttcg

SEQ ID NO: 6350 - DNA, 510 bp, synthetic construct
  misc_feature 1..510: note = Description of Artificial Sequence: Synthetic polynucleotide
  source 1..510: mol_type = other DNA
tcgaggcgcgatagtttattaaagacgagggttggttttttaaataaatcgcggtgattttatttgcggcgtttttttttacgtcggttttttttttttttattagagcggttcgcgtcgattcgatgggcggattcgatcgcgtacgcggttcgcgggttcggcggaggtagttttcgtttcggggattcgggacgcgtcgttttttcgttttaggttgttcgcgtaggaattttacggttacggttaagtggggtttttgtttcggatttcgttgggttcggacggtcgagagtttagggatttgggggggcgcgcgggttttcgagtttaggcggggcggcgggcgttttgtcgtttttttttcgcgcgtcgcgtcgtcgttcggtttttcgaagtcgttttttgtcggcgcgtcggtcgtttgcgttacggcgggcgttatttatttcgggtagagttttttgttcgtgtagcgcgttttgggtttttagcgttgatttacgttcg

SEQ ID NO: 6351 - DNA, 2722 bp, synthetic construct
  misc_feature 1..2722: note = Description of Artificial Sequence: Synthetic polynucleotide
  source 1..2722: mol_type = other DNA
acggcgatggatagtattttcggttttcggtcggttaggagttcgcgagttcgttcgtttagcgttttgggttcgatcggtgtagttttttttatttttattttttaggtcgttgtatttaaaaatttaagtttcgttttttcgattttttttttttttttttttatcggcgttcgttgttttttttatggtatcgtttttattagtatttcgtttaaaatttagttttgttttagcgaatagttttttacgtattttagttttggttttcgttgttcgagcgtttttttttatcgcgttcgttcgaggttttttttcgtttagttcgtcgttcgttagtcgtcggtcggtcggtcggttcgttagttcgtttttgtttttcggtaaagttgggagggaaaggtgtatttatttttgtgtatgtttgtgaatttgttttttagaatcgtaagttcgtagattttgttaaatttttcgaagaggggtttgaggttttttttatttaggttgcgggggatttgtttaatgaatagtttgatggtatcgtggttttttatgggaatggtcgacgggtttttcgggttgtggtttaattcgtttatgtgttcggtattgttcgggttgttgtcgagttcgttggtattgaggtttgcgttgttagtttgttcgtttgttaacgtggttatttttatatatatagagaaaattttttttttttttattttttttcgtttatattttttcgtttttttttttcgttcgttcgcgtttatatacgtatacgtatatatatattcgggttttttttttttcggtttttttatatttcgtttttcgttcgttttttgttttttttttttttttttttttttcgttcgttcgcgttcgcgttttttttttgttttttttttttttttttttttttttttttttttttttttttttttttttttttttttttttttttttttttttttttttttttttttggtttgatttgatttttttttttttttttttttttttttttttttttttttttttttatattgaatagataggatttttgtttttttcgtttaaataggttggatcggtttaagtttttagttagattaggggtgggggtggcgagtgtgcgcgcgcggaggagggcgcggggggtcgggaatgggcgcgttgtgggggttcgcgttacggcgggcggcggtcgggggtagggcggcgtggggcggcggttatcgcgtttttttcgtcggcggtttcgcgtcgtggcgatggtatagttcgagacggttttcggttataaatagcgttaggcgtatggtttttcgggaggcgttgagatttcgggttcggcggtcgcggggagcgggtgttcgtgaggagtcgggtagtcggttttttttttttgttttttgggggttttttttgtaatagtagtaggtgtaattttttgtattttaaaaatagtgatttttattttcgtgtgggtatgtaggggggttttatttattaagttatgttttattagggcgttaggcgggcgaagtaaaggtagggatggcgggcggggcggcggcggaggtggaatgggcgttttttttttttatttggttttatttatttatttagattagaaaagcgagtcggtttggagggagttcgttcggggattcgagcgcgtatttattagtgtcgagagaaaaaaagttatataaatatatattatgtggataaatttatagataagagttttttcgcgcgcgttttttttttgtttttttgtgtgtgtttttttttgttttttttttttttttgtatttttaatttgttagagtagttttatatttttttttcgttcggtatttatcgttatttaagttatttgttaggatggggttgggagttgtcgggtcgcgtcggggggtagagggacggggagtagagattcggggttcgattttcgttttaattcgttttcgaaggcggaaggtgggggttttcgtttcgggcggtttttttcgtttcggagagcgcggttggtttttcggtggttggcgggaggaaggtaggagtcgggcgtttttgttcgttcgttcgtcggagggggaggaaggcgttgggcgcggtggtcggtgagttagcgcgggggatggtttgatttgttttcgtttgttttacgggtttaaatagaatatatttttttaattattattaaaagaataaagtttttgaatcgttatttgggttgtcgtcggatcgagattcgcgcggcgtgcgttgttttcgcgggtttcgttttcggtatttatagttttcgaggtgcgaggttgagtcgtttttgtcgtggggatcgggggtcgagtcgttcggttcggatttcgtcggatttttcgttaggtttattggggttggtatttcggttgcgcgggaaagggagtggtaggcgcggagtcgggagtagggttcgagcggtttcgtttgtaggggtgaatattggtggtgaatttggttggggtagtagatttttacgttaatgatatttatttgtatttcgtttttttttatgtttgtttttttagggtagttttttcgttttagaagtttggtaaattgaaataacgcgttcgttttttcgcgggttgcggggttggggagttggggcggcggggttgagcggttggtttaattttcgtcggttttcggttagttattttcg

SEQ ID NO: 6352 - DNA, 1133 bp, synthetic construct
  misc_feature 1..1133: note = Description of Artificial Sequence: Synthetic polynucleotide
  source 1..1133: mol_type = other DNA
acgacgcggtgcgttaggtagagagtttggggagtgtgcgtgttttatttgtgtttgtatcgtgtgttttttttgtgtgtttttgagaatgcgtttttggtacgcgttttgcgttaataaggcgtttggtgtgtgtatgtttgtgtgatagtgtttgggttttgtttgcggttgtttgttcgtattttagttttttttgtgttcgtagttaggttttatacgtgcgttagttttcgagcgtacgttttcgagtgattcgtgcgcggtgtgtagggattttagggtcgtgtgtattaagggcgttcgtgttcgtttttttgtattaaggaacgtatttttatatgtttgagtgtacgtttttttttatgtgtgtacgtttcgtgtttacgtcgtttatgtttgtgtaggggcgttttacgcgcgtttttttcggttcgcgggcggttagggattcgcgttgggttttacgtttttcgtggggttgatttttttttcgcgtttcgtagcgggtcgtagcgattggtcgtcggtttttttttagtcgttattttttttttttttcgttattcgcgcgttcgcggttttcgttgtttttcgcggtttcggcgaggtcgcgtcgcgttgcgtttcgtttttattggttgcgcgcgtttttgtgtggcggtagttgcggttttagcgtttttgaatgtcgagaggggtcgggaagggagtttttttatgggttatttgttttttcgttagtcgtcgttttatcgtcgttcgcgtttcgcgtttcgtttttcgtttcggcggttttcgtagtttcgtcgtcgttcgcgttcgcgttttggagtcgcgttataaagggttcgcgcgtagtcgtcgtcgtcgtcgtcgtgcgaggagttaggatggttttggtttacgtcggttatttcgtgtttttagtgtttggttttgtgcgaaatagaggtatcgtttttttttttcggggtttgtttcggagcgtggatcgtcgtaggtatcggggcgggggcgggcgtcgcgggcggtcgggggtttagggtatattcgcgaggacgtagggcgagcggtggtttttttttattttattttagggggattttcgagggtgggggcggtcgttttcg

SEQ ID NO: 6353 - DNA, 2401 bp, synthetic construct
  misc_feature 1..2401: note = Description of Artificial Sequence: Synthetic polynucleotide
  source 1..2401: mol_type = other DNA
tcgaaggtgtcgttagttttagtgtcggtgggcgtttgtattaggaatagttaaagtcgacgatatttagttatttcgagcgttagggaagacgtttcgcgtaaaatcgcggttttaggcggattttcgttttagtttcgcgttgttggtggtattttcggggatttaaagtgggtggtttgggggtaaaggaatagaggtcgaagaatttggggtatgttttattagagtatttaagggacggagtgggaggttatattagatatgcgatttcgatatattttaaaagtggtagtttcgtgggttatttttaatagtgggatggatttttttaatttttttcgtttttcgaagtttttttgttatttcgggttatgtttttttttcgggatttttttgtgtaaaattatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcgagtttgtgagttttcgatttcggttttagtcgtagtcgttaataattttataataaataagaggataggattgagcgttcgcgtttcggagcgtattggttgggggtaattttttattttcggcgcgtcgttcgttgtttcgattcgagagtatcgggagagtcgagggaagggaaggcggcgaggggaaggtaggcggggatggagggaggtacggcgcggcgcggagcgaggaggtgggttgtaggggacgtcgagaagcggtggggttggcgtagagggcgggcgttcggggcgcgcgttattttcgttttgttttcgtagtggtagtatacggtttataggtatttgagcgttcgttagagtaagatgatgaagaggttttcgaagaaagttattatggaggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagggggcgtcgcgggtcgttcgcgttcggggtttgcgtcgttttcgggttcgtttcggtttcgcgcgcggtttcgggtgttttcggcgtcgcgtcgttcgtcgtgcgttacgggtgtgcgttgcgttcggtcggtgattttttttttcgagcgtttttcgcgcggttaacgagtcgtttttcgtttattaggtggtaattcgttaataatggataatcggtttttttcgttcgggcgtttttgcgttagtttttttttttcggttgcgttcggtttcggttcgtcgcgttagtgcgcgttcggtcgcggtaggtttatcgcgttcggtcgtcggttcgtggtcgtttgttagtttatgttttcgggattttttagttttgtcgttacgtcgttgagtttttcggttttcgttcgttttttttttttgtcgttttcgattttttttcgttttcgttttcgtcgtttaagttttttcggcgcgcgtttcgcgtttttcgtagtcgttagtagtagtagttgtagtaattggagcgggcgcggatttaggacgatttaggcgggaggggaggaggttcgtcgcgttggttcgtttgggtttcgggttgggtaggggtgggtagggtttttcggtagcggttcggtaagcgtttttgatttttagggcgtaaggtagagcgtttttagtttaggcgcggggttaggcgtttttttttaaggtgttgcgtttttagtcgagagcggtggggtatattgggaggacggcggggcgtttcggttaggtcg

SEQ ID NO: 6354 - DNA, 769 bp, synthetic construct
  misc_feature 1..769: note = Description of Artificial Sequence: Synthetic polynucleotide
  source 1..769: mol_type = other DNA
tcgggaacgaacgtgcgtggggtagtttaaatttttgagtttagatttcgtttttcgcggttagatggtgcggtcggtggggttcgagggatgcgtatagttgtgtttgagaggtgttgttttttcgttatcgaagtcgttgggaaattttgttgtattgagatattttaatgtcggatgttttaattttgcgggtaaaaaaaaaaaaaaagtttgaattaggtattgggtttttgttacggtgaattttattcgcgtttcgcgtcgtttttttatttatttaggcgaggtggtttggatttgtatttcgttgaagaagttttttatgcgatattttcgttagtatttcgcgcggatttggttgggcggcggcggggagttagtttgttatcgtacggcggtcgggatcgtagtttttgggtgcgtagtgcgtttttcgttgcgtttttttagagcgcgggtttcgtgtttgtgttcggcgcgacgcgatttttttgttagtcgggtttcgcgtgtttttcgcgtttttcgtagttttcgcgtagttcgtagcgttttttagtttcgtttcgcggtcgcgggaattcggcgtttgtagtttcgttcggaatcgatcgttaggcgttgttgtcgtcggttacgtaacgcggggtttttgtttggtattagttttaggtgttttgtttcgggtcgtgttgtcgcgcgatattggggatttaataggtcgtcggttatttagttggtttcgtagtttttttgcggtttagcg

SEQ ID NO: 6355 - DNA, 1169 bp, synthetic construct
  misc_feature 1..1169: note = Description of Artificial Sequence: Synthetic polynucleotide
  source 1..1169: mol_type = other DNA
tcgtgtttttttcgagtggatttggtttcggttttaaatttagtcgagggtcggttcgtttttggggattcgcggatgtcgcgagggggcgtcgcgttattgaaggttgggacgggggcggtgcgcggggcggcgtcggagttcgggatgtcggttttagagacgtcgcgtttcgtttcgaggaggtcgtcggtcgggtaagcggagttcggagttcgcggagtttggatcgtaggtaaagttgagcgcgtcgtggggtcgggggtggggggttcgcggcgaaggagtcggggtcgtagtgggcggtggggcggggggcgcgggtttttgtttgatggtttcgcgcgtagtttttttttcgggtgcgcggtgcgcgcgggcgcgggagggtcgaaggggattttggaatttttttgttcgggttaagggggcgggggcggttcggggtcgggcggggttggtgtttttttttttcgtttagcgtttagagttcgggagtcgaggggggcgtcgggtcggaggcgttcgtcggtttggtcgcgtcgcgcgcgtggatggaggtttcggtcgcggatcgtttcgtttattcgcgttggttttgcgggagttcgggtgagtcgaaggcgaggaaggggcgcgggtttcgggaaaattcgattttttcggcgttcgtttcggttcggttgggggcgtattcggttcgcgcggagagcgggcggggtgtgggcgaatgttcggcgcgttgcgtttttttcggtttttttttttttcggagatgaacgttttattttcgttcggatatacggtcgtatttttattttgtttttttcgattagtcggggcgcggttcgaattgggggagagaagatttagttttcgtagtcgcgaattttgtaaattcggagtttatgcgtttcgtttttcggttcggggagtttttagttttgttcgtcgagcgtagttcgggttcggattgtggttattggggacgagaagggttttttttgcggggttttcgggttcggatggacggagggggcgttcggtaggtgaattgggttcgtttcgcgtttcgaacgtttttttaaatttataagtttcggagattttggggtattttgcgatttcggagtgatcggtggagttttcgttcgcgcgtttggttttcg

SEQ ID NO: 6356 - DNA, 6036 bp, synthetic construct
  misc_feature 1..6036: note = Description of Artificial Sequence: Synthetic polynucleotide
  source 1..6036: mol_type = other DNA
tcgtatagtttgattatcgtgagtaacgcgtgcggtacgttttggaatttgtcggttcgtagcgttcgtgattaggagttgttgtgggatttgggcgtcgtgggtatgttgcgtaatttggtgtattttaagtataagatgatcgttatgggtagcgtcgtcgttttgcgtaatttgttggtttatcggttcgttaagtattaggcggtcgttatcgtcgtgtttttaggtagttgcgtgtttagtttgtacgtgcgtaagtagcgggcgttggaggtcgagttggacgtacggtatttcgcgtaggcgttggagtatttggagaagtagggttcgtcggtagtcgaggtcgttattaagaagtcgttgtcgtttttgcgatatttggacggtttggtttaagattatgttttcgattcgggttgttttgacgacgacgatgtatcgttatttttggttgcggtcgcggttatcggggagttagttagttttgtcgcgttgtttttttttttgggtagtttttttttgtaggggtaggcgttggttcgtatttcgtttattcgtcgaggcggtaaggaggtagagaaggatattagtggggaggtagtcgtggcggttaaggttaaggttaagttggcgtttgtagtggcgcgtatcgattagttggtggaggatattttcgttttgtatatttcgttcgacgatagttttagttttagttttggagattcgggataggaggcgttacgggagggtcgcgtttagttttgttcgttatgtcgcggttcggagggcgggcggcgagaggtaggaagtcgggcgtattcgttgttgcggtttaaggcggtttacgttagtttttttaacgatagttttaatagcggtagtgttagcgacgggtattgtttacgcgaatatatgttgttttgttcgttggtcgtattggtttcgcgtcgcgaggattttaggtgtgggtagtttcggtttagtcggtttgattttgatttgttcggttgttaggtcgagttttcggttcgcgaggttattttcgtcgacgttcgcgtgcgtattattaagttgtcgtttatttattagtacgtgttattgtttgagggtgttttaagggcgggtgtagagtttttcgcggggtttggaatttttttaggggttcggaagtaggtttggttgtcggtagattatttgagtaaggttttcgagaagttggcggttgtttcgttgtttgtggttagtaaggtattgtagaaattggcggcgtaagaggggttattttcgttgtttcgatgtagtttttttttttcgttgttttcggtcggtcgtttaggttttagcgagggtggtgatttggatgatagtgatttttttttggaggggttggaggaggtcggttttagcgaggttgagttggatagtacgtggcgggcgttcggggttatttcgttgttcgtagttatttcggtttttcggcgtaatcgaggtcggggtttgggggtggaagacgttacgtcgtttagttcgtcggagaattacgtgtaggagatatcgtttgtgttgagtcgttgtagttttgtgagttcgttgggtagtttcgagagttcgtttatcgttagttttatttttagtgaattttgtagcgggtagggtagcggtattattagttttagcgagttgttcgatagtttcggatagattatgttttttagtcggagtaagacgttatcgttggcgttcgcgttatagggttttttcgaggttatttagtttagtttgtagtgggagagttacgtgaagcgttttttggatatcgtcgattgtcgggagcgttgtcggttgttatttgagttggacgtaggtagcgtgcgttttatcgtggagaagttagacgagaatttttcgtgcgtttttagttttagcgcgttggttttgtacgagtattacgtgtagtaggacgtggagttgcggttgttgttttcggtttgtttcgagcgcggcgggggcgtcgggggcgtcggtttttattttgtagggtatcggcggcgggaggaggggtcggcgtttacgggttttcgttttcgcggcgtcgcggattaggagttggaattgttgcgggagtgtttgggagtcgtcgtgtttgttcggttgcgtaaggtggttttcgcgttggtgttaggtcgtcgcgtatttttcgtgttcgtttatatgttggtgttcgtttcggtttcggtttaggaggacgatttttgtattgatttcgcggagggtacgtcggttaatttttttagcgtcgtttcgtttagcgacgagacgttgtagggattttttagggattagttcgggggattagcgggtaggtaaagatttatcggtcgttttatttttgttagataggttatggggtatcggtataaggcgggaggcgtcggtcgtagcgcggagtagtttcggggcgcgggtaagaatagagtagggttggagttgtttttgggtcggttttcgagcgttttcgtagataaggacggtttaaagttcggtcggattcgcggggacggggcgttttagtcgttgtgttttacgacgtttattgaggaggtcgtgtattgtttttacggtaacgattcggacgaggagttttcggcggtcgcgtttacgttaatttatcggcgtatatcggttatttttcgcgtttttacgcgggagcgttcgtagggtcggaaggaggtttttgtttcgtttaaggttgtattagttgtttcgtcgttcgttcggatttagtttagttttattgttgacgagatttcgttttgttattttttgagttttttcgttagtttttttagcgagttcgagttttcggagtcgtcggtcgtttatttacgaggtcgggagttcgcggttattaaggattcgggtttaggaggcggacgcgatagttcgtttagttcgcgggtcgcggaggagtttttgtagcggtgtattagttcggttttgtttaggcgtcggtttttcgtgtttggtttgcggcgtcgtaagtttcgagttattcggttggatgagcggttcgtagaggggtttcgggaacgcggcgaggaggtagcgggttcggatcgggttttcgatttggatagcgtggagtggcgcgttatttaggagggcgttaatttaattgttacgtggttgtattaggtagtagttgttacgcgggaggtttcgttcgagttcgattttattttgtttttcgtattcgggttgttagtgggatttattttatagttttttaagtataggaagggacgataggcggagggagaaatgggtagtgttcggcggttagagaaaaggggcgtagttttagttaagattagcgggagttttcgtttttttgtaggtttcgagaagttacgtggtatatagaagattacgttcggggtgttagttgtgtttcggggacgaatagtgatttacgtttttagttcggtatttcgtgtttagtttaaagggattttcggttttcgcgttatatcgcggaaggtggcgtttttttgtttggtatagttcgcggttttagttaaagtttcgagtttcgggtagtagcggtcgcggagtttatatcggtttgttaagatttcggagttggcgacgttgagttagttttttagaagcgttatatcgttcgttcgtttcgttaagatttttttttttagttttttttagatttcgttcgttttttagtttttgtttagaaagcgtttttcggttatttaggttgttggggttttgttcggtttcggagttttttcggtgtttaaaacgtcggcgcgtatttttttggcgaagtagtataagacgtagagatcgttcgtgcggatttcgtttatgtagaggtcggttcggcgtgggtcgttatcgttggttcgggtagtttcggagtcgggttttaggggtcgggcggggatcgaggcgggttcgggggcgcgcgggggtcgtttgggtttggtgcgtgtggttttagttttttttagcggtagcgagtttttcgatcgttcgggttttcggcgatagttaatttttattaaggagtcgtcgggtttgcggcgtcgtcgtttcgagttgttttcggtcgagttcgcggtttttgttttttagggcgtttcgtttcgtcgcggtcggttcgcgttgttcgtcgtttttttttgtttttcgcgttgcgaagagtttcgagcggtatttcggtagggttcggtttcggttcggtagcggtttttcgcggttcgatttagttttggcgagcgttttgttcggtgtattattttcgagagttcgtttcgtttgtttgtgcgcgcgttcgtcgttcggtcggagattgttaagcgttacgcgtcgttgtcgtatattagcgtggttcgtaggttcgacggcgtcgttttcgcggtttttgttttagtcgacgtcgcgcgtcgtagtagcgacggggagtttcggtcgttttttagggtggtcgcgtcgggtacgatttggcggcgtattcgagatgaggacgtgttttatattttgcgtagtacgtttttcgttacggttttgttattgcggggttttacgttcgaggacgtttcggtcgggttttcgtcgcgtaagattagcgacgtcgtggtttagatcgaggaggtcgtcgtttttaagattaattttagtacgttttcgagtttggagattagggagtttttcggggttttcgtcggcggttagtttttttttttcggtagcgacgtggacggttttagtttcgttaaggtttttattttcgtatttttcgtgtacgagggtttgggggtcgtcgtggggggttttttcgttagtcggtacggtttttttagtcgttcggttcgagtatttttttttaattatgtgtttagttttatggtggtcgtagttattatcgattcggtcgcggagaaagtttcggttattgttttcgttatttttttggaatagtggtttaggtcggttttttggaacgttttttttcggttttgcggcgcggtttggttgttttatgggtttgcgttgtagacgttttttataggtcgttttagggtttttgtttattcgagttttattatttttagaattttcgtttagcgtacggcgatttcgcgttttatcggaagattttgtttttgtgtcgcggaggtttaggaggaaacggggcggtcgttaggttttaagtttcgatcgtggagcgttggtaagggcgttttggtttagttttgagcgcgcggttttttttttgtcggaagtcgttgtttgatttcgggcgagggaggcggtagttttcgggttcgggtttgggtttgggttcgttgtttcgtagggatagcgttggggaggtgacggcgttcgtcgtaggtggggcgaggttgggggagggcggcgtcgcggcgggtttgttagttgggggtttttgcggcgcgtaggggcgaagtttgtaattattgtagtcgtcggtaattcgttaatgagggttttgtagggattgtttttatttttagttttagttgtgggagtgcgggtgggggtgtggtcgagtttcggtaggaagtttcgtttagacggtgtttagggaattcggagtttaagcgtttcggcggagtttaaaagggtgggggtgggaggggtagaggttaacggatttttttgtttgtcgtattttttggcgggagacgggaaggtagcgggttgcgtacgatgggattttggtgtagacgtcgggtcggttgatatttggattttattttagaggagatgttggttattagttggggcgattttaagggtcgttggagttagtatcggttcggcgtagtcgcggcgggcgaggttaatggaaaggagattgaggggagtttcggtagtgagttcgaggttttgggatttggagttcgcgttggtttttttttagcggagtttgtacgttacggagattattatatgtgggcgtggttagtgtttaggatcgtatcg

SEQ ID NO: 6357 - DNA, 3400 bp, synthetic construct
  misc_feature 1..3400: note = Description of Artificial Sequence: Synthetic polynucleotide
  source 1..3400: mol_type = other DNA
gcgtagaattagtggcgatgggaggaaggggatcggtagagcggggttgggtaagtttttatttagtcgggttgagttttggttttcgtagagtttttgtttttttcgagatattcgttatttggtgttagcggtggatcgttttgcgggggtttggcgcggtttcgggttggttttgattttgtagtttcgcggagagggtaggttcgcgtggagagggacggggagtcgggtcgattgttttcgggtttttagtttttgagttagtcgcgtgtttatttatcgtagattttcggttgagtatcgttcggttgtaggtattgttgttcggcgacgattatcgttgttttatacggatgatttcggttttgtttttgttgtcgcggttcgagttcgcgtcgttgtttgcgtacggttagttggatatcgtgtttttttcgtcgtttaggtgcgcgtaggtatcgggatacggggtaggagcgggcgggggcggcgtggtttcgtggtcgtttttaatttttttaattgcgggttttaggttattcgcggaattcgaggagtcgttatttagcgtagatttttttttggagacgtttacgcgtttggtgcgggcgttgcgggttttttcggttcgggttttcgcgtcgcgtttggttttggattcggacgcgttggtcggtttttcgtagggtttagttaatttgtcggatttcgcggcgttggagcgtttattcgacggcgaggagtcgttgttgttgttgttgaggtttattgcggttattatcggggattttgcgtttttgtacgattttacgtcggcgtcgtgggttacggttttggcgcgtcgcgtggttgttgaattgtaagcggcggttgtcgagttgcgaagtttttcgggtttgttttcggttatagtttcgttgttggcgcgtttgttcgcgttttgtttaggtggtttcggcggtttcggcgattttttgcgagcgttgttgtttttgaaggcgttgtagggtttgcgcgtggagtggcgcgggcgggattcgcgcgggtcgggtcgggtatagcgtagcgcgggggttatcgtcgtcgacgggtcgtgcgcgttgcgcgagtttagcgtagattttcgcgtcgagcgtttcgtatttattttcgagatttattaggttaataattgttagggcgtgtgcggttggttttagttcgatcgtaattcgcgttacggtaattacgtggtgttgttgttgaagatgtaggttcgtggggtcgttttggcgcgtttattttgttgcgtgtttatcgtttacgcgggtaagttgtttattagtttgtcggaggagcgtattagcgcgtattacgtgtttaatatggtggttatcgagtgtggttgtcggtgatttttgcgtcgcgcggatttttgtttcgagggttcggacgcgttttagttcgcgtttttttttatatttattcggattttaagtatcgttttaataaagattagtaagtaatcggttggggtgttcgtgcgtgttagggggttcgtgggattttttttgtcgttttttttcgcgtacggttcgggttcgttttgtagcgttcgttgttttttttttgtttgaagcgttttattatcgttttttaggtttcggatttggtgtcgggtttaggcgtaaaggagtaggtgattttgcggtcgtagtattcgttttatttcgttagagtcgcggggcgtttagaaggggtttttggatttcggcgcggggtcggtttagtttcgttttttgtttgcgcggagtttttggcgatttttaggtcgttgtttttcgtcgggacgtttcggggatatttaggtttgtttttttttgggttcggcgtttttggagtttcgtgtttacggtcggtggtttttttcgcgtgatttttagcgttggggtagggtttttcggggttttttggcggttcgtggtttttttttttttcgcggttttttttttttaggtttttttttttttcgcggttttttttttcgcggtttttttttttttcgaggtttttttttgggttttcggtttgcgagggttatacggttttttcggacggttttttcggtggtttcgtcgggttttttttcgtcgttttttgtagtttttcgattttcgggaattttgggtttgatttttgtttcggttcggggcgtaggcggcgttgatggaggcgtttgggtttcgaatttaggttgtaagatagagtggggttttggggtaagcgtttatttttttttcggttcgggttttttttttttttggggatgaaggttttaatgttcgcggttagtggaaggaagtttttattaggggcgacgatggttttttcggggttgagtttggcgggatttagggttcgggtatacgtgtttggagtgttgtttttttagggacggcgtttgtagcgatagggtcgggattcgagttagttgggtcgaggtacggtttatattgtttattttttttttatttttagagtttttttttttggatagttggagtggggttttttcggtacggttgagattaaggatgttttcgagtcgtgggaagggatttcgggatttcgttgtcgcggcgtttttttttcgaatttcgtttttttaattggttattttttttttcgattacgggttgtaggaggtttttagtaagggaggggtcgtaggagtgttttcggggggcgtttacgagttgagcggtttttagagagggcgtaggggaaaggcggtagaacgttacgaggtaggaggggttgtataaggtttattcggaagttagaatttattcgcggcgaggggaatgggtttcgtaaaaggtttatatcgggtgagaggggcgcgtaaggttcgttatttaaggggagatgtataaattaattttgggggcgtgtaagatttagttttggagaggaggtttttagattttattttggcggtatagcgtttttttttggaggaataggcgtataggtggattttagtttcgttttatttttggggagtttgcgtttatcgcggtatagttggaaagtcgagtttagtagcgttattagcgaggcgagtattaggtatttgttgagcgataggtttttttagggtagtttttcgtttagggtcgggggcggcggcggcggttgtaggggcggcgcggtttgcgtttttttgcgcgcggggacgtttcgagggtttgcgggggtaagtgcgcgttgcgttgtggttattggttttgtgtcgttttttttttcgggcgtaggggataagagataggtttgtgttttgaattcggttttttttgtttgtttgtgcggtttcgggcgtaggtgaatttagtttcgggtgtttcgtagttgtacg

SEQ ID NO: 6358 - DNA, 1143 bp, synthetic construct
  misc_feature 1..1143: note = Description of Artificial Sequence: Synthetic polynucleotide
  source 1..1143: mol_type = other DNA
tcgatcgttagtggttgggaagtgggcggtgttggggggtgagtttcggtttttttaagatgcgttttttatgaaattttttagttttacgtgtatttatacgtatacggatgtatgtatacgtatagaaatatatagggttcggatatagttgcgcgtagataagtaaaggattacgtttacgtggaaataggtgtgcgtatacgttttcgcgtattcgcgcgtataagcgttttatatttgggaacgtgcgtatttgtttttcgttttcggtatatatatagtcgttttatattggaatatttgggcgttagcgtcgggttattcgggtacgtagggcgttacgtagggtcgcgtatacgtttttcggttatacgcgtatagttttttacgtggacgcgcgggtatatacgttcggggttcgtagtcgcgtatattcgtatttaggaaattttagttattattacgcggggttcgatcgtttttgagtatttttcgttttagtcgcgtattcgttgcgcgttcgggacgcgtatattcgcgtatatatcggttttttttgcgtacgtttcgggtttattttcgtttagagttttcggggtttttttttatttcggtttcggggtttttttacgttttttcgtcgacgtgtttatttgtttagggggcgttttcgagtcgcgtttcgcgttcgtttttaggagggttttcgcgagtcggttgtatatttcgaggcggtttcggttgtataatttggagcgagttgtttcgtttttttattttgggggcgaagaagggtcggggagtgggggaaagcgggaggcgtcgcggtttgggaggttttcgcgggttttagcgtcggtcgtattgcggtttttttcgcgcgtcgtcgtcgtcgtcggttttttttcgtttcgttttcgcggttttcggcgtttttcgcgcgtttcgggcggggtttcggggcgtacgcgggttttacgtttggttttgatttggttttgtcgggcgtgtattttttatttattttgggaagcggggtttttggagcgtggaacgggcgtcgttagtgcgcgcggcggggatcgggggtgagggagagtgagttgttcgttcggggagataagtaaggcgttaagttcg

SEQ ID NO: 6359 - DNA, 220 bp, synthetic construct
  misc_feature 1..220: note = Description of Artificial Sequence: Synthetic polynucleotide
  source 1..220: mol_type = other DNA
acgtgtcggtgacgtttcgtggagttggcgagtttcgtttgtttcgcgattgagtttgcggtcgtttcgattttttagtagattttggcgtggggtatttgagattttcgttattgaaaaggcgttatagaaatgtaaggaattatgattttaataaaattgttttatttaggagcgagtttttgcgttgtttttgtcgtcggagttcgggtttgttacg

SEQ ID NO: 6360 - DNA, 1860 bp, synthetic construct
  misc_feature 1..1860: note = Description of Artificial Sequence: Synthetic polynucleotide
  source 1..1860: mol_type = other DNA
tcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggaggtggacgatcgggcgtttaagtacgaattttttcgtcgaggtacggttgtcgggtttcgttttgagggtttggggcggcgaggatcgtcggggaggagggcgcgcgagtcggaggttagagtcgggtcgggtagggcgcgtttaggagtaggggagacggcgattcgggtcgaggcgggacggggatacgttatttgttcgtggagcgcggggaaggggtgcgcggcggcggcggcggcggagtttggcgtagagggtagcggtagtagcgggagtatcggttcgttcggggtcggttagtcggggagatcggggagtagcggggtcgcgggcggcggggtcgaggcgagtagtatcgggggaattacgattttcgcgttgagtcggagtagttcggtcgagttcggtattatttagatttagggcggcggcggcggcggttttgcgtttatcggttagaggagaggttgtcgtcgtcggggttgttgttgttgtagttgtcgtcgtcgtcgttggaatttggcgttcgtttgtattttatattttcgcgttgacggcggcggcgggggcggcgggcgttcgagatgttgggtcggcggcggcgcggtttcggagcgaatttatttggtttcgcggcgcggtcgttcgtttcgtttttgtttcgcgcgggaagtttttttttttttcgttcgcgtcgtcgtcgttttcggattcggttttcgtttcggttttcgttcgttcgcgttttttttcgtcggatttcgtttcgttttcgcgtttttcggttttggtcggggtttttttttcgttgcgtttttggattcgggcggtcgcggaggacgtgggtgggagagggtcgagggcgcgttcggttgggttttcgtcgatgtcggttttttggtggtttttggttttttgggatttagcgtatcgcgagggaggtttcgggtttcgtatttaagggtaagcggaagtcgaggtggcggcgtcggagttaggtatgtttcgttgtttagcgcggggttgagggcgtagacggggatcgcgcgagtcgttttttatttggttttttcggagtttagggcgcggagggtattgggttgcggattcggcgtaggcggtttcggacgttgttaggcgcgggcggatttttgttgtataaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttttgtgaattcgttttggatgtttttaggtatagtttgtattttttttttttttagtatacgcggtttttgacgttgtacgtcgagttttttgggatttaggacgaatcgggttttaaggattttcgtttcgttcggattatacgtaggtagcgtcggtcgagtcgagtttgggttcgtattggttacgcgtagttatcgttagacggcgttagttttttttcgttgtagattttgtttcggaggtcgttagttttttttttatttcgggtttatagttttagtgtagtttttggcgacgcgcgttgatagttgggtagagattttcgtgcg

SEQ ID NO: 6361 - DNA, 441 bp, synthetic construct
  misc_feature 1..441: note = Description of Artificial Sequence: Synthetic polynucleotide
  source 1..441: mol_type = other DNA
gcggggttttaaacgttatttaatcggggatattgggcggggggtcgtttaattaggttcgtagttggagtagatagggcggttttcgggatttggcgcggtttttgtttttcgttgtcgtcgaagttttaattttcgtttgtttgttttgtgttttttgtacgtagaagtttagtttgtgtggttttgcgatttgcgggtattgggagatttatagttaagacgttagggttttttggaagtttagaaatggtgagagtgtcggttcgatatttcgagagagggaacggggttggttggaatcggtgggaagcggttgtggcgggatttaggttttttcgtagttagttttataatttgcgtttagagtttttgtttagttcggttttagttttttttagttatacgatggcggtcgcgttgatagtcggggtttcggcg

SEQ ID NO: 6362 - DNA, 5587 bp, synthetic construct
  misc_feature 1..5587: note = Description of Artificial Sequence: Synthetic polynucleotide
  source 1..5587: mol_type = other DNA
gcggtgttttcgggaggttggtagtcggggaagtaggtacgtgaatttatcgggttgttttattttaatttgaggttagagttgaggcgtaggggtcggggtaggggtagaggtgtcgaaacgtattagttggggattttcgggggaaggagataggagagatttaaggcgagttttaggattcgtttttatgattatgattacgcgttgcgttcgaattatatgtttatttcgtatttgttttcggggattagatcgcgtttttttagatggttggggagggagtagatttcgggtgaaggttgggggaggtatcgggatgtcgagtacgttagagtaggcgggggatgggtttcggttttttgtcgtttcggtatttcgttttgtatcgggtaaagaaggggttacgatcggcgaagagcgcgtggagatatagggattcgcgatttaggggtaggaatttcgttttttttcggaaatttttcgggttttgagtcgtgttcggcgttttttattttattttattttcgtcgtttttgtcgttatttacggtcgttgcgggttggttagcgtgtgcgtttttcgcgtcgtaggtatttgttcgttgggcgttgtgcgtttatttttttttcgcgtattgtagattttcggcgttgtcgtcgttatttagcgtagttttcggttgggtatagcgtttcgtttttttcgcggtttcgggcgtttatttattcgttatggtttaggtttgggttaaatagcggggtagttggttgtttaaattggggtaaggagttgagggttgggagttgtagagaggatcgagggatatacggggagtagggatgagcggtcgtttcgagtcgtgtagattgggaagaagttagggagagtttgggtgggaggatttttaatttaagcgggtgcggggcggggttgtattttaattagaaagacggtggttttttcgagcgattttcgaggagagagggggagcgttttggggcgggggcggggcgggttgtggtaggagaggggagggcgggggcgatgtagcggtggaggcggtttggcgtttagttattgatcgttttttttttttttttttttttttttttttttcgttttttttcggtttcgggttcgttacgtcggattcgtttttttcgcgttgcgttgggtcggacgttaggtttgcgcgtcgcggttgagcgtttattcgttttgcggaaagagtcgcggaggaatcggcgggggcggttgcgggagtcgaaggaggtggtaatcgggagtagaattagaaggagatagggaggtagaagttcgcggtttcgtggtacgtattttttcggttagggatgggtttcggcgcggtttagtttttgttcggttcgtcgggtagagattgaatcgcggatttttatcgttttgtggacgatcggatagagagaggtattgatcgatcgttagtagtttttcggtgggatcgcgttttttgtatatttcgcgtagcgtttttcgtcggagtcgtatcgggtaagtcggcgagggagcggggttgattggcggtcgtcggcggttaggggagggggcgtcgcgcggggttatggtaggttcggaggcgttttagttcgagtcggagtcgattcgagtttacgcggtcgtcgttttttcgttttcgggttttcgtcgttatcgcgtttttcgcgggagatggaatagcggaatcggttcggtgttttcggatatttgtcgtttttgttgttgtatgttttgttgtttttcgtggtcgacggtgagcgcgggaattttgttgtcgttgtggattcgggggggtttttgttggggtcgttatcgagaagaagaagaaagagaacgaatcgggaagtttcgcggtttttagtaatttcgttgtgtagtttgggttcggaggggtagggagaggcgagcggcgaagggtcgtcgtagtagtagcgtcgcgttcgagtcgtttttagtttcgtcggggtttcggttgcggaaaggatgtttgcggggagcgggagtaggcgcgttttagttaggttttggcggtgcggttaggggcgggggagaagtacgagtcgtttttgtcgtttcgttttattcggagggaagtagtaggtagtcgatggtcggtttttgtttcggttttgtagtcgttttttcgaattttgttagttttttcggtcgtgcgttagggagtagttgcggggtggggggtataaggttagttagttagagatcgattgtttcgttttaggttgttttaggttttcgatttatagttggttacgtttttttttttttttttatttttagttgtatttatagaagtttttaaagatgtgatagtacgggagggagacgatatcgaaatgttttgcgcgtttcgggttagcggagttatttcgtattcgttggagatttagtggtggtattttaaggagttatttcgggagttgttgtacgagttggcgtttagcgtgtcgggcgttcggagtaaggtaattcgtcgtttacgcggtatcggcgcgcgttcggttcgcgttcggggcggcgaaggttaatttagggagggaagtagcgggttttattcgcgtagggcgtcgttttgtggcgtagtttattttttattttcgtattttaaagtatttttaaagttagtagtggttatttttaaatttgttaattattttgatagtatcgttgtttttattattttttagaattttatttacgtttagtttttaaagagttatattttagtttggtcgtttgttcgtgttcgttggttgcggttttttgatgggtgttgggtagtgaaggaagtttttttggttttattaggtttttttcgttttttgttattttgaggattttagggtttttacggttgcgttttagaggttattagaaaatcgagtatcggaaagtcggtaggatttttagtttttaggggtatagaggggttatttttttgtggtcgaaaataggtttacgttgtttgtttgttttaaaatttatatttttttatatattttagtgtgttcgcgtgtatatatatttatatatatatttatatttatatatatttatatttttttagggttttatttagagttatttttattgagtttttcgttgggtgttgtttagatatagcggttttttttttagttttttacggtttttagtgagttgggggaggattttgagttacgcggtagggtttaaggatgtttagagggaaggagaggggtttttttttttattttggtgtttatttagtttttttagtttagtcggtaggtgtgtattagggtagttattcgttggttaggtattatgttagttttaaagttcgtttttttttgggaaatttttggaaagtcggacgttttttgtgtttttaatttttatttttcgggcggtttcggttttagtttgtcggaggagggtgtttttgtttaaaggcggattcgagtttttttagttagaaggtcgcgagttttacgtttttttttttttttttgtattttaggtaataaataaggatgtaattaaaattagcgtaagtgtggagtttagcgcgggtcgcgggagattttttttggtcgtttcgggtttcgtagtttttttttttagtaagtcgcggcggtcgcgtatgtggggtcgcgtaagtagggtagcgatcgtagttttgtatcggtggttgttcggcgtgttcgggcgttatttgtcgtcggttgtagggtcgggtttttttttgtgtaaattaagggtttaaggtttgagttttttaattcggttcggcgttgatttgtaaaattttttttggtcggattgcgcgtttagggtttttcgcgtttgttagttttcgttttgcgggtattttttttagtatcgggagcgcgcggttgttcgttttcgtcgcgatcgtggcgttagtttttcgttttttttgtttcgttttgagtatttgttttgcgtttttcgttgtaattttttatttttcgtttggattgcgggtttgggtgcggggtgttgtaggtttgtaggggacggggtagggggtggttgtgttaggttgcgaggggttcgggttatggggttgttaattttgggaggagatgcgtttaagttttttatttggagcgtagaaaggtttggagatgacgaagttttttcgtgggttcggtttagaggtgagggttttttgggtgtttgttgagagtcgtagagtagtatttttcgaagtttttatcggggcgtaggggaggagtatttcgttggggggtttttggagatttcgcggaaaggcgggttggtagtaggtggttagggagttaggtagtagttttagcgttgtttgtttttttaagaaagtatagtgttagttgtaaagggcggggttcggtgatagggtggttttttttaggaagcgattcgggtaggtttttcgtgtttcgggaggtgaggagggtcggttggggcgggattgtcggttggagcgcgtcggggcgggaaagacgtggggaagttaaggaataaggaatttagtttggggttttttgaaggtgtaggagggaggaaggagaggtggattttgtttttttgaagcgttagttacgggaagataagtagtgttggtttgtatgggcggggtagatgtaaggtgggcgtttggttaacgtgatggggacgtggggatatagtttaaagagttggttgtttggcgtttacgtagagttggaagttttatgttattgggtagacgcgggtgaaagggaagtcggatcgtgatggtgggtaaattaggattcgggaagtgttggggtgcgcggatgagggggcgcgacggttagggtggttagaagagtaggtttgggagttgtttagttcggtttttaattttgtttttttgtagatcgtacgcgtttagggtaatgatattttatatcggtttcggttgtttgtcgtgcggttgtaggacgagggcgtgtacgagtgtcgcgtgtcggattatagcgacgacgatacgtaggagtataaggtttaggcgatgttgcgcgtgttttcgcgtttcgcgtcgtttaatatgtaggtcgtcgaggtcgtgttttatatttagagtagcggttcgcgtcgttacggtttagttagcgtcgttaacgttaataacgcgggcgtcgcgagtcgtattattttcgagttcggtcgcggcgataagagttcgtcgttcgggagttttttcgtcgttatcgatttcgtagttttcgaggtcgcggtagtttcggcggtttatacgtttattattatagtcgcggtagttgttgttgtttcgttagcgtcgtcgttatcgggataggcggttttgttgcgttagaggtacggttcgggtaagggatcgcggagagggggcgtacgcgcggggatggcgtagggttagggttgcgtcgggacgtttcggggggtttcggatttaggattcgttttttgggcgtatttgtatatgtatatttttttttagttaggtcgggagcgttttttttagggtttttttttcgcg

SEQ ID NO: 6363 - DNA, 3643 bp, synthetic construct
  misc_feature 1..3643: note = Description of Artificial Sequence: Synthetic polynucleotide
  source 1..3643: mol_type = other DNA
acggggcgattttgaaaagaggttgatgaaaatcgagttcgttttgtttcggttgggttgggaatagttcgtagggttttgtcgagtgggcgagtgaggcgcgcgagtagggcgttcgtttttttttagtttcggaaaatgattaagttaatcgtgtgggtatgttttattatttattgaatataattttttataacgtttcgtttacgtgttcgagtttgtttttgacgttcgcgttttaatgtttaaggtaaggaaaataaaggtgggggggggattgcggggcgcggcgcggtgcggggggcgcggcgcgggggggcggcggcgggtgggggggtagtttcggcgttcgggaggtggtaaagtgagtttggatttttggcgcggttttttcgttttttttttttttttatttcggcgaggtttgtcgttcggttttttttcgttttatcgcgattaaaaaatacggtttaattaaatattcgtggttgtgacgttggcgagagaagttgttagcgggtggggggtggggggaaagaagaggaaaatcgagtcggcggttgcggtcgggtatcgtatggcgttagagaatttcggcggcgagcgggatttgcgtttgggtcgtcgttttttcgttcgcggtttcgggatcgttattttgaaaaggagtttcgaggtttggcgttcggcgcgcgatcgggatttcgcgtttagtttcggggattcggtcggcgttttttattcgcgagcggttcgcgagttatttttaggtttcgggaaatttttaagagggtttggggggtggggggagtaaaaaggggagggggtaggttggggtcgcggaaatttttgtttaagtgattttttttatttttttttttgtttgggacgggggttcgttttgcgttttttttttggttcgcgtttattgcggggtttcggttttttcgttcgtggagagagggtaatttgtaatttttttttttttttaattaaagttagttgatgtttataatgtgttaaatttgcgggcgtcgagagtcgttgagatttgttattttgtgattgtatcggttttttgtgtttcgggagtttggttaggttgaggtcggagagttggttttagggttgaggtgttagggttcgaattcgcgattttaggaaaggtcgtggcgtttgtaagcgtaggcggcgttcgtagtatttgttttagtcgggtttcggtttgggggtttagtcgggggttaaagaggaaataaataaataaataagtaataggttatggagggaaaagagtcggttagttttaggttggagaaatgaggttaattagagcgaggaagtgcgggcgtgggggttttggaaggtagaggagaggtagggtttgcgcggcgtttgggaagagtgtaatttggggggacgtttttcgtttttttagcgtagatgtatgattggggtaggaatgatttttgttgataagtttttttttgtttgttttaagatattatttttcgaagatgaattgaggaaaatagtcgtaggcgagattcggggtgtattttaggtaaaaaaaaaaaagttagggttgggggagagtttttttttgatgagtaggaaagtgtttagatttcgacgcgtttatttgttgtagttttgtaaataatttaaaatatagatatttttatatagacggatgtatgtgaagtggaggaaggtcgaaacgcggggaagttagggaaaaagaaagaaaaagggttgggtagagagagatttgtgttgtttattttttattttgcggagtgaatttcggtagggttttttttggggataggtggaaagttaagtttttttttttttatttttgtattgtgagtggtttttattgtgtgtttgttggagaatatgtttatcgttttcgagttaggtggaggattggaatgttggggggcggggagcgttggagttgaggacgtagtggttaggggttgggggtcgagaaagagtagggcggggttttagtttcgcgtgcgggtggtagcggcggtcgggttttgtttgttagatattgttatgtttaacgggtgtttcgtcggagacgtgatttgttagtcgttttcgtttttattttagtagaaaatacggtagttgcgaggtgtttcggtttgcggggttcgggtattcggtgcgttttgggggttgggtcgtgtgcgcgggtgggagtcggcggtcggcggggtcggggcgaggggcgagcgggaggggcggagtgagcgagcgcgcggtacggtttttcggttttttttgcgttttttttcggtagtcgtcgtcgtcgtcgtcgtcgttgtgtaatttagtagaaattcgataggggtcgcgtttgttgagcgtattcggcggtcgggtagttcgagcgggtcgtcgggtttggtcggtcggtgtagaggcgcggagggggtcggcggaggggatcggcggggatgggcgcgggaagtacgtttgattagagtacgcgtcgttttttaattttggtgttttcggcgagttgggtagtttcgcgcgttttgattttgacgttttagtttttagttagggtttaggtgaatttggggtggggtgtgcgtgcgtgcgtgtgtatgtgcgtgcgtgtgtgtgtgtggaaggggtggtgagattgggaacgcgttgtttttttttttagtttgatattagtaattggatttttattttaagatcggttttgttttttgttggggttgggagggggggcgatttttttttattatttatatttttgtttattgtttattgagtggaaggtaggcgatttaaagagacgaaagagaggaaaaaggggtgagagacggagagaggaaaaagaggggggcggttagaagagggaaggagaggcgtggggatagggttttcgttttcgtcggggtcgggtttgatggtgaaatagtaaatttacgtacggagggtcgttaggaaagtggatattatcgttttaattaatttcgagatgtttcggcggcgggatttggcgtagtcgtgacgcgtttttataaatttgttcggttcggggttgtttcgagaattcgtatagtagcggcgttagatttatttcgcgttttttagttcggagtttatttgtataattggattttttttttttgtttttttttttttttttgaaatttgtttgaaaatttaagtgaaaatcgcgacgatttgtatatttaaaagtaagtgttaagtaagtgttttgcggtggtttcggcgcgtttcggggtgagcgcgtaaagtcgggagcgaggtgtcgcgagttgcgcgtcgtttcgggtcggtttcgcgtgtgggcggttgggcggttgggcggcgggaggacggttttcgcgggtttcgggattgttcggttggttgttcgtataattttttttttttttttcgtttgttgatttttcgggttaggtgaagtgtttgggttacgcgtgtatttgtggcgagattcgggaggcgattttggggggcgcgcggtcgtagttgggtattttgtttgggtcgggggcgggtagtcggttttagtggtcgtcgttgagggtagagttgcgagcgagcggggtcggttgttggtcgcgtcgcgtcg

SEQ ID NO: 6364 - DNA, 808 bp, synthetic construct
  misc_feature 1..808: note = Description of Artificial Sequence: Synthetic polynucleotide
  source 1..808: mol_type = other DNA
tcgggggagttgcgaggttatttttagtcggcgttcgggcggattgcgagttttcgcgggttcggtcgggggagcggagattggtttttcgttcgggttggggcgtttgtcgttcgcgagtcggaagagcgttttatttacgagtaggtagttttggtagagggttaattgaggattattgttgttggttttaggaggagcgaagcgtttggagatcgggcgcgcgggcgcggttttgggagcgggggaaggtgaggggaaatgggatatgatggtattaataatcgttattaaagacggtgggagtaataaaggaatgcgttttcgagacgtcgtttagtttcggggtgttttttggcgcggtcgcggtgtaggaacgcgagtttcgtcgtcgagtttttcgtcgtttgcgttcgttggcgcggcgttcggcggtagtgttatttcgaggtcgagcgttgttttcgtcggttcgcggttgttagtcggttttgttcgcgttcgggtttcgcgagcggtcgtattttattttacggaggggagataatgagattaattagaggcgtcgttatcgcgtcggagatagttgtcgtcgtatagtaattattcgcgggttgggtgcgcgggggtttttcgttatttgcgcgtttgttgtttttattacgcggtatcgattcgggcgcgttttcggtttttgttcgtagtttatagttatatcgcgtattttatattttttttgcgtttttgttggggagtttattttttttattcgtatagtgcgttgcggttcggggtgtgggaggtttcg

SEQ ID NO: 6365 - DNA, 3415 bp, synthetic construct
  misc_feature 1..3415: note = Description of Artificial Sequence: Synthetic polynucleotide
  source 1..3415: mol_type = other DNA
tcgaggggatcggttcgtttattcgttcgcgttttttggttcggcggatattaggtagtttttcggcggtcggtcgttcggaggacgcggaagatgtttcggggaatttaggtgatttcgttcgttatttatagaaagagttaggtcggggttgttttttattttttttgtagtcggagagttgaggaggtagggatttggcgcggtttagcgcgtttcgcgagcggttttttaaatgggtgcgagagggaagagggtagagcgcggcggggcgttcggggggcgttcggtattcgaggcgggcgtacgtatttaaataggagagcggcgttcggagttatttagtgcgggtagaagagcggggcgaggagcggggtcgcgttcgttggaggcgcggggcgagtggaggaagaggaggaggagagtagaaggaaggggaagcggttcgtatttgttgcgcgtcggggcgtttgttgtttttttttcggtatgatgttttttcggcgattgttattgtcgtcgtcgtcgtcgttgtcgggttgaggatagggagggagggggcggcgggttcgcgggggggcgaggcgggtttgtttttagtttttttttcggagagcggtcgttcgtaggatgttgttgcgtttaggtttttcgcgtttttttcgcgtcgcgtttcgtcgcgaatttcgaacgtgcggagggaagaaggagggcgggcgagggaggttcggggagggaggagtacgggggggaggaggaggtagaggaggaggaggtggaggaggaggaggaggatcgcgttgtcggcggaatgggaagtttgataaatcgttttagaggttagaggaggagggggcggggaggagcggcggttttgttttttttcgtttcgtttttagacgaggtgcgcggggttcggggttggggggcggggagagggcgggtagagcggtgggaggaggagcgcgggagcggttcggatcggtattgtttcggttttcgtttttaggtcgggggttacggtattcggggggacgcgtagtcgtcgtcgcggttcggggttcggcggtttagttttttgttcgtggcgcggttggagcggcggcgtcggtaataggtaagtttaaaggaaaaggagatgatcgtgttaatcgttcgttcgcgggggcgtcgcgttttcgttttcggttttaggttcgcgtgggattttcgtttcgttagcgaaaggggtgtcgttttttcgttttcgtttcgtgcgtatacgcgggggcgcggcgttagtttcgtcgagttcgtttcggggcgttcgttattttttatttttatttttatttagcgttcgtttttagttattttttagttgttttattcggttcgtatttttttttattcgtcgatttcggagtttttagcgtggttttcgggtcggggttggcgtttttcggggaagttagagtttacgggtaggttttttttagggaggaggcgggcgcgggtcggggcgggtgggggtagtttttagatttcgcgttatttagttttttttttaggattcgtcgtagttattttttttaatttttttttttcggataaatttttttgggttcgtttcgggggtcggtgtgggagggggtttttttaagtttttttttttgattttgggatgattagggtttttttatttcgtttttcgttttcgggagtcgggtcgcgttttttatttacggcgcgggtcgattttagggcgggacgggggcgggagaaggaaatcgggtttttttgtttatttttcgttaggggtttttttcgagagtttagggggtcgtcgcgtcgtgtttcgcgttcggtttgtcggggttgttggattagagggattgattattgattggtgatcggggtcgttgaggtttcgggtcggttcggtcgattggtcgcggtaagaaggagttggttgggcggcgtgggcggcggggcgacgcgggtttatttacgggcggcggtgagggcgcgggtgggtcggagtttatgcgggcgattttcgggcggcggcggttgagcgggagtcggagttcgagcggcgcgggcggcggcgtatcgatgcgttgcgggttcgattgcgtttttttgggttagtttttaggtcgggaatggggcggtcgcgtcggggtcggtttcgggcgttgtcgggcggcggttgttggagcgcgggggcggttttcgggtttattattttcgaggcggttttgcgttcgggcgcgtcggttggggttttggcgttttcgtaggtttcgaggtcgatagtttcggcgagggcgggcgtttcgcgttttagtatcggttgtttgagcgtttttggagtagtaaattttagatttttttttttttttttttttttttttttttttttttttttatttttttttttttttagtttttttttttttttttttttgttttgtgttttttttattttttttttacgattgtttttgtaagtttgttttaaaagtttatagtatgttttttttttttttagatcgggagatagtgattttatttatacggtaagattaaaagttttcgttcgtttagtttgcgggtttgggttgggtttagacgttttttaggatgtagatgcgtcgtcgttggttttttcggttataaagtcgtttttagcgttttttcgcgcgtaggagcgttcggagttgtggggtacggattttaggcggggtagggagttcgaggcgggttgcggcggggttttcgggttggcggattcgggggttgaggcgtcgtgcgcgttgggtgttcgcggtcgtagaggttagaatcgttatttttttaggtcggggagacgcggtcgtggagcgtgaaacgttttttgtaagcgaggaaacggtgagttggtcgatatcgtcggcggttttattattttggtggtcgcgttgagtttttgtcgtttggaggcgggttgcgtcgtacggggttagttttcgtcggtttttagtttattttcgaagtttttatttaggcgcgttcggtgcggcgtgtgtatagcgcggggcgtcgtatacggaagcgtgtagttttttttggtcgcgtttttttttttttttttattttttcgttgtttttgtaaatttttgttttttcggtttttttttattgcgggtcgcggtttgaattcgggttttcgcgtagtcggtcgtcgtcgttgggtcgttgtttggttttttttcgtttaggcgtcgagcgttgtgcgattcgttttaatatttgttcgtttaattattggcgtatttattagtgttaatgggttgtatattgtagcgatagttcgttacgtataatacgggttatgcggagtgtacgtagtaattatattgttatgtcgggatacgtaaaaaggttttcg

SEQ ID NO: 6366 - DNA, 3415 bp, synthetic construct; identical to SEQ ID NO: 6365
  misc_feature 1..3415: note = Description of Artificial Sequence: Synthetic polynucleotide
  source 1..3415: mol_type = other DNA

SEQ ID NO: 6367 - DNA, 1592 bp, synthetic construct
  misc_feature 1..1592: note = Description of Artificial Sequence: Synthetic polynucleotide
  source 1..1592: mol_type = other DNA
gcgaagcgatttagcgcgaggattagtttttaattaattcgtttttagttttgggcgttttttttagtagttagatgggggttttagaggtcggtgcgcggttatatggtttcgggttaggtagggggtcgtggggacgtatttgcgttaggcgtatagtatttttgggcgcgggacgggcgaagcgtcgtgggttttaagttgagttgggtcggttttgtagcgtcggagagtaaggcggcgtagggaagggagatggggcgggatgtggggaaagttgtcgattgtttggattttttcggttcggatggcgttagttgtttttagtttagtttgcggaaattcgagttttttttagcggttcgacggttcgggcgtttcgtagattttgggtttttttcgcggtgttttcgtcgttcgtttttgcgttttggttcggtttttacgttttttcgaggtttcggcgtagcgcggtcgtcgttattttttttatattttagaggtcgtagcgtcgttttttttttcgtatttttgttttcgtaaaggagttttttcgtttcgcgcgaggtcgcggcgaggagggggcgcggttcggcgtttgggagtttatattttttcgtcgcgcgcgtcgtcgagtagggcgtcgcgtttttcggttcgcgcgtggtcgtcggaacgatttcggttcggcgtcggtttcgtttcgtttcgcgtttaggggtttcggggcgggtttcgggtttcgggcggacgatgcggcggttcggtcggagcggcggcgggaagcggaggcggaggtgacgcgttagggtcggcgggtcgggttatgtagcgttttagggcgggcgcggacgaggcggttttatttttggtcgggttggttttgcgggagttggagttcgggtgcggttttttcggtcgggggcggcgggggtcgcggtttgggtttggagacgaggcggcgttcgcgttgggtcgtagagggaagggtagcggcggtttcgaggtcggggcggacggattgagtcgcggggagcggggttttcggcgcgcggcggtttcggagtttagcgcgtagtttgcgggtagtttacgggttagtttggcggggttcgacggcggcggcggtggcggtagcgttcgatttagcggtattagtttgggttacgattagcgttacggtagttcgcgtttcggtcgttcggattcgcgtttcggtttcgggtcgttttcggtgggtagcgttcgttttagcgtttttagtttcggttttcggggttcggtcggcgtttacgttgattttttttcgttcggcgtttgtttcgcgttcgttcgtttttcggagtttgcggggtcggtttttttttcgttgtttgtattttcgttgttttttggtcgggagggcggtttaagcgcggtcgagcggcggttggaggcgtttattcgggagttggagcgggcgttcgaggcgcgtacggcgcgggattatttcggtgagttcgttcggttcggtagttttttgcgcgtatggttggggttcggggtttcgagattgtttcgggtaggcggtcggattagcggaggagagtacg

SEQ ID NO: 6368 - DNA, 903 bp, synthetic construct
  misc_feature 1..903: note = Description of Artificial Sequence: Synthetic polynucleotide
  source 1..903: mol_type = other DNA
gcgattttagaattcgttttttatttcgagttcgtttttcgtcgttttttcgtttttgggagggcggttttattaattttcgcgattcgggtcgtttttggcggttttgatttcgttatttcgtttcgcggcgggggtttgggggtgaggggcgcgttttggggtagaggattgcgcggtagggtttgttatagggtagaggttagggtttttcgggaaaaaggtaggcgtatatatgtttttttttttgggaaaagacggggaggggggttttttttgggagattttaggtttcgaaatttttcgttttttatttttcggttttcgtattttttttttttttcgttacgtatttttttttttttttagttatttgttttatttcgtagcgtcgcgataaatacggttttagttcgttttcgtttttgtttagttttttttttaagtttcggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgaggatttcggatatagagtgtagagatttcggtaagtttattgaaagttagtcgaattcg

SEQ ID NO: 6369 - DNA, 1592 bp, synthetic construct; identical to SEQ ID NO: 6367
  misc_feature 1..1592: note = Description of Artificial Sequence: Synthetic polynucleotide
  source 1..1592: mol_type = other DNA

SEQ ID NO: 6370 - DNA, 382 bp, synthetic construct
  misc_feature 1..382: note = Description of Artificial Sequence: Synthetic polynucleotide
  source 1..382: mol_type = other DNA
acggattgttcgtttagtaatatttgattacgttttttattggttatcgttttcggaagttcgttttttcgttttcggaattttcgtaggcgttgggtttgtagatggcgtttaggtatatagtggcgagtgtgatttcgtagttttgggttgtttggttaagcgttcgtcggatatggtacgtcgaagggttatcggcgtggagttttcgtttttagcgttcgcggttgggaaatcggttatcgttacggcgggaattgggattcgggttgcgtttcggtttttttatatcggtttatcgtattcgtgggcgttcgtattggtgttgatataattttttgatttttgattcgtattgtttcgcgattaaaggtaaaaaacg

SEQ ID NO: 6371 - DNA, 665 bp, synthetic construct
  misc_feature 1..665: note = Description of Artificial Sequence: Synthetic polynucleotide
  source 1..665: mol_type = other DNA
gcgtttttacgaaattcgtttacggatacgatttcggggttatatttagttagacgaatgtttggtaaatgatagttattttacgttagatttttatagttttttatacgttatttttattgttttagggaattataagtataggtatcgtttcgttcggcgtttttttttaaagattggggtattaggatcgcgggtttttatttttatttagtataaagagttcggcgtttagagttagcggtttttcgaggatttattattaagttcgcggatataggtttcgattttatatttaacgttgttaaagtggtagagtcggcgcgggttgggatagaggcggtattgaggtcggcgttgtcggtggttgagagcgttataagtttcggttcgttatattaggggcgacgttttttagaggttttcgcggtttattcgggcgggattggttttattgtttgcgcgttttgagaagtagattacggtgttttagggtttatagtttcgcgtaggggagtttagtttaggttttgtacgagcggtttttcgcgagtttagttttgagagattgggagcgtaatttggtgttgagaagaatcgaatcgtttcgttgttttttgcgtcgaattatattttttagaggttttcgcggttttattttttcg

SEQ ID NO: 6372 - DNA, 764 bp, synthetic construct
  misc_feature 1..764: note = Description of Artificial Sequence: Synthetic polynucleotide
  source 1..764: mol_type = other DNA
acgcgttattagcgcgtttttacgtataaattttttttttgcggttaatttgcgatttttaatttttcgttttggttgttaagggaggcgcgtagagcgtttgtgtttgcgtatttttatattagttcgtgtagtgtgacgttgggtttcgtttttgtgatcgggttaggttcggagttgtagggaattcggattttcgggttttttggaaggtcggggagaggttagtgtgggaggatttggtggggaggaggtcgtgttataaattttgcgcggagttgtatcgttgttgttagatattgcgacgtcgcgattttttttatttcggattacgttttttagcggatttcgcgggagttgggtcggcggtttttttgtgtttttcgggggcggaggtagttgaggcgttttttttcgggttcgtaagggttgggttttatttaattaagggtagcggtgagattcgagtgtagatttttcgagttttcggggtaggaaggagattttttattagttttgttttgtaggtcgggagtgggttgaggagtggcgtgtgggttttcggaagttcgtcgtaggttatttgtgtgatttcggtgcgagtggaggttggtatcgtttagtgcgaggttgttatttcgtgtgtttgtttacgttttgtgtgattgggtgcgaggaagttaatggtatcgtggaatgtgaggttgtgagttgaggcgggagcgggcgattgttcgttgtattttgttgggtcgatattcgcg

SEQ ID NO: 6373 - DNA, 1394 bp, synthetic construct
  misc_feature 1..1394: note = Description of Artificial Sequence: Synthetic polynucleotide
  source 1..1394: mol_type = other DNA
tcgcgtttgggttcgtagtttcgggtacgttgtagtttcgtattcggttgtttacgttcgggattatttattgtgttttttcggaattgtttagcgtgtttttttagattttagatatttattttaaatttaggttttagcgttttgtaggggatttttattttggggcgtttatttttgattttttttttgggttttttcgttacggtcgagtttaagtggttgaagcgcggacgaggatgcgcggggtttcggtttttaattgtattataggtcgtatttacgaatttggttcggtatagttattatcgttcgggtttttaggttttagggttgtagaagtttagtttcgggaaaaaaagtatatcggtttgaggttttataggaattttttttttattttggttcggtttgtaaaatttggtttatttcgcgttttttttttttagaaaagtagcggttatagtggcgttcggtttttagttttagttttattcgatttagaggatagtttagttttgggagttagcggcgttagaatacgggagagcgtttgttttcgtcgcgaatgcgttagcgcgcgggggggcggaggtaagtttcgtagttgtttcgggtcgggaggggcgcgtggggtcgggtttcggcggggatagtcgggtcggggagacggagttagaggggtcgtagtgtttttcgttttaggtttttatttgtaatggtcgtttcgtgattgattagtgttattaaagataatttaggtttgtttttttgtggatattgcggtttaaaatttaaaaaaataatatttcgtttttttattttttatttggttttcggttcggagataggcggaggttgcgagtttcgtttcgtttttagcgacgttttatcggaatttttggaaatcggtttttgtttcgagtgcgtaagcgcgcggggggcgaacgttggggttttttagggagtaagggagaagtgtggggtcgtatttgtcgaggggtcgggaggtttggaggagggtggaggttggttataggatttcgatggggatggagtgtttaaatttaggtttgtagtcgtgattttggcgtgagttggatggaggaaattttagtatcgcgagtttggattaaggcgcggcgcgtgttgtttgtggtgtttgttgagtgacggtcgtcgcgttttcgcgtatttggatcgagtgtttggtcgttggcggagtagtgttttcgtgtacggggttgttgcgtgcgcgtgtgtcgttttttagcgggggattaggatggtgtcgtagagaaggttgcgcggtggtgtttgattttgacgttggttgtagcgggtttttggggtttttgcggtttgtgtttgcgtttgtgacgtatttgatatcg

SEQ ID NO: 6374 - DNA, 949 bp, synthetic construct
  misc_feature 1..949: note = Description of Artificial Sequence: Synthetic polynucleotide
  source 1..949: mol_type = other DNA
acgtcgtgtttcgttattttaaaaaagaaaagttattttcgttaggtttttttttttttttattttcgtgtgtgtttcgaggtcgagatgtagagagtaagaaaaaggagcgaaggggatttttgcgcgttttaagtatttattagcgtttacggtgtgagatgaaggcgtattttttgggcgcgaagtttttaaagtatttgtttagggagatatttttgaagttgttagggttttttttttgtttttttttagattcgggttttgtataaattttggagggttagcgggcgaggcggttatcgtagcggtcgttaacgagtagttgtacggaggtgtagaagaaggaggttattgttatttttttgataagttgggggcgtgggaggtttcgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacgagtagtcgttcgagggtagtcgtttgagtcggtagatagcggttagttggggtagcggttcgaattgttttcgtaatacgttttttagtatttcggtttgcggggtgtttaggagcgcgggcggcgcggcgcggggatttaggacgtcgggcgcggggtttatggtagggtcgaggtcgttgaggtcgggtttttatttgcgtattcggggtcgtacgaggtttgggcgggggcggggcgggggcgggagttggattatttgtaattatttttcggttgcgtattttaatttcggttttttttttggaggttgcgtttaggtatcgcgttgaataagtcgtataggtgtgattcgggagcgttggagcg

SEQ ID NO: 6375 - DNA, 1365 bp, synthetic construct
  misc_feature 1..1365: note = Description of Artificial Sequence: Synthetic polynucleotide
  source 1..1365: mol_type = other DNA
tcgcgcggttttaggtgaatttggtcgaggtttttgcgttaaggacggcgcgggttagttgaggttaagatcgtaggtattgttttatcgttttttagattatagtttcgtttttgtaaggtttcggggaaacgggtattttttttttagtgagtaaaggagaaagacggagttcggtggttgggtgtttcgtttaggattattagcgagtttagagttttttttacgatcgttttagggtgggtatttttaaaagcggaggaagggagggaatatattttttggtgttgtgtttattttgtttcgtatagagcgggcgtttataggttttgggggtttcgttcggatcgtagtggggagaggtcgttttatgtttcgtttcgttaaatttaagagttttcgtcgagcgttaggaggtttttagataatcggttttgttcgttgttttttgtagaatttttttatttttttcgagtttttttttttgcgttcgttcgggtaacggtcgcgttatgtttagttttaggtcgcgaggtagttcgttattcgttttttcgggttttcgggttcgattttcgcgttttggtcgtttttcggcgtttaggttttttattggttcgaatacgtttcgcgttttcggacgtttcgagttttttttttcggtcgaggttattttggcgaggttcgatttttgcgcgtcggcggttttttagtcgtcgggtttcgtttgcgtttattcggttttttggatcgttgtttttttgtgcgttatcgggggtttgttttgggtttgttcgatatcgtggttgttcgtttatttgagcgtaggtttttattttgtgttagggtcgcgcgtggttttcgtttgcggtttgttgggtttcggcgttataggtattgcggtttcggcgttcgtacgcgggggattgggcgggggttggagagtttaggtcgttattgtcggcgttttagtgtaggagagggtattgagtgtgagaattatatacggttggagtgggaaggggttttgttatcgtttattttgtagttgaagtcgaggatcgcgatagttttgttgaaaaagatttcggcgcgaggtttttttcgtacgttgttgaggtgggagagggtgggtgtgagggcggcgtagcgtttgaatgcggtgggtaggaggttagcgttggggttgtaaggggatttagttttgttttcggttttcgcgttttttgattttttcgtatatttcggggtagcgtttagtgatagagacgttttttaaagcggttttcgattcgaattaatggttttgttttttttttttacggggtagggggaagtggacgtttcgggcggtgttgttgagcg

SEQ ID NO: 6376 - DNA, 2638 bp, synthetic construct
  misc_feature 1..2638: note = Description of Artificial Sequence: Synthetic polynucleotide
  source 1..2638: mol_type = other DNA
tcgggggtcgcgttggaattttataggaaaaaggcgcggaaagtcgtcgggtatttttcggggttttatagatgtttttagtgttttagttcgtgtattagttcgcgtattcggagggattttaggtagggggagggtttcgcggttagtatgtgcgttcgaggttttttcgtagggggtagtgtcgttcgttcgcgcgtcgatacggtgggagggggtgggaatttgcgcggagttttggaggttttttgggagaaagttaggggatgcggaggggtgggcgtaagatttttaggattttagggaggtcgtggggagggtcgtcgagggtgtagtgtgaggcgtaggagggggttgggggcggtgtacgttgtagggagacgtagtttttggaagatgcgagtgtgaatgtgtgagtgtgagtgcgtgtgtatgtgtgtgtgtgcgcgcgtatcgtagtttttcgggtttcgcgaggcgcgcgggtgttagtttgtagtcggggttttttttttcggtttttttgtttagttcggcggtttttttttttttttttttcgttcgttttttttcggcgggttaggggttgggacgtttcggcggagtaggcggcggcggtggcgagttggggagttttaggttcggcgttgtcggaggggttcgagtcgagtcgtttgcgtttcggtcgggtagcgtcgggttcgtttttcgcggggttacgttttgttaaattttgttgcggcggttagcgtagcgggttcgtaagcgggcgggaggggcgtcgggtcgggtcgggtagggcgcgggcggttaggggtttcgagagcggcggtttcggttcgcggttttattatgttttagttcggcggcgggggcggcggcggcggcggcggtagcgggggaggcggcggttttagcgtcggggcggtcggcggaggggacgatttcggggcgaacgacgagttgatttttttttaggacgaggggggcgaggagtaggagtcgagtagcgatagcgtttcggcgtagcgggatttagacgaggttaagtcgtttttggttaacgagtcggagaattagagtagtagttcggattcggaggtaaggaagtatcgcggttattttcgggggatttcggttttgcgttcgtttattcgtttttgtttttgtgtttttttcgtaggcggagaggcgttcgtagttcgttcgggatattttttagaagtcgcgggattatttcgtcgaaggtatgtgttcgttgggatagttttttattttcgattttcgttgcgtttcgttgtttagttcgggcggtttatcgttttttttgtttgggtggacgtatttttgtttttcgtttttattggcggtagttttcgtggggcgcgcgtggggggcgttggggtttttagttttcgtttcgagttttttgtcgcggcgttgttagtttcgggggtttgggttttatttcgttttggttttgttcgtagtgagaaggttttaggatagcgcgttttttaaaggattttcgtattttgggtatttttttttgatgatttcggatttgagtagttcgtatttttttaacggatttttgtttttcggaggagcgcgtatcgtgagtgttcgtcgggcgcgtcggggagggtgggaggtcgcggttcgtaggatgcgttttcgggtttggttatggagtgggggatggggttttttgcgtcgattttaagtagaatttgtttgcggagttgaattattttttggcggtcgagcgcgaggttgcgttggttagtgtttggatgaaagtaaagttattttaatttttttttttttgcgggttgaggttttggagtttatttttgggattttttttggtttttagaatttttcgtttgtatcgaaggaaatttggatttgtgttcgttttgggggggtttcgtttttttttttggaaatcggttagttttttttggtagtggggtaaggggtttagggagttgggttggcgacgttgtttttcgatttcgggtttattgggcggttgtaggttggtttttaagaaatttagttttcgtggcgggttatttatagttttcgtttttatttttagttttcgtatcggggttttagtttttttgcggagttagtttcgaattttaaattcgcgtagatgatttcgaggcgatttaaggtattttttaagttgaggaatttggtttttttttttttttgtcgtttgttttttttatttaaagcgagcgttgcgatattttaaatttgttaatgggcgcgtattgtgtgttgttcgttggtatttagagcggtgattaagtaaattgatcgggttttagacgacgtgtaaatgagggcggattttttcgttttttttttttggttttaaattttcgtttttcgcgttgcgaggggcgtagttgggggttggcgaggtttttgtgttttttaagtcgttattttatttttaggttttttgtttaggtgttgggttcgatgatagatgttgggtgaacgtttatttattgtgtgttaggttttcgcgtgttgttgtttgggcgcgatgtgaatcgtagtagttttttgtttttcgtttagatttttattgtttgttatttcgttgtcgacg

SEQ ID NO: 6377 - DNA, 1531 bp, synthetic construct
  misc_feature 1..1531: note = Description of Artificial Sequence: Synthetic polynucleotide
  source 1..1531: mol_type = other DNA
tcgtatatcgatttttgcgtcggtttttgcgattcgcgttcgtttttttcggttgggaagtatttgttagcggtttttatttgggtcgttttcgtcgcggggtatttttttgaagtagtcgttgagcgataggttgtggcggatggagttttgttagtcggttttgttgcgttggtagaaggggaagttatcggcgacgaattggtagatgtggttgagagtgagtttgcgttcgggcgcgttttgaatggttatggcgatgagcgtcgaatacgagtagggcggtcgtattatttttattaggttttcgcggttggttatggatagttagtttagtttttcgggtttcgcgggcgcggcgggcgaggcgggcgcggcgggcgcgggttgcgcgaagggtcgttgagagtagtcgaagtgtcggcggtaggcggtggttgtagaaagggttcggtcgcggtttcggggggcggcggcggcggcggagcgtttaggtacgcggcggcggttgcggcggcggcggagggcgggttttttacgtcgggttcgttgagttataggtaggggttggcggcggcggtcggcggcgcggcgtagtcggttagttcgtaaggcgttttggttgtcgggggggcgttcggggcggcggcggtggcggcgggcgggggtaggtcgggttgcgaatatatttcgaagttgtcgtcgtagtagagggttatgtcggcggtcgtgggcggttgcggcgcggtcgcggcgaggggcgagcggggttggtttcgtcgttcgggcgagagtatttttttgggggttaattttgcggtttcgtttttattcgcgttgggcgttcggtgtttcgggtcggggtcgggcgggtgttagcggagcgtttgttagtcggttttttataatcgagttcggcgcggttttttttgggtcggttcggagcggggcggtggtcgcgggtttgggttttttacgttttcgttacgttttatttgttcgcgcgtttaaattcggagttcgttcgtttcgtttttatcgtttttttgttcgggttcgggagcgtttgggaggtcggcgtttttaggtttcgggtaaaaagtagtattttatttttagtttacgttttttaatattataataagtaaagttacgaatattaaagagaagataattcgaatagtacgaatgatttttaaaaagttaatttggggtggtcgttcgggttatttgtttagttatttttttggtttttttatttttttttttttaattttttgtgatcgagtcgcggaatttacgtttagttttaatcgatcggtttttagtcgaaaataatcgatgtgatttataacgttttggggtatacggtagaggttattaataggttcgtttggcgtgttttttttttttcggggattttgtgattggaggaacggaaattagtgttgagtttttttaattaaattgtaggttcgtttatattcgggaagtatttattcgttttttgtgcggtttgtacgggttttcg

SEQ ID NO: 6378 - DNA, 2045 bp, synthetic construct
  misc_feature 1..2045: note = Description of Artificial Sequence: Synthetic polynucleotide
  source 1..2045: mol_type = other DNA
gcgaaacggtagaggtcggtagttcgcggtttacgtgtatttgtttagggaatcgttttagcgaaatttgattcggatcggaattttttcgtagtatagcggtcgtgtttatcggaatggaacgttataagttgttatttgtattttttttttagttttgatagggaatacgcgttgtttttacgtttatatcgatattcggatttttatttagttcggttagagttttaggggttagggattagtgtagggagaaggttttttattttagtttttaggatttttaattatagtttattcgtttttattttgttcggttttaggtttagtcgaatttatatgttttcgtagtgtcgagcgttattatttatagtcgttttttaaattgtgatttttatttgggagattcggaattatttaggattttggtgtggggggtagtattttttatatttgtttttcgaaaattgttatggagtagtcgcgtttcggcgggtaggtgagggggtcgagtttattagcgtcgtagtttcgttgtttattttttttagcgtcggttgtcgttttcgggtagatatcgtcggttttgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagcgtttcggttgtttttttagagttttttgttggggggatatcgtttttatgaagaaaatttttaaataaattttagtttaggaggaggttatacgattatgttcgcgggttgtcggtcggaggggcgaggacgcgcgggcggaggcgcggttgtcgtgtttaggtagggagtcgagtttcgggtgttcgtcgcgcgtttttcgtcggggttatgtattttcgtttgcgttcgatatcgcgggttggaggcgagtgtagcggcgatagttcgttagcgtcgcggttcgtttcgtttcgggttcgtttttttcgtttcgggcgttttgcgtcggggttcgttttcgtagttttttttagtttttttttagtttgggtttttttagtttcgttttagtttgtggcgcgtttggcgggcgtttttttatatatgttagtatatcggttatcggttgattttttcggtttgtgatttcgcgtgggtgtagttcgtaggagtttatcggtttgtgttacgtacgggggtttttagtgtacggatacgcgtttttttcgttatttgtttatttttattagattttattttttttcgcgtcgtgttcgcggcggaaggcgtttttgtagcgcgtgtattcgcggagcggtggcgattttagtttgagtagaggagttgtagtgatttttgtttcgtttttagcggattgcggagggaattttttattttattttattggggatagggtggtacgtcgtagagtgtcgtagttgtataaatttggaagtttatagtatcgtttgattttttgtgtaatttcgaacgttagtttgttcgggtaattttgagtgggtttttgtagtcggttatgttagcggtttttgtatatttgtattcgcggttttcgttgtttgtaggttgtagagacgggggtattttaaacgtgaaagagtaatgaaggaaaatgtagatagagcgaggacgtcg

SEQ ID NO: 6379 - DNA, 476 bp, synthetic construct
  misc_feature 1..476: note = Description of Artificial Sequence: Synthetic polynucleotide
  source 1..476: mol_type = other DNA
tcggttcgcgcgggaggagtgtgatttaggtgtcgttttttttcgtcgtcgagggttaggagttcgggagcgcgattttttttcggttcggtttggttcggtttggttagttttcgcggtttttgttcgggttgacgtttaggaatgtggtcgacgagaagttttaatagtacggcgtggttttttagtttcggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcgtttcgagttggagaagtcgttagttcgtttttttagggcgtgtcgttcg

SEQ ID NO: 6380 - DNA, 455 bp, synthetic construct
  misc_feature 1..455: note = Description of Artificial Sequence: Synthetic polynucleotide
  source 1..455: mol_type = other DNA
acgcgggcggcgttcggggtttgcgggtaggtaggcggtttggtcgcggaggttttttcgagttttgcgtttttttagagagggaggggtttatatcggttggtatagttattacgggtatcgaaatttggggacgtgttcgattatgtttttttcggtggttcgggggttatttcgtattgtttagaagtttcgtttttcgttttttttttttggtttagtttattattttttcggtgattttgggtatgttacgtttattttttaggttttagtttttttatttgtgttgtgaggagtggaaggaacgggatgattaggagttttttaagatcgagtattcgaggtttttttcggtttcgcggagttaggaggtgttagtcgagatgcgcgtgtcgcgcgcgttttttagtgttcggttttcgtttttgtacggttttcgttgggtaagggcg

SEQ ID NO: 6381 - DNA, 749 bp, synthetic construct
  misc_feature 1..749: note = Description of Artificial Sequence: Synthetic polynucleotide
  source 1..749: mol_type = other DNA
tcgggcggcgcgtttaggtgtaggttcgttttgcggaggagggcgggggtcgggtaagtagagggcgtttagttcgggggcgtcggtttgggttgggcgtttagagtttatttcggcgcgcgggtcgcgggcgcgtggggtagtggtttttttagtcgggaagttgttgtttacgtttcggtggttgttgcggtttcgttagggttgtatcggggtttcgcgtagacgttttttcgcgatttgttgtagtttaggcggtggcggtggcggtagtagcggcggcggtggaggtggcgcgggcgatagttcggttcggcgcggtttttgaattgtttaatttttgttcgcgtcgggtttaagcgttcggtcgttgttttcgcgttgagcgtttgcgtatcgggtttcgtttaggtgaggggcgtgtgttcggagttcgttgggcgtgttcggttcggttcggtttcgtcgtacgttcgtttttttggtttggttgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcggtttttagttcgggggttcgggttttcg

SEQ ID NO: 6382 - DNA, 1134 bp, synthetic construct
  misc_feature 1..1134: note = Description of Artificial Sequence: Synthetic polynucleotide
  source 1..1134: mol_type = other DNA
tcgaaaaatacgttttaggcgtcgggattttagatatttgggaaatagagtgtacgtagttgttgagaggtttcgcgtttggttttttttattattgaggcgtagaggtgttgtggatagtttagatttatacggcgttcgaggtgaaatagaatttttagtttttttatgaggttattggtattttcggttgtttttagagtttttcgatttagagttgaatgtaaagtaagcgttcgaaatgtagaagtagtcggggtcgtttacggtatttgtttcgttcggggcgagagaagacgttaggttgaggttttagcgattttaggtattagtttcgaaggagggcggggagatcgtaaaggggaagtgttcggagggttaacggttttcgcgtattttgcgtttttttgaagcgcgtcgttttttcgcgtcggggattgggatttgtttttggggaattcgtttagaagacggcggcggattggggtcgggtattttttagggttgttaggttttttttagttttgtatttgtcgcgtcgttttatttcgttaggaagttttagagatttcggggatggggtgggagcgtttttttatcgcgggtttaaaaagaaggaaggacgtttttaggggtcgtagaaggaggattagttttaagttataatttttttcggatttaaggtaggtcggttggggtttcgcgtttatacggtttttggcgggggttcgcgcgtttcgggagtttcgcggttcggggaggaaagaggagataagagataggcgaggattacggggttgatttagtcggggtagggattatcgtggaaaaattttggcgaggtggggggacgcggaaagagagcggttcgcgttttgtattttgcgtcgggtatttcgcgttagtgtttcgtttttagtgtttcgcgtttcgcgtttcgcgttttgtttttatttcgggttagttgtatcgcgttcgcgtcgtaggaatcgtggagttggaaagtgggggcgtcgcggttggggggttgttttagttgcgtttcggttagcgatcggcgggtcgggtttaaatttagttaggttgggtaggcggtggtcgcgcgattggggatcgggcgtttcgtttttttcg

SEQ ID NO: 6383 - DNA, 1645 bp, synthetic construct
  misc_feature 1..1645: note = Description of Artificial Sequence: Synthetic polynucleotide
  source 1..1645: mol_type = other DNA
tcgcgtatcgaattcgagttaggtttggttttagggtagatttaattatttatttcgatcgagttttcgaggtcggcgttttagtttttatgtttatttttcggagacgtttcgtggagattttggcgtttaaaattgcgggagtttatttattgcgtttaggtggttagtttttgagttttttttattcgtggttttttgtcggtatgtaggtatgtataagtatatcgtcgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcgcgcggtgaaatattttaagtatcgcgcggaataattgggtttagtttttttatttcggattttttttaggattatacgttattttttattttcgaatttaggggtttttttacgttgcgtttatttgttttgtttcgtaatgattattttagtttggtggcggtggaatttgagttatagaggtcggttgtataggtagacgtgggtacggaagttagaatttggaatttttaggttttttagtttttcgtaagatttcgtcgttgcggttttagggtacggttcgtagagcggagttttttggttgtattgataggtgttcgggtcgtcgttttcgtcgttgttatcgttcgcgttattgttcgtatcggtttttgggtcgaattgcgttttttcgggtgggtatatagtcgcggggaagtcgtcggggggtagtatggagtcgtaggggtagcgcgtttcgttaggagtcgggtatataggttcgtggggcgttttagtcgtcgtttggtacgggaagagtgagtagggcgtagttagtttcgatttttgaggatcgggggattggaggtagtatcgttcggagtttaggttgtttatggagtagcgtgtagtggtcgtagtcgcggcggcggcggcggcggcggttgtagcggcggagggtagtttttttttttcgtagggggagtttttgcggtcgttcgggggtttcggtttggttattgtcgtagcgttggtaaatgcgttttcggcgtcggtgttattaagtatggtcgcgggggtttttgcgttggcggttgcgggtttttcgtttatcgtttcgtaggagagattgtcggaaaattttttggacgttttgtttaagtttaatttttgaggagagggggtcgcgttggggaggtggttagcgttttcgtcgttgtcgtttcgcgtattttttagcgggtagaagtgcgcgttaggtaggtttattgagtttattaagagttgtttttttaattgtatgttttgtaaagcgtagacggtagttggttgttttttttttttcggtggttttattataaaggtaggatgggggagttagcgttttttttcgaggggaaggtaattttttttttttttcgcgtcggggttatttatttgtcgattcgcgggtcgttattgcgcgtattggcgcgttttgaatttagcgtttttttcggaaggaaagcgtcg

SEQ ID NO: 6384 - DNA, 4698 bp, synthetic construct
  misc_feature 1..4698: note = Description of Artificial Sequence: Synthetic polynucleotide
  source 1..4698: mol_type = other DNA
gcgtttcgggaacgttttttcgttgtattttataggaggtcgtgggcggtggtttaatagttttagtgtagagtttgaattttatcgtttagaaggaaaggtgagtgggggattcgggcgggaggtgaggtttgtcggtagcggtttttaggcgtgttgggtagtacggttagtagaggcggcgtttggttttggatgttgtagcggagacgttaaggagattgaatgtagggagcgaggcgtagcggtcgcggagggtggggtcgttcggaaatttaggcggcgttagttttgtagtatttgtaggtcgggggcgcgtatacgaggggtacgtgggtgtggaggaatcggcgcggcggggttttttttttgtagcgtcgcggcggtcgagtgttcgtgttggaggaacggcgagtggggtgtttgtttcgcgtaggcggtattcgtcgttttagtttcgtatatagtaggtacggttagggatcgggatcgtggtttagcgtttggaggcgttttttacgcgtatttttttcgatgtcggggcgggaagtcgagtggttttgttcggagatgttaggggatgtgggtaggggacgaagaggttttttaattggttaaattttggtttgaggaaagattgaggtggttattgattcgtgggagcgttttggggtttcgagggaacggtagtcgagttcgggagattggtgttgggtattcgcgggggtcggcgggttttacgtgggtggatttcgagttgagggtagggtagggtcgcggatcgttgatttatgagtttttttattttcgtataaggatatttgtatatggattcgggtttttattcgtttttggttgggttggcgtcgggagcgcgtaggggagggacggcggcggagtgcggggtttggcgggtgaggtgggtgaggtgtggtcgcgggggagggggcgaaggtattagaaggttgcggtcgcgttgtcgttgttgtttttatcgtcggcgcggggcgcggagggggcgaagaggtgtttgttagtcgtattgcggtttaggggtgaaaggaaaagggtttatgtaaaggagaaagggtaggtagagatttttgttggtgttagtaggtacggaaggatgtggtcgcggggatttggagtttagagggtaacgttgggtgttataatgtcggagatgatttcgggtgtagaggcgattttagttgggtagagttatagagaacgtggttcgagaaggggagtttttttaaattagatatattttgtgttgttttaaatttagtatttatttttttttatttcgtttttataatttttagggttttagcggagttatttaagcgtttagtattattagttttattttaggtaaaaattaagattaattttgtattttattaattttttcgtatttaagttattacggggtagttttttatagttttaaggcgtggttattttaagtttatagcgagttgttcgtgttttcggtttttgtttcgtaaatttcggacgatgttatcggaggacgttgaaggtaaaggttggtggggttaggcgtcggcgagattgtcgcgttagtatagttttcgcgggagtcgagtgttgacgggtttcgcgattttttttcgagggtaaacggttcggttttttagggatatttggttagtgttattttttttttatcgggtgtcgcgtatttttttaatagaacgtgatttcgtagacggatgaattcggaatcggtaaaattcgtttgtttttgtttagtttttttgttttattatattattgttttttattgcggattgcgtcgtgtgcgtttcgggatcgtttttgtatttttgtttatagttttttattattaaggtagtcggaggaagattttttcgagttatttgttttacgttagtagttatatcgaggcggtttttttcgtattattttttaagtgtagagtttttgaaagttcgaggtttttgtgttacgtatttttttttttgcggggcgatttcgcgtatgcgtgtgtgtgttacgcgtttaatcgtatagagtaatttttagacgtgtaagataaagtattttaagtaaagatggtttagagtttaaattggaaagtatatttcgaggcgttgaatttgttttcgtcgtttgtttcggtttttggggcgtcgtatttaggagaagggttttaattttttgttagattcgttcggaattagtttttttggcggtgtagtaataagtggtttcgtcgttttttttgtgtattcggagggattatatttttttttttttttagtttttagtttaaacgggagtaggtaatggcggggaaagggggaggtgacgagagcggggagaaggaagtatatattttttaattgtgaaattgtttgtttgcgtgttgtgttttgggatttttttgttttaattaattttaattttaacgtggtcgtaacgttaagattaagatttagaaatgaaaacgtatttattttttttattataaaggtcgtttgttgttgttgtttttttaaaatattaagtaattttttttttttttttttacggatttatattttgtttatgagatttttttaattttggtggtttggagaaatgaggtgggggaggggaggattaagggtagtaagacgtttattacgaaaataagatatttattaatttaatagggtcgtttttttttatataagatgtttttttattttttattaatttataataggtaaattttgagtttttttaaagtttcgttatttagcgtttatgttcgaagttttacgaataaattttttttttaggtaaatttgtttaatttttgttttatgtttagcgaagtttaggtacgatgggttaaggatttttggtttttatattgtttgagttacgttttagttggaaaggttattttgggcgagggacgtgttgttcgattggtttaaataaggaaagaaagtggagtattaaagaattaagggtttttgtttttttttatttcgttattattattatcggttttcgggttttgttgagcgttgcggcggttttggttgaaaattgcgttttcgtttaaatcgagcgtaaaatttttttggatagaagtttgaaagaatttagtgtagaaatagattttttcgtttaatttggttttaattagtaattatataagtatatttatataattatttaagtggagagtagacgtttagatttacggtttttacgtgttgttggagttggcgtagacgcgtgtgcgggtatagcggcggacgtgatatcgtatttttttcgaatttttgttatttagggtggtgtcgttttaagagggggtcgtggggaggtggggtaataggttgcgtaatttatttgttttgggggagtttagggtttagagtagagcgtaatttcggggggttgtcgtatagttttatttttttatattagaagagtaatgttttttatggatgattaatagtcgggttttttttgattatgcggcgcgtttttgtcggtattatttagttgttttaatttgatttttattagtaacgtgtttttagaggttgcgagttggattcgtattacgataacggttttttttttttttattcggtcggttttttgggaaggatcggggattgtagttttcgcgacgttttttttttttgcgtagggagtaggtttgagtttttttacgtaatgatttgggagattttaggtatttcggggtttggtcggagggttttcgggttttggagttgggcggtgtttgtagtgtatcgtcgtgagtttttttcgggtataatgtgttggtgtgtagagaggaggaaaggaaaaaaaaaaaatttaatattatttttaagtggtattggtatttatgaagtggtagtggtttatattgagcgtgtttttgtttggaggtgtagggggcggttattgtagtcgaggggagggtattgcggttaagggtagggcgagaggatagttaaggtcggttggtcgcgtgggagtttttttttttcgggtttagcggtcggaattattagtattgcggttaaaggggttggtaggtttttttgtatttcgcgtgttttttcgttttttttgtgtttttcggtttttttaggaggaagatggggtgtttatcgcgaatggggcgcgtcgggtcgtttggtcgggcggttacgtgttttttttttttcgttattgcggcgggagttttaattagagcgcgttagggggtttttttcgggtaggaattattcggttcggcggcggagggtgggtcgtcgttatttgatcgttcgttttcgtttttcgcgagtaaggggcggtggtagcgtttgttcggttataaatggtttttttcgttcggttcgttcgttcgttcgggttcggcgcggattcgtttgggcgtgtttttttcgtcggttttaggcgttttatcgttttgttcggcgttagttcgcggttttagttatttttgagggcgcgtcgggtatttagcgcgtaggttcgtttacggaggtcgatacggaagtttggatcgtcgaggcgtgtggttcgtttatcggtaggtgagcgtgtatcgcgggcgtgggatgttgtggggatagtgcgggggacgtgtggggttttcggatgcgaacgcgagttcgtgcg

SEQ ID NO: 6385 - DNA, 462 bp, synthetic construct
  misc_feature 1..462: note = Description of Artificial Sequence: Synthetic polynucleotide
  source 1..462: mol_type = other DNA
tcgttgggattttgtgcgcggggtacgttagcgattataaacgtgttttaattttgttgagttaaagttttggtgttaggcgttgttttttttttgttcgttcgagtttcgtattttttggtttttttttagttggtgttgtgtttagttttttttgggtaatttatttaggaattcgttgcggttatttttcgttttttttttaatttgggtcgagtaataagtggagttagaattaattttatgggcgagaggagtacggaggcgagtggagcgcgttgtcgttagaggttgttaaggaggcggggtggttagcgcggggggtggaggatgggggtaggacgcgggagggaagggtagggggtggggggcgaggtttcggggattagcgcgcgagagtgtttagttgggaaatgtagtttcgaattaatatcgtatgttttataattagtttacgagtcg

SEQ ID NO: 6386 - DNA, 300 bp, synthetic construct
  misc_feature 1..300: note = Description of Artificial Sequence: Synthetic polynucleotide
  source 1..300: mol_type = other DNA
tcgaattggtttgttcgtggcgggtttgtttaaagtataggggttttcgttttcggtgcgcgttgtttttaggattagtgttgttgggagataaagagttttagatattcgaggttgggagcgtcggagagtttttaggtttcgggtattttttcggagtacgtaagtatagttttaggtttttagggatagatgggttagagtcgtttgtatttgttcgtattttttgggaggttgcgatgatcgtagttagggtggtcgagcgttcggtttattgtattcggcggttgttttgtagcg

SEQ ID NO: 6387 - DNA, 554 bp, synthetic construct
  misc_feature 1..554: note = Description of Artificial Sequence: Synthetic polynucleotide
  source 1..554: mol_type = other DNA
tcgagatatttcgggcgcgagcggtagtgttgtttgtttgtttttttttttttttagtttttttttttcgtgatttatttattttttgtagttttcgttcgtattttttttaatatttcggtatttttgtattatttgttcgggtagtttcggcgggttttgggatttgttgtgcgcgtcgagaggaaggtaagttttaaatttttgtttggaagacgggttgtcgcggttgtattattagtaggaggaggaggagaagaaattatttcgcgatattttattttgcgggtgttttgtcgttgtcgtttttgttgtcgtcgattcgagttcgcgggttcgaatatcgtagcggtggggacggtgggttcggcgggcgtcgggaggaggatattagcggagttttgtattttcgtgtttcgtttattagtatttatttgttttttcgttttttttttagttttttagagaagggattatgatttggaaacgtagcgtcgtttttcgtttttatagtgtttgcgggtttttgttataaggtaattttcgtttcggcg

SEQ ID NO: 6388 - DNA, 1153 bp, synthetic construct
  misc_feature 1..1153: note = Description of Artificial Sequence: Synthetic polynucleotide
  source 1..1153: mol_type = other DNA
tcgtttttttcgtagagatcgttagttgaggttgtaatatttgtttcggtaaagcgttttcgtagttttttcggtttgttcgattcggtttttttcgtttttgtttcggttgcggtattattttttggagttacgtttcggcgagcgggggtcgcggagcgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggagacgtttcggtagtttttaatttgtgtgcgtcg

SEQ ID NO: 6389 - DNA, 1603 bp, synthetic construct
  misc_feature 1..1603: note = Description of Artificial Sequence: Synthetic polynucleotide
  source 1..1603: mol_type = other DNA
gcgatacggtttttttgacgcgtttttaattaaggcgttaagtttagtttgatagtattttttttttttttcggtttttggtttgatgagtcgtttttatttgcgagcggtgtaggtatttttgttgtcgattaattttttttagcgtcgaattggcggtattcgagtcgcggttgttaggtcgggagaaggttgggtttggtcgggttttgtagcgtttcgggtttcgtttttgttttgggcgttcgttttcgtcgcggggcgaggtggtggagatcgcggacgtcgagggtttttttagttagtacgtcgcgttgtttcggttttggggcgggggtcgcggagttttattaagtggttcgcgtttcggttttcgggagattcgagcgcggggagggagtgggtgtcgcgagggggcggttcgcgcggggagagtcgttagtttacggcgtttttgcgttgttgtggatgtggttacgcgttattcggtttttggattgttaggagagcgcggttcgacgttattacgtcgtggacgttcggggatttttgaattttagcgttaaggttgcgacgatgttcgtgatttttatcgcgaagttattttcgtaaggcgacgtaaggatttcggcgatttcgggcgtcgtatattcgttattttttagttttatgtaattttttttttgttgttttttttcggcgttttgtttttttataattggaagtcgcgaaggcggttattgcgttgagtcgttcgttttgttggttaagtttgggcgattcgcgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcggtcgaattatttttagtttcgttgagttatttcgttcgttcggtttttatcgtatcggttagaggaaagttttcgcggtttttacgtttttttatagttgtagcgttttttttgtttttggtttcgtaagtgtttatttgagtcgggagaggttttcgggtcgttttaattgttcgttttatttggtagttcgttttcgttttcgttttcgcggtgaggcgtttttcgttttttcgttttttttttttaaattatagttcgagttcgtttttgcgcgcgcgcgtttttttcggtttaagtgaatagttttcgcgtaagcgggatattgtggtggatgtaatttttttcgtttttagtcgcgaggagtttttcggcgtcgtaggtagcgttttttttcgaagtagttgtatttgtaattgggtagtttggattttcgtgttttgttttcgggatttcgcgtagggggcgtttcgggatattttttgcgggtcg

SEQ ID NO: 6390 - DNA, 1411 bp, synthetic construct
  misc_feature 1..1411: note = Description of Artificial Sequence: Synthetic polynucleotide
  source 1..1411: mol_type = other DNA
acgattagcgttttcggtgcgaggatggaaagaaattttagaaaaattttcgttagataattcggtagtatttggtttcggaatagagaggagagaaagatttgatcgtcgtatttagggttattcgtcgtattaagtttgagggttttttttgtttttaggtttttgtcgttcgagtttaggtttttttaggtgttttagggtcgggttgtattcgagtttcgaggaggttttgttagcgttagcgcggcggtgataatcgagggaggtgggtgagaggtgcggttgtcgaggtaaacgtagagtattcgtttagttttttaagggtcgagagtcgggagtttcgaacgtcgtttaagtagttttttgtttttcgtagttcgtttatatttttgcgggatttttggacgtttcgttcggggatttagggaggagggagagaggagggagggagtgggtagtttgggcgtacgttatcggttttcgtacgttcggtatttttcgtggcgcggcgagttaatgggatttgtatattcgaggtgtaatagtattattgtattaattattatttttattttacgtttagattgtttatttatttgcgggaaatatatgtcgggagaagtttatatttcggattttgtttcgttgtttaaggtgtaatttcggggaggcggcgaggggggaggggagggttttagattttttattatattttttagttttatttgtcgttgtaaattatgaggattttttattgagcggtatatggagattatatatttttttgaatatcgttttttaaagtttgtagatttttattttgaaatgaaataatttttcgttggttttttcggggataggcgttttttgcgttttttcgcgcggtttgggggatttttttcgtagagtaggcgcgtattttaatgtcgtggtcggcgtttagtggagattttttttatagggtttagaataatttttcgcggaatatttatttatatgtagtgtttgagaattaaggtagtttttttgttttgtttttttgcgtttagttttcggatttttgtgtcgtttgtagtttttttttatttcgaatattcgtatagacgcgagtttatttttgttttttttttacgttgggcggttttaaattcgtcgcgagggttgaggtgtttatatttgtttacggtagtttgtttcgtttttaagcgttttaaagttttttaagcgtttatattggttttgggatagtcgattttggtttttttgtttgtttgagggatcgcggaagtggcggggaatgtgttttcgtttgagatcgtttattgtgagtttttaacggaaattttgtacggaaggtaatcgttttttcgttcgcggtaagtaggatttattcgagtagcggggatcg

SEQ ID NO: 6391 - DNA, 2629 bp, synthetic construct
  misc_feature 1..2629: note = Description of Artificial Sequence: Synthetic polynucleotide
  source 1..2629: mol_type = other DNA
tcgtcggggttcggaggtgttcgaagcgacgggattgatagcggaggaaacgtagttttttttcgcgttcgttcgcggtgtaaatcgagtataggtcgtggagttaggttgtttcggttttcgttgggttttaattttcgtttcgtttagtgggtttcgcggtaagcggtttttgaatagttttaagagggttcgcggagtaaatatacgtattggttcgtttttttttcgggtagcgcggtttcgttattagttttgttcggcgcgtttagttatggattgtacggtagtcgggcggggaacgcggagagcgagcgtatcgatttgtgagagaaggttaagaggtttgcgttgtcgacgttcggtcgtattttcgtttcgggtttttttcgcggtgaatttgggtaggagacgttggggtttcggaaagagacgagtttagtagaaagcgcgtagagaggtagttttaggttaggggagtgtaaggttatagaggttagggaggtgagtataggaggatataaattgaggggataaagaggagcgataggagtttaggaaagcgaaaaagtatagagggattttgggcgttggttttagaggcgggtttagagggtgtgaggttaggttggcggcggcgtcgtcggttgcgatcggggtcggcgtcgcgcgtttttgtattttcgtattcgtttgtatcggtatgcggtgggtttttagagatcgaggcgcgaatgtagcgcgtcggttttgttgtcgtggttttagtaagagtaatgtattatggcgagttcgggttgtcgggtataagcgaattgtaggttcggcgtattggtgggcgcgggcgtcgggggcgcggcggtggttgggttggtagggttgagttggttcggcggcggcgcggcggtttcgtggtgcggtggggtaggcggcggtgcggcggtcgcgtgtagatggtgtgcgtgcggatgcgggtgggggtgcggcggaggcgggggtgcggtcggcgggttttttaggttattgtacgagtttattacgtcggggggtagcgttatgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaacgggaatttcgcgatgatgtattggtagatgtcggatagcgtgagtttttttttcgcgttttcgcggatcgttatggcgatgagcgttacgtacgagtacgggggtttttgcgtcgggttcggttttttcggggttgtttcgtcgttatttttatcgtttttgtttgggttcggcggcggtttttttggttttttgattgtgcgatcggtttttggggttagtagggttttcgtcgcgttttcgggttcggggtagttggttattatgataaagtcggcgcgtcgcggtcgggtcgtttttgtttttcgttttaggcgttggcgcggtaaagagttggggcgtacgagttcgtttacggttaagttttaaatttttggagattgcggatgtcgttcgcgtttgtttgttggaggtttgtcgttgttttttttttttttttttttttttttagggagcggtcggcgggagtggagtttagtttttggttatggggagttcgtttaatagagaggggtttcggtttcgtcgttttttttcgtttaggttagttttcgttttggtgggtttttttttttgcgtttttttttttttttcgtttttcggtttttcgaagtacgattcgcgtttttggcggagttgttttttggagtttttagtgcgttaggagtttcgttttgttttgattcgtatgggttttatcgagtttcgtttgcgttaggcgttttcgtttttatagcggggcggttagtcgcgtacgggcgagtttatttttaagttattttttgtaaacgtttcgtatagtttggatcggtttgttttcgtttagcgagttttaggggtttagtcgatagttaggtttacgcgtttttgaaatttgtcggtattcgttttgcgggttgggttgggagatgacgaggatttcggtggggtttgttcgtattcggttaaagtttaggaagttcgggttttagcgaggaaaggcgttttaagttttttcgcggtttttaggtgaaagaaaacgatttttttgttttgtcgtttgttgtcg

SEQ ID NO: 6392 - DNA, 1686 bp, synthetic construct
  misc_feature 1..1686: note = Description of Artificial Sequence: Synthetic polynucleotide
  source 1..1686: mol_type = other DNA
tcgcggttgtttttgtttttcggagatgacgcggagttttgttattgttatttaggtttaaggttatttattttgttcgataatttttagtattattaggcgttgttttagtgtgcgtttggcgttttttttagattagtcgacgtagaacgtttagagatttagttaagggtaagatttttagcgacgttcgttagtttttttcgtttagatattagtttaaagggtatggtaggttagggtttttcgcgttattttagatgatttttaggtttcgggtggttattttttgggggagttttttattttttgcggtagttttttcgagagtcggagtggaggcgcggggttggagggtttttcggagtcgtttattagggttttttgggggttcggtttcgattgggtagggggatttggatagggtttcggagcgtggagacggttgaggaaagttgggggtcggggttttggggcggggagcgcggaattcggcgtcgatgttcgcgtttatgaatatgtacgagttattttttttttttcgtgacgttacgggtcgtttcggggtgagcgtttgagtcgtttcgggttcgcgttagtgagcgcggttgttgtcggcgagttagcggcgtagcggcgggaattcgaggtcgagcgtcgcggcggtagcgttagaagcgtatttatcgggtacggcgaggcggtttacggtgcggtaggtatcgggaggcgagagtcggcgcggatagtaggcggcggttgtagttcgttggcggttgttgcgaggatgttgtttgggcggttgtgttgggtgtcgtttttgttggcgttgggcgtggggagcggtagcggcggtggcggggatagtcggtagcgtcgttttttcgcggttaaaggtgggtgttggggaagtttgttttttttttaggagggaggtagggtaggtttgagggtgaaagcggtaaggatttaggtttaagttggatttgtttatttttttttgtcgtagtttttttggtttttgtgcgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcgtagtgggtgagtttcgagttttggtttagggacggttagagtagggcgttggcgcgtcgtggggataagtaggtgtttgtttttgtttgggggaaggattagcggcggtgtttttaaggagggagtcgagttgtgatttgttttttagttcggggatggagtggaaatttgtaggttttagggaaggtttcgttgatattttttaagtttttttagggcgtttttgatttttcggggaacgtgtatttttcgggtaggcggcggggttcggaagaagcgcgggatgtgaggtttttcgttgttttttttatttcgttttgattatcgaggatcgaggagtttaatttggtattatttttttgtttattttgtttttttgaagagtttgattttttcgcgtttttcgttcggaaggaagttagatttaagcgaacgtttggttttgttaggcgagtttggaagtcggcgaatttcggattttgatagttgtttgggagcgtcg

SEQ ID NO: 6393 - DNA, 1686 bp, synthetic construct; identical to SEQ ID NO: 6392
  misc_feature 1..1686: note = Description of Artificial Sequence: Synthetic polynucleotide
  source 1..1686: mol_type = other DNA

SEQ ID NO: 6394 - DNA, 2132 bp, synthetic construct
  misc_feature 1..2132: note = Description of Artificial Sequence: Synthetic polynucleotide
  source 1..2132: mol_type = other DNA
tcgagaaagtgggtgcggtaggcggcgtttggaggaattggcgtaggtttttttttacgtagtatatttggtcgtagatgttgaggaaggtgaagatgtggaagagttggtggttgtggtcgataatgtcgaaaagattcggttggatgcgttcggggattttgtttacgttgaagaaggcggttattattagttagaagtagcggcggtagaagtgtacgaagagtgtggggttttttttacgtaggtcgaagagttagttttcgagtataatggggtaggttatgttgagcggtatgacgaagacgaaggtgcgtagcgcgaacgggtaggtatattagtcggtacggtttttgtagtaggttatagtgtaagttatcgttagtacgaaggttataggtagtattagggcgcggtaggcggcgataaggcgcgtgtagtttacgtgttagtttaggcgttgttgtaagtatggagttatgattttggtatttagtaagttgaggtttggtaataggtagtagtagtaggttatcgtgttgtcgaagtcgtagtagttgatggacgcgtagtttaggtagaagaaggcggcgcgtagacgtagcgataggtagttgaatacgtgcgtcgtgtagtttatggcgaaggttagtagtattttcgacgcgtagtattataacggtagtagttacgggtggtggaagggtacgtcgtcgtcgtttaggaagaatagacggtagaatttgtttaggaatagtagtagcgggatgaagtgcgtttagaagttgagcgtttcgttggtaggttttagtatcgaggttaggtatttttgggtcgtgtacggtagacgtcggtagttcgataggatgaagtattttacgaagtcgtcgggtatttcgttttagcgtagtagcggtttggtagacgttggggggtttcgggaggcggtagagtgggagtttcgggcggttttcgaagttgtcggggtcggggtcggagggttttttgtgttcgcgtttcggggttgtaggcgtcgcggtatggtgttcggggttcggttagggcgcgcgtaggcgatttttggcgtcggttttcgggcgttgggtagttttcgtcggtcgtcgtcggagtttttgtgtttacgtcgggggcgtcgttgtaggtttaggagaagattcgtgttttcgagtagtcgtttttaaaaattaaataaattaataagagaattaattaataggtagcgttgcgatcgttaggagcgcggagcgcgcgaggtttagcggttttttcgttaagtttttgttatcggcgcgcggtcgttcgcgttgcggtagcggcggcggcgcggttgattgcggcggtagcgcggtagcggtgattgggtatcgcgcggtgcgggtgttttcgtcgtcgtcgttttcggagcgggaggtggggatgtgcgagtcgaggcgcggagggagggacgggcgtatcgaggaagggcgggggttttttaggttagggtttcgcggtcgtttcgggggatagagttgttttttgtttcgagtttcgtattattttttttttcgggtcgtcgtagttcgggtcgtttcgttaatgattgatgcgggggtcgtaggttggtcggcgacgcggcggcgcgcgcgtcgagtattagagtcggttttggggttcgaaattcgatagttacgcgggcgttttggaggatattggggagtcgcgttcgcggggggcggggagttgcggttgcggggggaggggagggcgtcggagtcgggtagggcggagagatgcgttagcggtaattttcggaggtcgtcggggaggggggtatttcggaagtcggggggttttaagttcgcgttcggatcggggtcgtgttattgttagttatttggggatgcgtttttcgtttttttattgtttttgcgtgtgtgttagtgtgtgtgtgtgtgtgtgtgtgtgtgtgtcggtttgtttacgtattatacgaaggtttagttggttttttttcgtttagtgggcgtatttaggtgcgttattattttgtcgtttttttcgtttttgttttgttcgaaagaatcgttcgtaagttgttttgtggtcgcgtttattagtttttcgagtcg

SEQ ID NO: 6395 - DNA, 2954 bp, synthetic construct
  misc_feature 1..2954: note = Description of Artificial Sequence: Synthetic polynucleotide
  source 1..2954: mol_type = other DNA
acgttaattatagtggacgtagtatcgcgagcggaaatgcggagagtatcggggtttcgtatgtggggtataatgaaataagagtagtttcggttagaggtttagtaaagcggaaagacggtttcgttcgtatattttttcggaaaattgaagcgttttttttgatttttaaggttagaaagatttattatttttttcgagagggcgtagttatagatttattagagagggcgggtagggtgtcggaagttagagaacggcgtttcgcgtttttttatcgttttagggcgtagaggtgtttttagtgttcggagaggttggtagtgtcggtttcgagggaagcgtggagcggacggtcgataggggatttttgtttaaattttattattaattttttttgagagtaaaaatatggggtcgagttcggtagttgtacgtagaatttaattttttggtagttttcggtatcgacgagttttagatttcgcgttcgtatttcggcgttttgcgcgtagagttaagttttcggattcgtggattgtagttttcgcgcgtcgcggtaaagcgggtcgcgtttttagttttcgaggcgtagcgacggtgggagtcggttcggcgttgggggcgggggcggggtcggcgaagggggagggttgcgcggcggaggggaggagtcgcggcgatagacggcggcgcgtattaatcgggcgtcggttggtaggagtcgcgtagaggttggttcgagcgcgttgcgggcgttcggcgtaaggggagtcgggtagtagtatttttttgggcgtcgttttcgcgcggcggcggcggttgcggcggggtttttttttgtttaaatatttcgttggttagaagcgttggtatcgggggcgggttgggtcgggtcgggtagtgttgtatatttgggtttttttgtttagagttgtgtgttcggggttttttggtttagtcggaggttgcggagcggcgggggttgtttgcgttgttcgttcgggtattttttcggtgatggaagtagtcgtcgtcgtcgttgcggggtcgcgttgtgttttatttatcgttgttagagaggtgggaaaattcgtcgtacggaggtcgaaagcgagaggggttgcgtcgttatgtcgggagttgagttttatataagtcgtttttagttatcgtttttagtcggtttcgtttttttgagcgagataggaagttgcggtttcgagaaagcggaggagacgtcgttggagtcgggaggcgtcgggttcggcggagcgcggagcggggttttgggtcgcgtgaaagttttttttttcgagtcgtagggcgttcgttgttcggaaattgtttagggataagtcggtcgattttttagatttttcgaaggtgcggggatttttagcggaagcgagagggagcgaaatcgaggaacgagtgatagtcggatagttcgtcgggcggtgattcggggtcgttttcgggcgcgttttcggttttaggtgagcggaggaatcgggtagaatcgagggtgggcgttatttaggaggaggaggttgggagggagattggggcgtattcgtttatttcgttttttttcgtaggttttattcggagtcgttgttatgggagagttagttttgggcgttggggattagtcgtcgcgttcgtttcggagtcgcggttcgagtttcggcgttagtagttagttcgttgcgtttttttttcgggttgtagggttgttttcgtcgcgtcgtcggttcggattgtgtttgtgatgagtcgtagttcgtagcgagttttgttttcgggcgcgttttttcggttgttttaggttgcgtttgtagtcgcgtcgcgtgttttgttttcgtagtggtttcggcgtttaggacgtcgttggttcgcgttttttttcggaatgaaggtgtttcgtaggaaggcgttggtgttgtgcgcgggttatgtattgttgttggtgtttattatgtttaattttttggattataagtggtataaggagtcgttgtagtagtgtaatttcgatgggtcgttgggtgtcgtagcgggggtagtcggaggtagttgggggcgtttagggtcgttttcggtcgggtcgtttcgtgtttatgttcgtttggattttcgtattttttatcgttttttcgttgtcgtcgtcggggcggtttttgtagtcgcggtagggatggcgggggttgcggtttttttaggtaatggtattcggggtatcgggggcgtcggggataagcggtagttggtgtacgtgtttattacgtggcgttttggttcgtcgtttttcggcgagttatttaattagaatttcgaggtgttttttttttacgagttagtgtggtatgtatggtaaaaattgtattcgggggacgtcgtttttttgtagggggtagcgcgggatatgttgagcgttttttatcgttgcgatttttttgttttttagttgtatagtttcgcgggtagcggggggcgtaattttattacgttgggtattttcggcgtagttattaataaggtggtgtgttcgttattattttgtttcgtttatcgtaaggaggtcgtggggttggtggacgatcgcgtgtgtaagaagtgttcgttatagcgtttggcgcgtttcgaggaggagtgtcgtaagtatcgtatattagttataaagggtgtgcgcgttttcgacgtggcggttttggcgttattgttgcgagattcggttttggattttaaggttatttatttggtgcgtgattttcgcgcggtggcgagtttacggattcgttcgcgttacggttttattcgtgagagtttataggtggtgcgtagtcgagattcgcgagtttatcgtatgttttttttggaggtcgcgggttataagtttggcgttaagaaggagggcgtgggcggtttcgtagattattacgttttgggcg

SEQ ID NO: 6396 - DNA, 2954 bp, synthetic construct; identical to SEQ ID NO: 6395
  misc_feature 1..2954: note = Description of Artificial Sequence: Synthetic polynucleotide
  source 1..2954: mol_type = other DNA

SEQ ID NO: 6397 - DNA, 885 bp, synthetic construct
  misc_feature 1..885: note = Description of Artificial Sequence: Synthetic polynucleotide
  source 1..885: mol_type = other DNA
gcgtacgtttgcgtgtttattttttagagtttttggtttcgcgatcgtgtattgattttttttagaattttaggttcgttttggacgtggaaggtagtcgtgtcgtttgggaaagtggagtcgagttcgggacgttgtcggtttaaatggaacgtcggtttcggggttcgtttttcggcgggttttcgagttaaattttttaattgttttatgacgttatcgggttttttttttttgtttcggttcgcgcggttttagcgtggcgttaaggagtgtggcggttttcgcgcgtatcgtgggttatttttaatttaggatttggttagtaggttgtttttcgagtcgaggttgcgttgggcggaattagggatttatagttcggagtggggttgaaatagagtttttggttcgagtagagagcgtgtatacgtatgaaatcgtgtttttgggtgcgtcggcggttaggtgttcgatgtcggttttggaagtagcgtcggagttcgtttgaatttaggttcgggaggttagaggttgtcggttacgtttaattgtgttttttttgggaagataatttttttagttttggtttttttttgagttacgggtggttggttggtttggtggaaggtaggtgtataggtaatagagataaggttaggaggtaaagtatatttatgtgtaaatgagacgcgttagggaatttgtaattttttgtattttcgtttttgatgtttcgatttttataattatagaattttaggtagaggtcgtcgattttttcgttttcgttaagagggattcggagtatcgaagttttttagtcggtgtcggcgttttcgcgtttttttttttttttgcgtcgtgattttaaaagggcggcgggcg

SEQ ID NO: 6398 - DNA, 2174 bp, synthetic construct
  misc_feature 1..2174: note = Description of Artificial Sequence: Synthetic polynucleotide
  source 1..2174: mol_type = other DNA
tcgttttatcggttttttgcggtcgttgtagaagcgtattttgttgaatatttcgaggacgtgtttttcgtatagggagcgttcgtttttgttggggttggagcggcgtttggaggtcgatattcggtcgttgttggattttttcgtttgtcgtttttgtcggattaaggagttggttatcgtcgtagttatagttgtttagcgagggttttaggttttagtttttattgcgtttttcggtttgcgtttcgtcggggcgagggtaggatttgggcggttagggaaagggtagtcgcggggaggtagtgttaaaatttgaggaggttgtagtatcgaaaattcggcgtttataaggttagttaaagtttgggtagtggcgataaaatgtgtgaaaatttagatgtaaatttttttaatttttggcggtcggggggcggggcggggcggttttaggtttttttgcgaagtagacgtttgtattttaaatttgtattttaaggcgatcggcgtttaaggggtagtggggagtttagttatattgcgttcggggtattaagtggaaggggaagaacgatgtttaaaataataagacgtgtttttgttggagaggcgtaagcgttgtaaggtgtttaaagtatatttatatatatatatatagaaaattcgtttataaagtagagtttggatttaggcgggtagcgcgttttcggtagaaaatattaaaaagtgaataaaacgtttttttagaaaataagttattaatcgtacgagagaaggagaggaaggtagtaatttaattttttgcggttcgcggttttgaagattaggaggttcgttttagtagggtgaggtttatagaatgtatcgcgtcggttgcggttttttaggggtcggttattcgagttttggaatttcgagaggcgcgaagtgggagcggttattcggagtttgggtaggggcgcggggcgggggtagttgtttttagttgcggtgagagtaattttcggttagtagtattgtaaagagagtgggaggcgagggaggggggagggcgcgagggagggagggagattttcgagggttaagtatttttcggggagaaattagcgagaggcgatttgcggggttttaagagtgggcgtttttttttttttcgtttgtttttcggtacgagacgggtatagttggtgattatttagggaattttaaatttggaatgatttagtagtttaaataagtttttttaaaaggtagcgatgtcgaaggtgttttttttagttcggcgtttatacgtttttaattggagtttttcgttatggtttattcggggtcgtcgtatcgagttggttttcgtataggtttagagggagcgagggaagggagggaaggaaggggcgttttggcgggttcgggattaggttatcgtcgcgttgttgttcgtgttttttaggttcgcgcgtttcggtagttagtagtttataggtagtagattagatggggattattcgtcggacgtaaggtcgattatttagtttcgcgtcgtttatttcggtcgaggaaggaagtgattcgcgcgttgcgaatattcgcgcgttcgttcgggtggggcgggggttggttgtaggcgatgttggttcgcggcggttgaggtttttggtcggagttgtttattatggtttggcgttaggggcgtaggcggggtttttaggttttttggggttatttcgcgaggtagtcgagggcgtaattcgggcgtttggggtcggaggcggaattaggggtcggggttaggaggtaggtgtaggcggttgttaattcgtttaatttgttgcgcgggtggtcgtttagagtcgcgggtttgcggggcgtttttcgtcgtcgcgtcgtcgtttttttaggttcgggagggggcgtttagggtggagttttatttatgggttgaggttttgggcgcgcggagtcgtcgtcgttttttcggttggtttagttggagtgttagtttcgtaggaaattcggggttcgggcgagagttatcgagatggtaggtgggacgtagagttcgcggtagttagagtttttttcgtacggttcgtcgatttacggaagagcgaaagagcgtttaggtggggtcgagttgggggtcgggtttttggagcgttgggaagtatagcgcg

SEQ ID NO: 6399 - DNA, 873 bp, synthetic construct
  misc_feature 1..873: note = Description of Artificial Sequence: Synthetic polynucleotide
  source 1..873: mol_type = other DNA
tcggagagttgttatcgatttttttaacgttttaagttttagttttgtcgttcgcgtttttttttttttttgggttataattttggttttttcgggtcggttttacgtagttgcgtaggagttcgcgggggaagatttttcgtggggatttcgagtacgacgtgcgattttaaatttttatattttttttgtcgtttcgtaggttatatgtatcgggagtcgggcggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcggagagcgtacgtttgtcgcggtcggtatggaaacgttttcgttaggttcgggggcgtcgttgattggtcgatttaatagacgcgggtgggtagtttagtcgtatcgttaagttcggtcg

SEQ ID NO: 6400 - DNA, 2174 bp, synthetic construct; identical to SEQ ID NO: 6398
  misc_feature 1..2174: note = Description of Artificial Sequence: Synthetic polynucleotide
  source 1..2174: mol_type = other DNA

SEQ ID NO: 6401 - DNA, 510 bp, synthetic construct
  misc_feature 1..510: note = Description of Artificial Sequence: Synthetic polynucleotide
  source 1..510: mol_type = other DNA
gcgggtatttcgtacgttacgtaggcgttttttcgatgagtttttttttattttatagtttagggaaggtgcggggttgcgggcgtagagttgtataagtagggttgtaggttgggttaaagtcgttttgcggggatcgatatgaattcgggttttttatcggaagggattaaggattgagggttgagcggcggtagcggagatttcgttcgtagatttcgtttcgtcgtcgttatttttcgtcggttcggatgaggtttttttagttttgggacgttttgtttttatatttattatttttttattttaggggtgtagcggagttttagttacgaattatttaatattcgtaggttatagagcgacggaggttgaggttgtgatcgaattatcgacgtttttttgaggggtgaaagtacggtcgtggagattttaatcgagtttacgttggcgtaaaaggtaaaagtcgcgttagatttcggatgtcgttttttttttttcggttgcgcg

SEQ ID NO: 6402 - DNA, 511 bp, synthetic construct
  misc_feature 1..511: note = Description of Artificial Sequence: Synthetic polynucleotide
  source 1..511: mol_type = other DNA
tcggagtttggggtcgggttttttttatttgcgtgttgttttcgggtttcgtttcgtttcgtttcggagggatttttaggtcgggtttagatttaggagttatttggggatttcggggtggttgcgcgtcgagggggcgttagcggggacgtgagttggcgtcgagatagtttcggttttttagcgttagggttattgttaggagattttcggttagtatttacgtggggcgttttcgggagttcgaggggtttatcgtttgtcgggattcgttattttaaagcggcgggtgtcgtcgagtcgttggagttttcggattttaggttcgtttcgtcgtcgagtatgtttagtgcgagtcgtcgtcgaaagttttttggaataaatattcgtatttggggtttggcgggttaggaggtgtcggacgggcgtgggagggggagagcgagttggcgcggtttaggcgttcggcggttaggtttgggtttgtttgcgtttaaatcgaattagagcg

SEQ ID NO: 6403 - DNA, 417 bp, synthetic construct
  misc_feature 1..417: note = Description of Artificial Sequence: Synthetic polynucleotide
  source 1..417: mol_type = other DNA
tcgcgtcgtcgttttggcggggacggtgtagtaggcggcgggatgcggcggggcggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcgagtagatagcggcggggcggggagcgcggggcgcgtggtttttgggttttgcgggttcggagtttcggttttgcgattttttgagtttggttgggaatttcgtacgtaatcgtttaggcgtcgggttttttttttgttttaggagggaggtggcggcg

SEQ ID NO: 6404 - DNA, 1748 bp, synthetic construct
  misc_feature 1..1748: note = Description of Artificial Sequence: Synthetic polynucleotide
  source 1..1748: mol_type = other DNA
acggaaatattcgaatcggtgaaatgtaaatcgtgtttattgtataagggaatcgtgtagggagagtcgttttttataaggagttaattagcgtttgtttcggatattttcgcggggtttttagcggggtttaaattggcggcggtttagtagggggcgaggggtgttgggaaacgtcggggttgcgaatttacggaagaaaatgtattcggtgtagttgttttagattttgtcgtcgcggtattggttgacgaaggcggcggtgttcgaggagttatacgttattatgtggaagtcggtttcggataggcgattaaaggtttgttttaagtaggtgaatttgaggtagaagcgggacgtgtattttttcggttgtcggtcggggtcgcggttttcgttgagcgtgttttcgaagatttttttggttagcgcgatgcgttcgtatattatgatgcgcgttatacgtcggaatttggcgtcggtttggttgtcgcgtacggtggtgtaggagtttcggtagtttagcgtgaggaagttcgagcgtttgttttgcgcgtcgtcgtcgtcgttattatcgtgcgttttcgggttcgagggtacggcggtcgtcgtttcgcgtagtagtagcgcgtcgttgttattttgcgagacgttgttttttaggtcgttttggtagttttcgtcgttgagagagttttgtttggtgattttgggcgatagtagtttgattaagtcggtgagttggaaatattcggtttcgcgtagtagtcgttttttttcggggaagtgtttcggtagcgcgagttgtttgtttcgtagataatttagtacgtatttgaaaaggaagtcgtttcggtcgatgaagaagcgcgttcggttgtttttgggtagttcgtttcggcgtcgggcgtcgttacggggattagagggcgagaatatgttggttaaagtattgttcgggacgttgagtagcgtcgagtgtttggttatataaatttggtcgtttacgtttagttttattattttagggaagggcgagggtgcgtagggtttcggggcggcggcggtcgacgcgtcgggcgagttggacgaggaaattatttcgttaatgggtaggatggtgttgtcgtcgttgttcgtgttttttagagttatagttttttcgtcgtcggtttagtgattcgagagagttgtattttttcgttttcggagttcgcgttttagtttttcgcgtgtttttggcgttttgcgttttcggattgggcggcgcgttttttcgatcggggcggtttcgtttagggttcggggtagcggcggcgtcggcggcgttcgagttttatcggaggagagacgcgcgagagaggagtttcgtcggtgcggcggcggtaatggagaggtaagaaggagttgttgtttttttggggcgagggcggggaagtgtgagagagatttgcgagaggttttagggttgttgttcggtttttcgtggggagggcgggaggaggggtcgaagtaaagaaaattcgtcgtttcggtagtttgtaagcgtgtcgcgaggtcggagcgtcgacggtggcgttaattatttttggtagtacgggaggaggtattgacgttaagtttcggattgggattcgagttttagttgttatttaaagagataggttgtagtcgcggttttcgggtttcgacgttagggggcggggtcgagagtcgagtttgtaagaggtgtagtttttcgattcgcg

SEQ ID NO: 6405 - DNA, 1748 bp, synthetic construct; identical to SEQ ID NO: 6404
  misc_feature 1..1748: note = Description of Artificial Sequence: Synthetic polynucleotide
  source 1..1748: mol_type = other DNA

SEQ ID NO: 6406 - DNA, 648 bp, synthetic construct
  misc_feature 1..648: note = Description of Artificial Sequence: Synthetic polynucleotide
  source 1..648: mol_type = other DNA
acgaaacgttgttatatcgagcgaatgtaacgcgtatatacgtttatattcgaatagtataagtaagagatcggttgggtgtggaatagaggcgtatatcgcgtaacgtatttatagtatgtatacgcgcgtatttcgatttcgttttttttcgcgcgtttttatatttcggcgtttaagattttcggtttacgaattttattagatagtcgggtaattttttaggtgcgtagtttgttatttcggcgcggtcgtttttgcgttttagcgtttttttttacgtcgttttttttagtcgtttgcggcgtcggagtttagcgtaggttagtttagttagtttcgtcgtgtatacggtgcgtagcgtgggttcggggttgtcggtttagtcgtttcggttacgtgtgagtcgggggcgcgggttagcgcgatgcgggtaggagttgcggcggcgtcggtgttgtcgtttggtttcgcggcgggggtcggtgtagaggagatacgtagggagggagggaagagaggagggaaggaggagggagggggttagtcggggttattgtttggatagttgggcgtcggtttttttaaaggtggggttattcgcgttcgtacgtatattagttcgaatttttattttcgatatagtcg

SEQ ID NO: 6407 - DNA, 863 bp, synthetic construct
  misc_feature 1..863: note = Description of Artificial Sequence: Synthetic polynucleotide
  source 1..863: mol_type = other DNA
gcgtataggaagggcggaggcggtattcgggggggattgtttttagaggaggtcgttgtgagtcggcgacgcgaggttgggggagtgggaggtaaattcgttaatttgtcgtcgaatggttatttttagtttttcgtttacgagggtggaaaggtagaaggtttgaaggtaaggcgtgagggagcgtttaggacgttttcggaggggtcgggtcggggtttgcgttgtagttcgtacgtattttattttcgcgtcgcggcgttcggtcgttcgtttttttttttgggttttttttggtcgtcgtcgtttttttttttttagtttttttttttttttttttttttggtttttcgtttttatcgttgatttgttagcgtttttgttcgtttttttttcggcgttcgttgttttttttgtagcgtgtttttcgtttttatttcggatggggatggggtagggggcgcggggtgagttattaattttagtcgtttgtttggtcgcgtaaggcgggaaagtgggggcgtttttgcgttttacgttaagtttagggttacgagtatttttgtggagatcgggagcggttgggttagggatgatgttttttttttttttttttttttttttttttttgttttcgttttttttttgggttttttcggggattattttttatttttcgttagagtcgttttgggagagtcgagggtttgagggtcgattattaagggtagagtttattttttggggagttgttggaggagataggtagcgtcgggaggtggtttatatcgtatcgtcgagagcgttttgttttcgtatcgttgaaatttaattacggttataggttataacgttaggggtcg

SEQ ID NO: 6408 - DNA, 1288 bp, synthetic construct
  misc_feature 1..1288: note = Description of Artificial Sequence: Synthetic polynucleotide
  source 1..1288: mol_type = other DNA
gcggattcgagagcggcgattttcgtttggaggtcgttggtttttatatttaggtataggtaagatattacggttattattgataggagggtcgttaggacggtatacgggggtatggttcgggtataatgttgttcggtaggggtcgggttttcggatttgggttttcggtttttttttttttttgcgtgtttttttagtagtatcgtggcggggtcggtcgtttcggtttcgttttttattttttatattttaaataattttaaaaggaaagaaaaaggtcgatttttttaaagtttagtttttgtggttgtataattagttggtggagttaagtttacgagcggatacggatttttgttttgtttagcgtttagattcgtaggcgtgtattattttcgtttttttttttttttttagttggaagtgaaaagtatttttcgttcggggattgggtggcggtggggtaaaaagtaagacgaaatttatttagatagttttttcgatttttagaggatcgatatttttttcgagggttttaatagtggtcgtttagggttcgagggtaacggtcgaggcgttacgcggggtcgcggttcgttttggttacggaggatcggatttgttgcgtttttgtgagtttgttttatttttatttattcggtgtttttcggtacgtcgatttgttttttatttgtatttagtttaaggtaaaaaggttgtgagagtacgttatagcgtagcgcgaaaggggcgattaaggtggagaagagagaggaaaacgaaataaatttaaggaattaatgttattcgcgaagtcgaagtcgcggttgttcgaaggattttcgtagtttcgcgtgcgcgatttttaaatatttttcgcgatgttcgcgtgagtgtgtgtgtgagtgtgtgagtgcgcgcgcgtttcgagtacgacgtttttttttcgattttttttcggcgttcggcgttcggtttgtcgttttcgttgttgcgcgtttttttttcgaaggtaaagtaggagttcgttttattattataatgtatttattttggtttagttcgcgggtcggttcggggaatttttaagggaggcgggaagtttgggtgggagcggggtaggaggtttgttattagtataatgtatgtaaatagttggagcggttatcgtgattggagaggagtttggcgatttttttttttgcgcggagtaattttagtattttcgagggttatttttttggtttgggtcggggtcgaagcggggtcggttgcgtaagaggcg

SEQ ID NO: 6409 - DNA, 1275 bp, synthetic construct
  misc_feature 1..1275: note = Description of Artificial Sequence: Synthetic polynucleotide
  source 1..1275: mol_type = other DNA
acgcggagtaaaatttaatcggtttagggaatttagatacgtttttcgcgtcgtacggattttttagaaggagtttggaggtaggcgttggatttttttaggtattttcgttttcgtcggtttttttttttcgcgttcgttgggttatttattcgcgtggggtatggtgatggtttcgttggtgttggagtttacgttgaagatgattacggttgaggcgttttgtaggaacgcgtttcggattttatttttgtacgtgtagttgtttttggggatgagggttatttagtttttgtcgcgggtcggggcggcgaatttggtgttggggtcgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcgtttcggtttcggggttcggcgcgggttcggcgtaggtgatgtttacgaaggcggtgtattatttttttttttcggttacggtaaagtttaggtagagtagatgtacgaaataaaaggaaagtagttatgttgagagagttagattgtagtacgtttggatgagagatattgttatttttattcgtcggggtttttttttcgttttcgcgtttttttttcgtttcgttttttttttttagtttcggttaatttcgggtcgttgtttttttttttgttgttgtttattttcgggtcggaggggtcgcggtcgggacgcgtagtcgtcgcggggatcggatttcgggcgagcggatggcgttggttttttttttttttagttgtagcgcggtggttgtattttgttttttgggcgttcggggggcgcgggaatagagggttcgcggggtttgcggaggagttttgttgtcgagcgttttgttttttcgttcggtttcgtttttttttataagggtggtcgggggtttacgaatttgtagggtggcggttttgcgttttttagtttcggcggggacgggtacgattgttcgtagtttggggtgttgcggtgcggggtgttgtttagggtgtttcggtcgtcgttattgagcgttggggcgcgcgaatttagttgtagtcgttgttgttttgcgtcggtttttttaggttgcgggcgttgcgtttttgatttcgtcggtggttgcgtttgggtacgtatttgtcgcgggcggggcgggtttggggatagtgggagcgagtaggtagagcggagtaagcg

SEQ ID NO: 6410 - DNA, 1071 bp, synthetic construct
  misc_feature 1..1071: note = Description of Artificial Sequence: Synthetic polynucleotide
  source 1..1071: mol_type = other DNA
gcgagcggtggttcgatttcgggtgtggtaggaaggggtgtttcgcgttttagagttagtgttagtttttattttttcgggaagtcgagatttagggggaataggttttttagagtttagtttgtagggacgcggagggtaggagtcgtcggcgaggagtagttaatttgttatttttggcggttgtatttttcggcggttataggttgttcgatagcggattttagggttttcgcgacggtatttagagtgtttagaagggaggtcggggtcggggtgggtcgggaaaatcgagggagggaaggagtttggagaagtttcgtttaggcggggagggggcgattcggggcgtatttttcgattatgatttttatagattttggcgtcgtaatttgcgttttttgaggtcgaagatgcgtattttggagaagatatttattaggttgtcgttgtagagttcgcggtttttgttggggttgtttcgttttttgttggtagacggtcggttttagtgttgttttcgcgtttgtcgtttttggcggattaagtcgttagcgatggtcgcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagtcggacgatttcgggaagtcggacgtcgtggtcgtcgtcgtttggttacgttcgagtggagagcgggatcgcggttgcgggcgttgttggttatcgttcgtcgtaggaatttcggcgggggtcgttatcgttattcgcgttgttttttcgttttgttcggttttcgggcgggaggtagagtcggtcggcggtttttcgggcgtcggttggagggcgggtttcggtagggtttttgcgcgttcgtcggttcgggtcgcgttgggtaggatttagcgtcg

SEQ ID NO: 6411 - DNA, 694 bp, synthetic construct
  misc_feature 1..694: note = Description of Artificial Sequence: Synthetic polynucleotide
  source 1..694: mol_type = other DNA
acgttttcgaatttcggattttagttgttattttatttgcgtcgtttcggacgttatttggttgttgacgtggtttcgagttagtaaataacgttagtagtttttttagatttacgtcggttcgttttttcgtcggtttttttttcgtagtggttttttttgtagtttttttgggtttcgcggttagtagtgtagttcgtggagtcgcggttttgttcgttttttttgggtggttttagtgcgcgggttgatatttatttagtcggggaaggtgaggcgagtagaggttggtgcggaatttgtcgtttttagtagcgtcggcgggttaagtttagggtcgggtagataaaagaggtcgttcgcgtaggaaggtacggtcggcggcggcggagcgtagcgatggtcgggcgagggggtagcgcgttgttggttttgtgcggggtattggttgtttgcgggtggtttttgggcgtcgaagtttaggagttcggggcgttcgcggcgggtatgaggcggcgtcggcggttgtagtaagaggacggtatttttttcgagtattatcgttatttcgagttgcgcgaggcgttcgtgttcgtgtggttgtagtgtatcgttattagtaggatttatacggtggggcgtagtttcgagggtcgggagtttttggttatcgagttgttcgataattttggcg

SEQ ID NO: 6412 - DNA, 694 bp, synthetic construct; identical to SEQ ID NO: 6411
  misc_feature 1..694: note = Description of Artificial Sequence: Synthetic polynucleotide
  source 1..694: mol_type = other DNA

SEQ ID NO: 6413 - DNA, 1424 bp, synthetic construct
  misc_feature 1..1424: note = Description of Artificial Sequence: Synthetic polynucleotide
  source 1..1424: mol_type = other DNA
tcggcgggtacgttggggatgtattcgcgtagttcggcgaaggcgttgttgatgttttgagttttgcgtcgttttttgcggttggcggtgtttcggcgttttatcgggcgcggtttttttaggttcgggggttcggcgttcggcggtattttttcgtaatgggagtggtttaggtcggcggcgtcgttggtatattcggggttgtaggatagggttatgttgtagtcggggggcgatatttcggggtggtcgatgagttagttatggaagtaggggttttttttatggttgtagcggttggcggcggcggcggtagttgcggcggcggcggcggtaaacgggtagttttcgtggtgtattatcgggtggtggggaaaattatttattagatttatttcgtttttcgcgtttttttacgcgttttagcgtgcgcgtagtttcgtcgcgttttcggttcgggtttttgttttagcgttcggcgtttttttttattttttattttttagttttcgggcgttcgggttcgttcggtagtcgtagagggggttgttgtagttcgggtttcgttttttcgtttggttagtcgggttcgttttagtagcgttgcggtcgtcggttttttatggggcgcggcgagttggttttggtatcgtgcgtttttggtcgtcgtcgtcgtcgttttcggttttcgttttgttttacggttcgcgtttcggtttttgtttttcgggttgttgcgcggaggtagaattttttcgtgtttatataaaggtgtcggggttttcgcgaggttggtacgcggagtttcgggaatttaagttcgggtcgcggttttggtatcgaagttaattcggaatttaggggcgagtttgagtcgcggttggaggagtcggtttagttgtgtcggggggcggcggggtcgattgtttattgtaaagttattttcgtgcgattttttttttttcgtttttttttttttttttattagttcgatttgggtttttgggcgtttattgttttaatgaaatttttggttgttgttgttttggtttttaaatgtgattttagttgcgagtaacgtgttttcgtttttttcgcgttttttcggagggtttttagagaggttttagtgtatttatttttttagatttttttttttcggggtaaggatttggggttttgaatgagttttggagttcgaagatcgcggttcgggttttcggagggttttgcgcggtggtcgaggaagtttcggggtgacggcggtggtttttttgggttggacgacgtgaggggagtaagcggatttttttagtaagatttttatgtatagttatatttttagggtcgttcgggttaatatatgtcgttagaggttttttacgttaatttcggggcggtaggggcggcgtttcgagttttcg

SEQ ID NO: 6414 - DNA, 1215 bp, synthetic construct
  misc_feature 1..1215: note = Description of Artificial Sequence: Synthetic polynucleotide
  source 1..1215: mol_type = other DNA
tcgcgtaggttttcgggttcgtcgtagattttaacgtaaattttcgggtttttcgtaaattttaacgtagatttatcgtggtttcgttcgcgtcgggtttcgcgttcgagaggtcgagttcggattcgaaggcggcggcggcggcgggcgtttcgcgaggattcgggagtagcgtagcggcgagtagagaatacgttatagagaagaagtttagtaagtgtatggtggaaggatcgggggtgggggatcggttcgttggcgggggtaggggtgggggcgcgggcgtttttgcgaggtcgcgggttttttttggtttttttttttcgggtttttttcggcgattttttttgggcgagtcggaggcggcgggagcgggttcggggtttcgcgtttttaattttgtagggcgtttttttagttagtgtcggggaaaggcggcgggtgttaggtaaaagttttataggaaatcggatattcgagtttttcgtattcggagttcgcgaggtgaagcgagggcgagggaggacgtcgtcgcggttcgcgtcggtgtagttttttggagaggcggggcgggggatattagaatatttcgcgatgtttagtttttttaaattcgttagagttttcgtttttttttttttttttttttttcgaagtgagaggagtcgggtcgcgggcgttgcggcgggggcgttggcggcggtgtcgggggcgggaggagggcggcggggcggttggcggcggcggggttcgggagcgtcgcggcgtaggattttttagagcgcgtcgggttgagcggcggcggcggcggcggcgggcgtaggggtagggtatgattgacgcgttttttgtttgcgtttatgtgagagaaagcggtcgagggagggagcgtgtcgagttcgggttgttttttttttttattttttttcggaagtcgtttttttggagtttttcgtttttttcgtttttttttcggcggttttatttttttcggtttttttttggattttttttttttcgtttttgttttttgcggggagcgggcggtcggaggggtaagtttagtttcggggttggcggttggcgggatcggttttagaggtgatgcgattattttggattacgtgtagcggggagaaattgggtatcgtggggtggagggagttttcgttttattttcggttattttcgagtttttgttttttttttcgtacg

SEQ ID NO: 6415 - DNA, 1184 bp, synthetic construct
  misc_feature 1..1184: note = Description of Artificial Sequence: Synthetic polynucleotide
  source 1..1184: mol_type = other DNA
tcgtttttttttttcgggtcgcgatattgattcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcgtggggcgtgtgggtgaaggcgatatttcggatgcgggacgtatgaatggtggtagagtaggggtcgggattcgtttatgggttgggagagagatgtttttgtgagtacgggaaagtagcgttgtcggagaatagttttgaggcgggattaaaagtcgtcggcgaagtttcgtcgaggaatacggtcgttgttcggggcggttcgcgagcgtgcgtgtgtggaggggaggatgtcgtttcgcggggttttcggagggtgtcgggagcgggtttttagtgtagttttttcgttttcgttgggggtacggttgtttataggtttcggttcgcgtgtgtggagcggggcgagggggtgaggcgagggggtgaggcggcggtcgagtcggggcgttgggcgcggggttggcgggaggcggcggtggcggttcggcgcgaaggggttaagcggcgtatcgttttttcggcggtcgggtgtaaatagaggagttttagtttattatgtttggtcgtcgcgcgtagttcgagttcggagttaggcgttgtaatacgatacgttttagatttaggtaatttggtagcgttgggttcggttttttacggttatagcgagggcgcgtcgcggtaaggtgggtgagcggcggcggcggcggcggtttggggcgggttggcggagcgcggttttcggtgaggtttttcgcgcggtagggtcgttcgttcgtttcggggattgcggcggtggcggtggcggtggtggcggcggcggcggcggcggtttcgttttttttttttgtggtgtcggaatgggaggaggttcggcgcgggtttgaatcggtgcggaggtaatattcg

SEQ ID NO: 6416 - DNA, 5820 bp, synthetic construct
  misc_feature 1..5820: note = Description of Artificial Sequence: Synthetic polynucleotide
  source 1..5820: mol_type = other DNA
gcgagtagaaggcggacgttttcgagtcgtaggttacgtagttgttatagttttgcgattcgttatagggatttttatagacgtttagcgtcgcggtcgagttgagttcgtggcgcgcggtggttagtagtcggttttcgtagatcgggtagtagatcggcgtttgggtcgaggcggcgggttcggagttcgttagcgtgcggttttcggattcgtagtacgtgtttagggagttggtggttattaagaattgtagagagaggtcgcgaggattggcgggaagtcgggttggaggttggggttttgggttttgttaatttcgcgcgtcgtttacgagggcgtgtttcgagtattttcgggtttttcgtcgtttatattaggatgttcgtttttttttattagtttgtgcgcgtttggtttttttcgttacgtggggtttagtcgagtatttatattttttttcggagggtttttaaggtttttgacgttatttgcgcgttaagtttttttttttaggggttttttggggttttaggatttttttggggtatagtttgagttttgtggtttaaatattagggaattcgggttcggttcgtcggatttttttagcgtttcggttttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggttttttaagttttcgtttagtttatcgtttttatttcgttttttcgattttttttttcgatttttttttcgtcggtcgtgtttcgtcggtttttttttgtttttcgcggttaagtcggggattgtcgggcggttttgcgcgttcggaagagtaggttttttaatttaggtttcggtttttttcgttaagttcgtttttttcggcgtttcgtagggttggttgcgagggagggggcgttgggtgtttggcggaggcgtttttttttgtttattttgtttagttttttgtttggggcgtacggagtaatcggaagaggggatcgagcgtttattttaggattttttcggttagtattttttttgggattttgtttaagtttaaagcggaggttagtgagtaggcggtaagggggcggtaagggggcgttcgggttatttcgaattcgtttttcgttttttgcgttatcgtttttcgggatcgggattcgtttcggttgttttcgttttttgggtcggtttttcgtggtaagttgggaaggaagtcgtgtaaggtagcgttgtgtagatttgtttagaaagatttttgggtttagatttgtgaatcgttttagggttattttttaattaatgatgacgttttcgttttttttttagttgtaagtttgttttttagaaacgaaatttgtttgtttttttgatagttcggttgaaggtgattgatgattatttggagattatagtatatattatataatatttgttgcgtaattgttttaatttatagatgaaaatacgagtttttcgatcgcgttggatcggagcgggttacgttcgagttgtttgtagagggaaattatcggaaataatgaatagtcgttttatgtaaattatttagatagtttagcgtcggtagtcgcgagaaatatataaagaatacgagttaaatgatattaataattgtttttgaattttgtattgatttcgcggtaggtcgcgttttttttttttttatttgaatcgttaatattatttttttgtaaataataagaaattagttatcggggtttttcgttagaaatgaattttttaatttttttttttttttttttgtttttttttttttttatttttttttttttttttttttatttttttttttttttattttttgtagttttttggtttttttcgagtatttttttattttttattatttattgtttataaattattcgttttttttaggtaatgaggttcggttgaaggaggggtgtgagtttagtcgggttaagggttgggatggggagtagagatttttagaggggaggtatttagttgtggtttgttttttttttatttatattcggggatttggtttcggcgattgtgagtatttcgtcggttgagggggagagttagggtttaggggtttagttatttatgttttgtatttttgggttttagtgtaatagtttagtttatttagatttgaggttggtgtatttttttttttttagattcggcggggtttaattggagtcgaagttttagaataggcggttatttattttttgagtagagtttgggagaagtagtttttattttttagggtagttagtacgtgggggttttttcgggggttttttttgattattatcgttatttttttttgtttttttttgtttttttagtttgtgtgtataaatcgacgttttagtttttattagcgggcgatttttttttcgtgatttagaaatttggtttttgaatcggtttttttaggtcgtcgtatatatacgttttattttttgttcgttagtaggttttagcgtttggggttcgggtttagttatagttattttgtttcgggaagttcgtaattgtttaggaggttttttgattcgttcggttttatttaggttttattatttattttaggatatagggttaatttagtttgtggattggcgattatcgggatattttattgaaattttgtagtttggtttaggttcgtttgtttaaatcggggatttttattgggttattttttttttatagataatattggaatattttttaagtgtttttattaaaaggttaagtttggagcggaggtatttagtgttttttttattaacgataggacgtttagtattttaggtattagttgaacgcgtttgtatagattcggagtgttgagtttttttttttttagggattttcggtattaaatatattcgtgagtaggtgggttagaagttagtcggttttcggagtatatagtatcggtttagtttcggggagatgaggtgttttcgttggtttggagcgtttcgaagagcggaggattagggtcggagtaggtcgtaggggaggtaggggatggttagtttttaacgcgaagcgtaggcgggtcgtttattttgacggggttatcgttggtcgtcggaattatggaaggttttcggggagataggtcgggttttgattttttttcggttagtttagttttggtgttttaggagttattttgggggttattagtttttcgtattaagagttcgttcggagggagttttttttagtttagagaagttaattttagttaaaggcgaagtcgggagttcggggtattaggtaagggtttttttttttgagatttggggttagagattttgggggcgtttgtgttcgtttatcgttcgggatattcggttggggtgtgggtttgagaggttttacggtcgttgacgtcgtattggcgaatttcgaggttggtaggttatttttttatagtttcgaggttttttcggagttagtggtaggagaaggagttatagggataagcggtgaatttttggatttttaatcgttttttatgggggttcgcggtttttttttttttttttttcgttgcgttttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgttttcggtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgggtgtaggagttggggtgagggcgtttcgggtgttagtaggggcgttgggagttgtttgggcggggacgtagggtttcgggaggttatatagttttaataggatagtgggaaggcgcgcgagttagatttggttaaacgttaagttcgttgcggtttcgggttttcggtttacggggttttttttttcgtttgggttgttttatttagggacgtttgggtcgggcgcgaagagttcggaaatagttatttttgtcgtcggttcggttttttttcg

SEQ ID NO: 6417 - DNA, 1233 bp, synthetic construct
  misc_feature 1..1233: note = Description of Artificial Sequence: Synthetic polynucleotide
  source 1..1233: mol_type = other DNA
tcgcgttgggttgcgtttttgtaggagttaggtttttttatgttttgcggcgatagtcgttggggtggggttacggggaagtcgcgttgtttttcgtttgagcgtgggttagggtttaggtggtgattaaggttcggcgtagtggtttcggagcgtggaggggtagttgttgggcggtttttcgggggagggtgacggttttattcgttaacgttgttttttttttgggattaggtcggaggaattttggatcgttcgaggttggtgtttagttttttttttttattttatttttattattcggcgattttcgtagatttgattggtaggttttgtttcgatttttatttttttaggttttcgtttcggtgtttcggtgttcggtttcgggttatttttgtaggttttgtttagggtagtcggcggtgtttggaggcgggttcgtttcggttgttttacgtttaggtcggtttttggtattttagttagtgggagggcgttttcgtcgttttcgtgttttttcgtaggggttgcgtcgcgttttcgggttttttttttcgtcgtggtttggtttgtttgttttagggcgtagttgcgttcgttttagcgtttttcgggtttgcgtggtttgttcggtttagaggtttttattacggttcgttttttgtcggacgtcgcgttgttgtggtcgcggtggttttgtggttgtgagggtcgtttttgttcgtttatatcgttttttttttgtaggtgaggaatggggtttgtttcgtttggaatgtgtttttgtcgggttttgtttgatttttattttttagtcgggacgcgcgagttttttcgtttggttgagttaaaaagggatcgcgcgtatttcgtcgttttttattacgaagcgtagatataggaggttgtagggttagtgttgcggagaattttagacggttttatagtcgtcgttattcgcggggtattcgttcgggttttgtcgaggatgtgggggttttggttttcgtagagttgggattttcgaaggttttattagaaatttaggagtagttttagttttgtagagttcgcgagggtggagacgggagattcgttgtggggtttgaggttgagatgtcggtttgcggtgaagtcggcgggacgttttaattcgtttagattcgtttatttcgtagggttcgggtttatttttcggtttgtggtttgtgttgggttgcgtagtcggcg

SEQ ID NO: 6418 - DNA, 2865 bp, synthetic construct
  misc_feature 1..2865: note = Description of Artificial Sequence: Synthetic polynucleotide
  source 1..2865: mol_type = other DNA
gcgagttttagttcgttgttcgtttagagtcgtttaggtgcgagggcgtttttattagaaatcggtgttttcgcgcgttttatttttcggggttttgtagatgtcgggtcgggggtcgttagtaggttttttggtttttgttggagatattggaagattaggcgattaggatagcgggtcgggttagtgcggtgtgatacgagggttcgagcggtttcgtagtttaaacgtgtttttattttatattttttacggttgtttcggattcggtgttttcgtgttttttagtttgtttagcggtacgtgggttttaagtttggtttttagcggttgcgttagtttagttgtgtttattttggggtcgcgagggttttttatcggttggtagttggtggatacgttgttaagatcgggggaaaaaaaggaaggaaggaggttagggggatatagggttggtggttttcgtagtttttgatttgcgacgggcgcgagcgtattttcgcgtttttgcgtagagatttttttttaagattggtttacgacgttttttatttcgaagttaagggttttttgtggtaaatttttatacgtttttttttttttcgtttattttcggcgttaggattgacggggagagggtaaggtcgggttagaggggttgtgggtttggattgcggttgtcgttcgcggttttgtttttttgggtagttagacgtggggttagcgtttagtcgtagttttcgggggtgagttcgtagattttcgtacgtgatataggttaggtatggggacggggagtttttcgtcgttcgtttttatttagatgttttttgaggtttcggaatatttcgttttttattttaggatttgattaatttttaagttacggtcggtttcggtttcgcgagacgggggattttgaggattgttttttttttcgggttgggatttttttatagtagtcgatcgtttttagtttagagtggttcggttcgtagcgtttttcgggtataggttttaggtggacggtttcgttttcgcgttcggtttttttgttcgttaagcgtttcggggatttttcggtttttaagcggtcgcggtcgggtggagttagtttcgaagttcgggatttttcgaagggagaaaattcgttttgtttttttgaagcggcgggagaaatcggttttatttaggttcgggggttcgacgttttcggcggaggtcggttttaggggttcgaggttttcgaagttggaggtcggtttcgtttcggcgttttttcgtcgttattttcgtttttatttcgcgggtcggcggagggaggggcggggtcgtttgtcgttcgcgattcgggttcggtttttttagtgattgtttttgtttttttcgcgttagttgtttttagttttggggtaacgttgttaggtgtttagttttcgcgttcgagagagcgtttgtttggttttgaattttggttaggaaggggcgcgaggggaaggtttcgggggaaggcgtgttttcgcgtttcgtttcgtttcgtttcggaaagttttcgcggtttcgtttattttaggggttcgtttagttttcggagatttttttttttgagcgtagtcgtttggtgtcggttttcgtcgagttggagcgcgcgggttacggtttttttggggacgtagaagcgagaagcggggatttcggcgcgcgtttcgcgtttcgttttttttgttcgcgtttcggttttcggttcgcgtttcggtcgtcggtatggtgttgttggtcgggatcgggtcggagggcggcggggcgcgttgtatgattttattatcgtcgtttttatttcggggcgcgtaggtcgaggaggatttcgttgattacgaagagtttgaggatttttcgagtttgttagatattcgtagtatcgtttcggacgattttttttattttttcgaggacgaggaggagtacggcgtcgagagcgcggagagcgtttcggagggcgtttcggaaagcgtttcggagacggcgatttttttgcgcgtcgtttgcgttaataacgtggggttgttgcggacgttggtgcggcgcggggtgagcgtcgaggaggcgtaggagattgatcgtaacggtagggtaagcgggcgttttcgtaggatttgagtttttttattgtttttattttttttttttttattatattttcgcgttttttagtttttggtttcggatcggtttttcggttatttagtcgtcgtttagagcgtttttttttcgttgtttgggagcgcggtgttttgggtggttttttcgttttaggttgggggacgcggtgcggggagggagtagtcgaggtgttagcgcggtagaaacgttagttcggcgtttttatcgtatttttttttcgtttatcggttttcgtggattttttgattgaattcgcgttggttgttcgtgttgtaatttaggatgggttttttgcggttcggtttttttttgattattatttttttttaggtttttggtaggggattatttttttttttttgtaggagatagttttttttgtttagcgttttatttggtttttgggtttttcgcgtcgtttttgttttaatacgttggggcgtagatcggtttttttagtcgtaatgatttggaagtaatagttttttttttcgtcgggatagtttggttttttattttattttcgttgagttttgtggttcgcgtcgcgattagttaacgtgatttttgattggtttgttcgtaggttattttcgcgagttaatgttagtcggggttttttagagttagggtatagggagagttttagagtcgcgggtatttattcgggtagggtaggaggcg

SEQ ID NO: 6419 - DNA, 1154 bp, synthetic construct
  misc_feature 1..1154: note = Description of Artificial Sequence: Synthetic polynucleotide
  source 1..1154: mol_type = other DNA
tcgttttttttcgtatattagggacgttatgaatgtatcgagtatgtttttagggtggcggggagtagtattgtcggtgttgttttaaatacgttttttttcggggagatgggtggtagggagggggagtacgtagggtagttatttggtaatcgttttaagaaaggtattaatttcggatttttttttaggtatagcggttttcgagggggatttggcgcgatcgcggtttttttcgaggtaggtagaaatttcgtagtagtcgtcgtcgtcgtttgtcggtcgggagtttaggattatttttattagcggtaagaggaggaggacggcgtcgggaggaggttgcgttcggtttcggtcgtttagtttcgtaatttatttaaaggcgcggcgttcggcggttttttcgtaaatatgtatttttcgtcggcgatagttttttagttcgggaagaggcgtgcgcggcgtcgttcggttttagggtaaggttttgattttgtttaattgtagtatttttcgtttttgttgtttgagcgcggtcgcgggataagggatgttggcgggcggtaggggcgagcgtcgcgggcgagaggcggttttcgacgcgagtgcgtagcgttcggttcggcggttttttcgagttcggcgagcgtagcgttttttgtttggtttcgcgggttttacgggtttttgcgggtttttcggggtttcgggcgtcgtcgttagtcggtcgggttgagagagtagtcgtcgcgttcgtagtttcgtttagtcggttgtcgtcgcgggcgcgagtttggggtcgtcgcggcgttcggcgtcgagcgttttcgagttgcgtttcgcgcgcggttcgcgttatttgtgtcgtcgtcgttttagtcgtcgagggcgaggtttttttcgcggcgcgcggtagttttagtttttatttaaatttcggcggtcggttcgggcgttcggttagtgagggagcgttcgtttcgtcgtcgaaatcggtttcgggtgcggagtatgtttagtgtcgtcgcgagagcggcgtttcgtcgcgcgcgttttattttttttggttttcgcggtagtagcggtagtcgcgggagagaggggaggaggtcgcgggttgggagagggtcgagtatttttgggaacgtacg

SEQ ID NO: 6420 - DNA, 1154 bp, synthetic construct; identical to SEQ ID NO: 6419
  misc_feature 1..1154: note = Description of Artificial Sequence: Synthetic polynucleotide
  source 1..1154: mol_type = other DNA

SEQ ID NO: 6421 - DNA, 396 bp, synthetic construct
  misc_feature 1..396: note = Description of Artificial Sequence: Synthetic polynucleotide
  source 1..396: mol_type = other DNA
tcgttgggaagggaaaaacggtttatatcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagggcgaaagatcgtcg

SEQ ID NO: 6422 - DNA, 438 bp, synthetic construct
  misc_feature 1..438: note = Description of Artificial Sequence: Synthetic polynucleotide
  source 1..438: mol_type = other DNA
tcgcgtggagagaaatgagttggagagttatatcgagttaacgcgggatacggttttcggttcgggtcgggttaggggtgggaggcggttttttatcgtaggcggcgggatttttatgcgtcgagggatttaagtttttattttatttatacgtttattcggcgtcggggcgttgcggtttcgttttacgagtttagagtaggtcgtagtttgggttggggattcggtatttgggtagggtgagtttggtcggatatttttttttaggattattcgtattttatagtcgcgttaaaagcgttttatttttttgtttttcgtcgcgtaggttttttatcgacgttcgttcggaaggcgagagtttttacgtggttcggcgcggcgcggttttcggggatcgcgagtaataaaagttcggttcgtagtttttgtttttcg

SEQ ID NO: 6423 - DNA, 438 bp, synthetic construct; identical to SEQ ID NO: 6422
  misc_feature 1..438: note = Description of Artificial Sequence: Synthetic polynucleotide
  source 1..438: mol_type = other DNA

SEQ ID NO: 6424 - DNA, 411 bp, synthetic construct
  misc_feature 1..411: note = Description of Artificial Sequence: Synthetic polynucleotide
  source 1..411: mol_type = other DNA
gcggtggtgtcgatttatttgagtagttgtttcgcgtttagttcgtcgcgcgtagtggcgtgcgtcggttggatggtttggtttatgattatttcgtcgggcgtcggtcgttttatggttagggcgagagcgttacgtttgcggttttcgatattttattatgttcgtttcgttcgtttcgtttttttcgtttagttttagagggtattggcgtcgttcgttcgggtcgcgaatttttggtcgttaggtggtgggagttgcgagtgagggggttcgtattgttattttaggattatcgcgagtgggggaaaattagcgttttcgggttttaggagaagtttgggaagtgcgcggggagggggttttcgggtagataggtttggaaggcggtttttcgagagtcggagcgcg

SEQ ID NO: 6425 - DNA, 1137 bp, synthetic construct
  misc_feature 1..1137: note = Description of Artificial Sequence: Synthetic polynucleotide
  source 1..1137: mol_type = other DNA
tcgcggttaaaacgtttagcgtcgggtttgggtttgcgaacggtttagtttaggttttgcgttagagtatcgtattcgggggcggacggttttgtagttttttagttttttttcgtattaattagttgacgttcgggcgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcgttttttatcgttttttttttttttgtattttatttcggtatttcgtattttttttttcgttcggtttcgcgtattttgtttagattttataagtattttttcggggtatttaggattcgacgtttttttcgcgtcgttagcggcgttcgttatttttggtacgtcggagggatcgttttcggttttttgcgcggcgttttttaggggatttttagtttattttttatttagttgttcgggtttcgacgttttatttttgtcgaattgggggatatcgaggttgagttcgattaagagttagacggttatcgagcgttttatgatttcgtttttcggacgtgatttcggttggttaggggtcgtcgcggagggtagtgtagtcgaggtggtagcgtagggtagtagtagatttcgtttttattaaagaatttaagaagacgttttttttttttagcgttttgttaaataaatttttggagagggcgagagtggtgattaaagagaggagttttttttttttttttgtttgcgtttcggcgcgcggaggtgggtgagtttcggggagtcgtcggcgggtttagtttttcgttgcgggtgggtttcggtagaggcgcggcgggcggggcgcgggttttcgcggtcgtttcgggtttgttgcgcgggtaggtagatttatcggtagataggcggatcgggcgttcggttgtcgttgtttttcgcgcggcggttgcggggtttttgatttggagaataatgaagcgtgagttggaggggagcgagcgggtcgtcgggagcgtattgtgtataaatagaggcggcgtgcgtgtgagtttgagtttggtaggcgcg

SEQ ID NO: 6426 - DNA, 2383 bp, synthetic construct
  misc_feature 1..2383: note = Description of Artificial Sequence: Synthetic polynucleotide
  source 1..2383: mol_type = other DNA
tcgacgtgttaaggaaagcgcgtcgtaaggtggagcgttcgggttgacgatgagaaggtgagttgtgaattttgtatacgtttttaaataaaaggtttacgagcggcggtttcgacgtggggagtaagtaggtttttttggtttttgtagtaggcggatttaggttcgtttgtcgtcggatatttagaatttgttttcgtagcgcgagttttgtatacgttttgcgatcggtatttttggattttttaattattcgtcgtttaattttcggagagagggtttttcgttcgttgagttgcggggttgggaaggaaaagggggacgcgtttttgggggtttttggatattttggtaaagggggttgtagttttaggttttagttaaagggtttgggacggagtgggttagaaagtcgttaaattgaggattttttttttttttaagtcggagttttaggtgcggagtcgtttgtttatttattttcggagtacgttttgttgttttcgtcggcggacgcggttggttattgcggtatttttttcgcgatattcgggcgttagaaattcgtttttagagtttgttgtagcggatcgaatttgttgcggcggcggttggggtcggggcggtttgggcggaggaggttgaggttggtcggtcgtgttttgcgtttagagtattatatagtttagttataggaagtagagttggagatatagttttcgttttttttttatcgtcggcgtcgaaagcgcgcggtcgtagattcgcggagagggagtgattaaagataaaatttgcgcgttttagaaaagagttagggtttaataagtttttcgtcggtttcggggattttttcgggttcgggttttttgttttagttggagatttcgatagagcgtcggttttttgattgtttgcgaagcgagacgcggggcgtcgggtttagcgtagtgagcggcgaggcgcggcggaggtgtagtcggtagtttcgagcggtatacgttgtataatcggtttaaagtttcgagcgattttaggatcgttagcgggcgggggaggaaattataaaagttttggcgtaaaattttaaaaaatgtgaattttaaaagaaaaaagggtttgtacgtagagttcggcggattttcgtgcgtttcgaagacggatattggaaagttgtaaaagttattagaaagaaataggtaagtaaataaaagtcgtttttagaagaagaggagggtttttttcgggttcgttcggagttttatagggtaacgaagcgcgggtagcggttgcggagtcgggcggaggtgcgcggggtcggggcgtgcggttagtaagagagagggcgggaggttgggcgttggagaagatgcggcggtggagggcgcggcgcgggggttttagaggttcggcggggcgcggggcgggtcggcgggcggcggttgttagtgggggcgcggtcgtttatacgtggggtttaattcggattgagaggtcggcgtagagtgggcggggatagagtaagggagagatcgggattgaggaacgaggggaattagggttgggtgaggggaagaggaaggaagggggggagggcgaagggagggaagaggacggagattggggagaaggggggcgaattcgagaggaaggtcgggttggaagagggatttggaaagagggattggcgagttcgggtgcgagaggaaatgagcgggggatgggggcgaagttagggtaaagagagaagtgggaaaggagagggagggttaaggttcgggcgtcgagaggaggggttcggggggtcggttggagggggcgaggcgttaggcggttttgtttttcgttttcgttaattggtcgttagttttgttttgattgtttgtataaagcgagtagacggcgggggatggggcgattagggatcggatttgggaaaggaggtagtagttttttttttttttttttcgttttcgttcggtcgcggattagggattagggtgtttaagcgcgttaggtttggtcggattcgtagttgaattgattcgtagttgaattttttcgtcggatagaggtcgtaaggttgaggatgagaacgggtttttttgtagggtttcggtttttgatttgggatggggggattcgtagttagttaggaatagaggtttacggggttgttggttgtagttttaatttaagaaggaggagattttttttttgtttttttatttttatcgttttatcgggagcggcgttagtttgcgggattaaattaggggttgggagtttttagattgaaatgcgttttttattattaagagggagtttacgcggtcgcggggggtcgaggtagttagtcggcgtcgcggttttggggagttcg

SEQ ID NO: 6427 - DNA, 2367 bp, synthetic construct
  misc_feature 1..2367: note = Description of Artificial Sequence: Synthetic polynucleotide
  source 1..2367: mol_type = other DNA
gcgatttcggttttggggttttgtttttgtcgcgggagaataggttttaatttacgaagttggttaattttagaaattcgagattcggtttttgagaagcgattgcgtgtttcgggattttgcgttaataattaaatttgggagaagtcgcgggaatgtttttattggacgttacgaagggaattggggttttttttttgggaagaaaaagttcgatttgtgtcggcgagagtaggttgttttgggttgggggtattttcgagcgttgcggcgggacgtcggggttcggggcgaagagagttagggcgcggatcgacgtttgttgtttttttgcggtattgttgttcgaacgaacgaacgaacgaacgaacgaagcggtttcgtttaggaaaaatatttttttgacgcgaagttacggttgaagtttcgggttacgtagaggggttagtaattttatgggtggtggggttttttatttttggacgtagcggggagtagcgggcggtttttttttttgtttattttttttgggggtgggggagttttgtgttattcgacgttgcgaggggttgttacgggttttttaggttgtgtttttcgcggggtcgtggttcgtgttttcgaggttgttatttttttgaggtgttcggagttaaagtagagggttgatttcgtcggttgggtgaggtagtattcggtgacggcggttatgattgtgttttgggcgtaggaacgagtttttcgcgttgtttcgaaggtttttgatttttcgcgttttgcgttgtttcgcgtcgtcgggtggatttatatacgttaggagtaaattgcgtaggattcggtcgttatttttttgcgtttttttatcgcggagattttgcgtttttagtttagcgttttttattttatttgggtagcgttgcgtttgcggttcgtgggtttcgggttcgttcgtcgcggattttggtttaggtttcggtttcggttggggtttcggatttagttttggttttggtattgtacggtttttcggtttttgttggttcgttatattttagcgcgcgaggtcggggttttttcggttcggttcgtttttttcgtcgtcgtcgttcgtcgttcgcggggaaggcggggatattggtcgggaggcgggaagggtggggggaggggaagttaggtgttcgtcgggatttgcggggagaggggcggcgcgtagtttcgtcggttaggggttttggtttttttcggggcgtaggttggggttcgcgcggttggcggtcgggtttcgaggtcggggagcgcgttttgggattttcgtggaggggttttgtcgtatgcggacgaagttagagcgggttttagtttggttttggggtattttttttttttgggtttagttttttatttgattcgtgaggggttggttttattttcgtttagacgggggttggtggtcgagtttggggttttgagattggattttttttttttttgtttagtttgcgggagggagttggttttgcgtgttggtagggagagttcgttgtttagagcgtggtagttagggaggtttgaggatagattttaggttttttgtgtttgggggtagggggtgttagggtggggtaatcgttcgatttgttttggttgggggaattgtttttttttttttttttaggggttgggttggtgaggaaagggtatattaattttttaggatagatatttttggggttttttgtttaatttttatgtttgtatattttttagcgattattttgttgcgggtttgcgaacggtgacgtttttatttttgtggtttcgtaggtcgtttttggttggttgtcgttgggagacgggttggacgtaagggaattgggagtttgttttttgtttatttttaggttatagggttttttagcgttgtttcgtggttagataattttgtgcgcgaagttttatggtggaaattagttggtcgaatttatttttggtatttcgaagtgtttagtttgagtttgtttgttgttgggattatgggatgggattatagggtaggtcgggttgtggtttgttttttttagggattggagcggttaagtttgttcgtcgacggttacgggttttagagcgatcgttttcggcgtaaggtgtcgggagatggtagcgcggtagtcgggtttgaattttttatgagatgtagttagtagcggcgtttttttgtttggttttcgtcgatagttgttgcgggagaggtcgcgattcgcgttatttcggcgttttgttagttcgtgtttttagggtcgtttggtttgggaacgtagagatttacgattttttttttaattttcgaagcgggaagtcggttcg

SEQ ID NO: 6428 - DNA, 1235 bp, synthetic construct
  misc_feature 1..1235: note = Description of Artificial Sequence: Synthetic polynucleotide
  source 1..1235: mol_type = other DNA
gcgttagcgcgtgttttgtttagagagttcggcgttagtttatttttcgtgtagttattggttgggattttgtgtgtcgttgtcggttaatgaagacgttggagatcgggtttttgttcgttttttttttgcgtttcgggatgaggtagagattgaatagtcggcgagtaaattaacggtatttagaaagttatgtcggattcggcgtttagcgtttaagcgttaattcgttgaaagttttttagcgaaattttagggacgatttggatttcgttgagaggaattgtttttgagtgagatggttttagaggtttggaggagcggattggtaagtatcgggagggtagtgggagttttgtttttgtttggtgttttgaataaggtttttacggttatttattatgagatttcggaggaaagagagaagggtttcgttgtgggtaacgtggtcgcgaattttggtttggatttcggtagttttttagttcgtaggtttcgggtggtgtttggagttagtcgaagattttttgaggtgaatcgggagatcggagagatgtttgtgaacgatcgtttggatcgagaggagttgtgtgggatattgtttttttgtattgtaattttggagttggtagtggagaattcgttggagttgtttagcgtggaagtggtgatttaggatattaacgataataattttgttttttttatttaggaaatgaaattggagattagcgaggtcgtggtttcggggacgcgtttttcgttcgagagcgcgtacgatttcgatgtgggaagtaattttttataaatttatgagttgagtcgaaatgaatattttgcgtttcgcgtgtagacgcgggaggatagtattaagtacgcggagttggtgttggagcgcgttttggatcgagaacgggagtttagtttttagttagtgttgacggcgttggacggagggattttagtttttttcgttagtttgtttatttatattaaggtgttggacgcgaatgataatgcgtttgtttttaattagtttttgtatcgggcgcgcgttttggaggatgtatttttcggtacgcgcgtggtataagtttttgtaacggatttggatgaaggttttaacggtgaaattatttattttttcggtagttataatcgcgtcggcgtgcggtaattattcgttttagattttgtaatcgggatgttgataattaagggtcggttggatttcg

SEQ ID NO: 6429 - DNA, 3043 bp, synthetic construct
  misc_feature 1..3043: note = Description of Artificial Sequence: Synthetic polynucleotide
  source 1..3043: mol_type = other DNA
gcgagggtttcggggtggtgggggtgtcggttttagtatgtggaggcgataggattcgtaagattttacgcgtcgtcggggtaggatcgtatagggtcgttatttatttatttggggcgtttttaatgggtattcgtgtattttagttcgtgcggtgagcgtacgtacgtcgtcgttgtcgcgtttatacggttttttaaagtcgggggaggggtcgtggagcgaaggagttgtaggtagatttttttttttttttcgagttgggaaaagggttagtttcgtgttttgtacgtttggttttgttttgtagtttgtcggtgagttaagagtcggtagagtagaggaggcgtacggttcgggtcgtgttattattttttggtttgttgatttggttaggagttggggatggcggtagtatcgcggaggtacgttttgcgttgtttttacgttttttttcgaaagtagtgtttttagggggaaagttcgtaatgttatttgtttcgtcggtaaagttttgggatgtcgggtattttttgaggagggggaagacgcggtatttttattgaggtcggtaggttaggaagagaagtttttcgggcgtagggcgtagtttagtttcggggattttttgggtttttcgcgtgtcggtcgggatgaagcgcgttttgtatcggattcgggattcgggggcgggggttggcgttggtagcgttagacgttgttttattttttttcgattttggggaggatagtaataagttttgttttagttattttattattttgttagtacgtgtagatttcgggttttcggagttcggcgcggatttcgttttgtttcgcgtttttttttgtacgtttcgtgttattttaagagtttgcgtggttttgggtgggcgtttggttttcggcgaaacgtttggggcgcgtcgcgtgggtgtacggtgtttttttttagtagttttcggttgcgggggtatatgtatttatttgtattttgtagggataggcggtttttttgttgggagtttttgttttggggattttcgggtgggttggtggcgtcggtttttcgcgtcgggttaaaggtggttaatattaaagttagggttatgaattggtttagtcgttcggtatatatggtttttggtattaatttttcgtcgggagatttggattttttgtgttttttttttttttttttttttttttttttttcgtcgtttttttttttttttttattttttttttttgttcgttttttttttttttttcgcggtcgcggttcggatagaggttatttagcgttttttcgtagtttttcggagagtatgtgattaggtcgttagtagcgtcgcgagtgttcggtaatggtagggatggtgttttaaatatttttggaagttttggtgttatttgaatgaaggagtcgagtaggtgttgtttcggcggttggattaattcgagatttcggtttttttgataatacggtcgggaggcggggtttgcgtttaattattataggaggaagtcgagcgtcgttgggagcgtcggataaagttgtcgatttggcggcggttacgcgtttgcgtgcgtgtgtatgagtgtgtgtgagcgcggtcggagatgcgtgcgcgtgtgcgggtgttttagggtaatggtcgaaaggattgtataatataagagcgaatttaagttttagttgttgttaaagggggacggtgtgttttgggatagtgtttttggggtttttggttcgcgttatatttatatcgggttgggaaagtttttttttttcgtcgtttggaatttagtgagatttttagtttagaggatttgataaattgaagtagttttttaggtataatgatgttgtgggttaattgagtatatatgggaatttttggttttgtgatattttgtattaaaaagaattttacgattgaagataggagtagaagtattagatatagtatttggtttgagtaattgttttattttttcgttttggtgggtcgtgtaatatttggagtgtcgtttttcgttttttttttaatttagacgtattttaggttgggttgtagggatttaggtgatagttaggatttgtattatttttaggagggtggtagggaggtttaaggtagttttgagttagttcgtcgcggagtatcgcgtgttcggaggttagagtttgaaaggtaattttacgcgtttttaaatatatttttgtatttttttaaagcgttgttcgttatttcgtttcgggtttttttttattttttagttattcgatggaagtggtgagaataaaaataaagataaaaaagttaaattcggggaagttatttttattttttttttttttttgttcggttttttttttaagaatcgtcgggtcgggatagttttcggttatttttttattcggttcgtggagggaaggagaaagttgggcgtcgtttggagcgtttttttttttgttgtgtgtgtacgtgtgtacgtttacgtttttttcgcgtcggggtcggggataggaattgttttcggtttcgttattttacggcgtagttcggggggttcgtagggttgggggagggcggggatacgagcgtcgcgtttaagcgttttagggtacgtattcggcgttggcgcgtattcgttttttttttcgtttttattttttttttggagaataggtgagtttcggtattagttttcgattttttattttcgtttcgcgtttcgttcgcgttttttgcggtaatgcgtttgggaagttttattatttattgtttaggcgacgcggttttgggttttcgcggcggggcgtattgttcgtttggttggggtcgttatgtgatacggttgggggagggggcgaggagatacgcgggtaggttattttttggtcggcgtttgatttttaaagtttttttttttcgtgtttcggttgtacgcgggagtggggaaggcggaggcggggggttaggatggttacggttggtcgtagttattcggcgtgtcgagtttttttgagtcg

SEQ ID NO: 6430 - DNA, 864 bp, synthetic construct
  misc_feature 1..864: note = Description of Artificial Sequence: Synthetic polynucleotide
  source 1..864: mol_type = other DNA
tcgtaggcgcggagttgcggttgtagttattagtttagacgtggcgcgttcgtagtaagtggttggatatcgtagattaggttcgcgtttttagtagcgcggatttcggggttagtcgtttaggtagtaaagttaggcggtcggtttcgttagtagtcgatgagttttattttgtggattgtttagcgttagggattaggattcggagaggtgtttaggaggagtagatttttagattaggtaggttgtgtattcggtgattttgacgttatttaagggaagtttcgttatttcgcgttagtgtttgagttgtaattgtaaattgcgcgttttggtacgagtagcggtgggggcgggtgggggaaggagcgagtgattttttaggcgtttttcgttatttgatattagttaggtagtttttagggttagagcgttagcgtcgaagttaggtttattcgggaagttatttcggtggtcgcggggtgtttatgttagtattagattttttttcggaaggaggagcggggcgggttatacggttaggcgggttttttttttaaggcggggtgggtcgcgcgtttgcgatttttcgttcgtggttttggggtagttcgggttagttaggagaattcgcgagtttagcggcgtttgtatttgcggttttcgggagtcgggcggttttgcgaggtttattaggtttgagaggtcggaggtcgttagtgtcgttgttgaagggtggattaggcgggatcgcggattttgggttagatcgtagatttggtatcgcggattgggatttggatcggggattttgagttggattacggattgggggttggatcgcggattgggggttggatcgcg

SEQ ID NO: 6431 - DNA, 2071 bp, synthetic construct
  misc_feature 1..2071: note = Description of Artificial Sequence: Synthetic polynucleotide
  source 1..2071: mol_type = other DNA
gcgagagtagcggagagaaaggagttagagaagtgcgtatttattagtttatcgtagttgttgagcgttatagaggaggtttcggttaggtcggttacgttttcgacgtagagatagttttcgagtaggggttttacgcgggtggtgtttttttcgttttgttattttatagtggtttcgggcgttacgaggcgggcgttgggtcgtagtcgtaggtgtaggtttcggttaaagatcgtgatattgtagaagaggtgattgttaggttttttttcgttgttttcggggaagttcggggttcggatcggggcggttttgcgggttcgtatttttgttttggacgtagttgtcgatattacgtgggatattaagcggttttgggcgttagtgcgtacgggtatcgttaggatgcgtttcgtttcgtgttttaggggttcgtttgtaacgggaaggggcgttagatcggcggagattacggagttttagtgttttagagattcgtcggtaagttacgtttttttagatttcgttttattgcgaagggaaggggtatttcgttaggcgattttagaagttagtttgtattttttcggtttttttgtaatcgggaaggggcgttaatagggttattatttcggggtttcgttattttttagtcgttttttttttcggagattttgtttgttaagagttttgttttttgtttcgtttagggttggggttcggtgggaattttttcgtgttcgaagggacgatttcgttagagagtttttcgatttttgtatttatcgtttttggtaggacgtggagttgttcggaagttatttcgggttggtttttttattcgtgtgttacgatttttcggcgggtttttgtcgttcgagtgtttttatcgttagttttcggagcggcggagtttcggttttttcgagtacgagcggtttgttttgtttgtttagttttcgtttagttcgttgtcggtttcgttttttcgagcgttcgaggattgggaggggtggaatagggttttttcgattttcggggattttttgcggggcgttttaattaatttttagggtttaaggttacgcgttcggtagtcggttttttcggagcgttttcggacgcgagtttcggcgtcgtttcgttttggtttttttttcggattcgttggggttgattttgcgtttttggtcgcggggtttttttcggtttttcgtttttatttttcgcgatttaggagtcgttagtgtttcgaggttttttcggtttaaggcgttcgggggcggtgcggggcgttttttgcgcgattaattcggtttcgaagttggttaatttggtttcgggcggggcgcgcggagtttgtttaagttaggttggacgacgtttggggagggggcggcggggtacgcgggatagggttaggtcggcgggggtttcggggagtaggggtcgggtcgtatttatttggggggtcggcggcggcggcgagtttggcgttcgcgggcggcggcggcggcggtaggagcggcggcggtagtagtagtagtagtagtagtagtgcggggtagagtaggcggcgagcggttttcgtcggcggatttatggtagtcggattgtagtcggggtttcgtattcgtagtcggcgcgaaagtttttcgcgagtcgtttagtttatatttgggggtagttggagtcgttcgtagttgtagtatcgtagggcgcggggcggaggaggcgaggcgcggaggggcgggcgggggagcgtggagggaaggcggggagagggaaggagcgagcgagcgagggaggtaggcgggagggagggaggcgagcgagggggagggcggggacggcgggcgttttagtttgcggtgattcggcgtattttggcgcggtcgtcgtcgtcgttcgttttttttttcgcgtcgtcgtcgtcgcggtgtcgggttcgtagcgaagtagagatatttcgaggcggcggtagagaagcgtcgcgggtcgggtcgggggagtttcgtcgttagttattttaggggtataattttcgaggagcggcgtcggtcgaacg

SEQ ID NO: 6432 - DNA, 1170 bp, synthetic construct
  misc_feature 1..1170: note = Description of Artificial Sequence: Synthetic polynucleotide
  source 1..1170: mol_type = other DNA
tcgggttggcgggtattgagttggggttattacgtttttttagagcgtttgcggaggtggcgaaggtttggagagtatacgaggcggaattcggatcgagtgagttttttgagtcgtttgcgtgggacgtagggagagggcgaataacgtttttaggcgttgaatgtaggggtaaggagttagcgagggtggttggagtaggttttgttagttgttattaagtttttttataggtttgggggtttggggttttttggaaagattttttcgtcgcgttgattagtacggggttcgttttcgtattttgaaggttgtcgcggtttttcgttatttataattaagtttaagattaaggttgtaagttgaggtcggggtattgataacgggaatgaagttataggggaagaggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggatttttgcgtggtttgggaggtaaatcgggcgtttttttaagtcgttttaatatgatttaggtttttaaatacgtgaaagcggtagatataatagggatgcgaaggaaataaaaaataattggggaagtggtgttaagttatttaggttttgaattgaggacgagtagtgcggtcgcgtttggggcgcgttcggaaattatttttagtttgtggcggttattgttttatttaaatttttttgcggggagagttgagcggatttttggggggttggttttgggttagttttaaatttttcggttgtatttcgcgtggttttatcgacggcgcgtttcggcgtagtttttggcgcgggttcg

SEQ ID NO: 6433 - DNA, 2168 bp, synthetic construct
  misc_feature 1..2168: note = Description of Artificial Sequence: Synthetic polynucleotide
  source 1..2168: mol_type = other DNA
tcgcgttgtagttaggtagagtttcggggtagttcgtttatcgcggaggagttattttggagttttacgttttttttatattttatttatggattggaaaggatgtttagttattcgcgagtttgtttgatattgggatggaaagttatagttcgtaggttggagtgaggcgcgggaagatgtttggtttttgtttcgcggatttggtagtcgcgttttgcgggtttgtttattgaattgttgaggattcgttcgtgtgcggggattcgagtgttatttttcggagcgttattttgcgttttagtttttaggttagataatatttggaaggtagggtagggttgttttcgtttttattttttgcggaaggatggtaggattcggcgtagcgacgtagtagcgggagggtatagcgatttgtatttttagtttttttttaggatataaggttgattttatttttcggatagttgtaaagtttttgttagaattaaatcgaattcgcgtttcggagaggggtttttggggtcgtttcgttgtagggcgtggggagtggagagagggaaggggaagtttggggttgggtgtgcgcgcgtgggagcgcgtttcggagcgtttcgtatttttttattttattttcgggggtagtttgggaaggagggagtggtagtcgcgggaatgagggagtaagagaaatttttttaaagtgacgttttaaataggttcggatttagaattcgaagttaaaggttgttagaaattgggatttttcggttttttttgtagttttttttttttcgtttcgaagttcgggcggtttgttggttgtttgttttttcgttttcggtttagaggtttttggttggcgggcgtttcgtcggtcgtcggttttttttttgaaattcgtcggcgtatatgaggtcgttgttttcgtcgtaggcgttggcggttttttcgcggtgttcgtggtgatgttatgtttcgttattacgcgggaggagaggagggcggcgtcgtcgggttttgggtgaagagcggcgtagcggcggcggcggcgggcggggggcgtttgggtagcggtatgaaggatgtggagttcggtcggggtagggtgttgttgaattcggtagtcgttaggggcgacggtttgttattgttgggtattcgcgcggttacgttcggtggcggcggcggtggtttgagggagagtcgtcggggtaagtagggggttcggatgagtttgttggggaagtcgtttttttatacgagtagttagagttgtcggcgtaacgttaagtatcggcgggtgtagaattatttgtataacgtgttggagagatttcgcggttgggcgtttatttattacgttttcgtgtgagtattcgcgttttttgttatgttcgttgtaggggattattgtttttggttttttggggcgtgtttcgcgttcgcgtttttgggttttcgcgcgcgtgtatacgtggtggtttttattttttcgtacgtgttcgtggttttttttttggagtttttttttttttttagttttattttttttatttttatagtttgaatttttttttcgaggatatttaatgaattgttcggtagttttaggttttcggggcgagagttaggtagacgcgggatttaggttgcgcggataattgggagtaattaggttttaagatacgtaaattttaatcgaacggggcgttcgggagttagggaatgtaaagggaggataggcgttcgtgtgaggtttgagagtatattggagaggttaggaggtgatggcggggtaggacggggagaagtgagggggtatcgagggttaggtttttagttttaggggcggagtaggggaagttgttatttggagagagttgttaggttttaagcgcgttcggaaatacgtttcgttattatttagttattattaacggaaaatttgttagtgtatgtagttttttttgttacggagaaggtggttaaggtttagaggaggttagtaggttaggcgaagtaacgttttcgcgttgtagggggcggggaggtagcggggaatttggggcgtaggaacgcgggcggaggtgcgatagtagaagcgtaaatgggtcgtttttgatagagatcgggtagtgggttaagttttcgtttgtggcgcg

SEQ ID NO: 6434 - DNA, 2053 bp, synthetic construct
  misc_feature 1..2053: note = Description of Artificial Sequence: Synthetic polynucleotide
  source 1..2053: mol_type = other DNA
tcgacgtacgattcgtttatacggaataagaattttacgaaggatatttggggattatattggtcgtattcgagggggcgggaggcggaaaaagtatttttaaacgtaattttgttaggttttatttttcgtattttttggttttcgggatagaagtttttttggtatttttcgtttagtttaggggttggttgttcgttagaacgaaatattttttattgattacggagagttttgtagggagtcgaggttttcgttcgggttaagggaaggcgttggcgtcgcgggagataagaagaggcggaggcggaaaagaagtggagaaggaaggggtggtagagggagtagcgtgcgggaggcggcgtcggcgtcgggttgttggcgaggcggggtggggtggagtggggtgtgttttcggcgggcggttagtaagttagttcgttcgagcgtcggcgtttcggtttttagcgttcgttcgcgatagcgatcgggattggcgtttcgttgtttcgatcgtcggcgagtttcgtttttttttaggttttttattgggttttttcgcgagtttcgtttggttcggcgtggggtcgttcgttttcgttagttcgggcgttcgtcgtttcgtttcgttcgcgtagtttttgtcgtttttttcgttcgcgttgtttttggttttttttcgttttagttttatttatgaagcgcggttttattacgtgttaatgagtttttgttttgttttggtagcggcggcggtatagatttcgtcgagggaattgcgcggggagggatttgagcgtagcgttcgtagttttaaattttgtttggggcgggggattcgtcgcggcgttagttttggggttagaggggataagttttttcggttcgcgttatttatttttttttttttttttttttttttgtcgtcgcgttttcggaggttttcgttgttatgatttcgttgtgttttcggatatttttatattttgattaggttaagaaggggttggtgtatgcgtcgtttacgatttcggggttattaattatacgttttcgggtagcgcgtatcgttaatatttttcgcgggggttacgtttggggtagcgggttgagtcggaaggggaaggggagcgggagtttagaggtcgaggcgcgtcgggttcgggggtgcggtttcgcgtttttttttttcgcgtaaggtcgttttcgtggtaggcggtagcgagttgggttcggggtcgggttgagttttgggatcgcgttgcgtagttttcgagtcgttcgttatttggttgcggtcgcgcggttatttgtttttcgttttcggggcgtcgtttagtttcgcgttaggcgttttttttagcgttcgtcgttttttttcggcgagattattcgggcgcgtttcgttcgtcggttttcgatgtaaatagttgggtttcgtaggcggttggtttcgcgtttttcggttcggcgcgtttttttttcggttattcggggtttcgtttttcgtattttttcgttggaggaggacgttttattttagggtcggattgggggttttgggattcgggggcggtagcggcgggcgtttggggagtcgcggtgtgtttagtagtcgcggtaggaattaggggatatgttcgttaattgtttttattattagtcgtcgtttgttttttgtgtgtacggattaaattttaattggtttttatatttattatggtgaattgcgaatttttaaataagtttgggtcgtcgtttttgtcgaggaggcgtttttttttttttcgttttcggggttttgtagggtgtgcggcggcggtcgtggttatttagatatttttatttttcgtgagttggatcgggagaggatcgtacggtttttatttgacggagttacgttacgtcggttataagggtttcgtgttgggcgttgggttcggttttcggtcgtttttttgtggtcgttttggcgtttattttatgatattttgtcggtgtttttagatattatttcgtatcgtttcgttttatcgatttttaggttttttcg

SEQ ID NO: 6435 - DNA, 1679 bp, synthetic construct
  misc_feature 1..1679: note = Description of Artificial Sequence: Synthetic polynucleotide
  source 1..1679: mol_type = other DNA
gcgtttttattgcgtgtttagcggcggtggaggcggcgtttttttgtattacgaatacgcggttcgttaaggcgtcgttttagcggttgatggtttcggtttttttttaaaattttcggcgttcgatttcgtcgcgtttttttaggtaggaattttgcgattttattttttgggttcgttattagtttaggtttgcggtgcgcgggagggtattaagcgcgaggtttttttcgcgttttcggttatttcgtcgattttaggtaagtgggggtagtttaagaagggtaaggagtagttggatcgtgttttggatatgagcggagtcgttcgaggataagggtattttttcggtatcgtgggcggtttttcggcgggggtcggtagtttggttttttatttcggcgtgcgtttagtttttaagttcgtcggtttagcgagggcggcggcggtcgtttacggcgatttttatcgggaggagagtagtagtaagtaaggagtcggtttcgttttgggtaggttgttgggcgggggtcgggcgtgcgggcgtttcgggagcggggagaattcggcggcgggcggcgcgggttattattattattattacgcgtattattattattattttaagtgtttgttcgttggggattcgtcgtcgtcgtcgtcgtttggtttgttttgttttggggttttgcgcggtttttttttgtttttcgttttttcggaagaggcgttcgtttttaagtacgtggagcgcgtttcgttcgtagtcgtcgcgttgttaggagcgcgttatgcgtagttgttttttgcgtcggggttgtttttcgagcgttgcgcgttgtcgtttttcgattcgggcggttttaaagtttattcgggtggtgagtgtagttatttgttcgtcgttatgtcggtttttatagtttataacggggagttgttttacggtttatcggttattatcgtttattattcgtttaaattgtatttcggcgggttgttgaagtattcggagtttattttttattttagcgggtttgtagcggtcgttttaagtttcgtcgagttggggtcgttggttagtatcgatcgagagatcgttatgtataattagtagttgttcgagatggttgtcgggaagggtcgcggacgtttggattcggggacgttgttatcggtcgtcgcggcggcgggaggtatcgggggcggcggtagcggaggtagcggcgtaggtaagtttaagatcggttatttgtgtttttattgtggtaagttgtattcgcgtaagtatgggtttaagatttatatgcggacgtatacgggttataagttatttaagtgtaaagtttgtttgcggtttttcggcgattttagtaattttaataagtatattcggttgtacgtcgagggtaatacgttttatcgttgcgagttttgcggtaaggtatttgtgcgtcgtcgggatttggagcgatatgttaagtttcgttattttggttagagtttgttcgttaaagcgggcgacggttcgggtgtcgagttcggttatttttcggagtttggggattttaagagcgacgatagtgacgtggacgtttgttttatagacgattagagcgatttcgaggttgggggcggcggggagcgcgatttgtaacgagttttttcgggaaggggcg

SEQ ID NO: 6436 - DNA, 1474 bp, synthetic construct
  misc_feature 1..1474: note = Description of Artificial Sequence: Synthetic polynucleotide
  source 1..1474: mol_type = other DNA
tcgtttttaaaggttcggggaaggaggttgcgggtgggtggcgcggatttcgggtttttagttatcggcgttttttcggggttttttgatttcgttttttaaaggaggagggttcgtggtaacggtttttttcggttaggcgttttcgggacgcgggggtgaggagtgagcgtcgtggtttattttatttttcgagcggggacggagtgggcgatatcgcgcgttcggttgtacgtaggttttgcgcggttcgaggcggttttatagggggcgaggaggaatttcggagattcggcggagagagtagagacggagtttattaaggggtttgtcgtcgtagagcgcgggagtcggtattcggtggggtcgagggttcggggacgttggggttgtttgatttgagcggcggtcgttgatcgttgagggtttttgtggtcgtagcgtttagattcggggagaagggcggtttttaagggtcgggagtttttcgagggcgcggttagcgaggagggatagagggcggcgttttcggttgttcgggcgcgtagaataagtagttgtcgttagggtcgataaagttgtttttcgaggggttgagatttaattttcgtttttcgatttagttaggggagcgcgaggtcgtatataattcggcgcggggggaaagtcggttgtagttgcgttttttatttttattcggttggtttttggcggggagtttgggtagcgtcgattaaagttcggagcggtagtttcggggcgcgggacgcggggtatacgggtttagttgttcgacgggagttcgacgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcgcgtttttcggcgggcggagttcggcgtcgcggttaggattttttatttcgttttcgcgatttcgttgcgggtttgtatattcgaggattcggtttgaaacgttcgtttatttatttttttgtcgtttcgttataagattttatttttgtttgggtatgagtggggggcggtagtttcgtgggatcggcggtattcgtcgtttttttttacggggataattcgagaagtgcggttcgggtagggagagaaattaggagagaaaatgagaaagagaattttcgtttttttttaaagttggacgatttattcgtatattttttttttgggagattcgtttataatttagtataaatagggaatagttcggaaagcgcgcgagttttcgttcgattgtggcgggggaggttgaacgtttggtttatacgggtgtaggacgcgggggttaggttttttgttgcggaggaagagggggaagaggtcgcgcgggagggatttttgatacgcg

SEQ ID NO: 6437 - DNA, 675 bp, synthetic construct
  misc_feature 1..675: note = Description of Artificial Sequence: Synthetic polynucleotide
  source 1..675: mol_type = other DNA
tcgcggtgcgaagtttcggattcgttgggaatcgtatagttttcggtatttttggtcgtatgtttgttagaggtgggtttcgggaaatatattcgttgtttttttaataagcgtttttcgttttttattggtttttcggttttcgttttttatcgttttttttcgtttcgtagttttcgagtggcgttagtacgttcgtcgggtatgggttttaaatgtttattagcgggagtttaggcgtttttgttttggagcgcggtcgggagtaaaatcgtaggagtgggagggtagcgagttagttggatttcgagtcgcggagcgcgttggttttgtttcgtttgatgattttagagcgcgggtttaagcgtcgtttatgtagtatttttgagtttcggggaaggagagttaatgaaaaaatatttaatcgttttcgttgcggagagttatgagttgtttggatgttatgtattaagtttatggtttttcgtagttttatttcgtagtcgtttatattttttattattaggtacgtgttttttttggggattttgggaaggagtgcgcgtttttcgtttgcggcggtatggtttgtacgttaaggtttgttgtgttttcgcgcgtttcgggcgttcgattacgatcggcgtagtcgggatgcggggattgtcggagtcg

SEQ ID NO: 6438 - DNA, 1133 bp, synthetic construct
  misc_feature 1..1133: note = Description of Artificial Sequence: Synthetic polynucleotide
  source 1..1133: mol_type = other DNA
tcggtttcgtagtttttcgcgtttcgattttttagattttcgggagtttaggggagttaggtgttgggcggtgcgttcggtgtcgtcgcgttttttttcgttatttttggttttttcgttattcgggtttttcggtcgttttggatgtttcggttgtatttttgttttatgattttagtttttttttttaattttttttttggttttttttttttcgagcgcgcgcgtatatatatattcggttcgttttcgcggagtggttttgggagtacgatcgattttagtttagtaaatcgcggttatgtcgtttagatttttcgtttcgaggtttcggttttcgtcgtcgtcgttttcgcgtcgttttttttcgtttagatatcgtcgtttgcggtcgtttgggcggtagtttttgcggtttttaaagttggttttttgggagggggcggtagggagtaggatgaaggatttgttgtaggaggaggatttatatatttgggcgaagggaggggtagcgtcgttgttgggacgcggcgcggattcgtattattgcgcgtagtagtcgttgtagtagtcgtcggggatcgcggagtcgggacgttttcgttcggttcgcgtttcgtttttcgttttattttcgttcgtcgggtttagtaacgtagggtgtttaggagtcgcgggttgcgtagggaggcgggtagcggttttcgcgcgtttttgtcgttttcggagtcggcgcgcggcgagcgtagggcgagcgcgcgtcgggcggcggtcgcgttggggggcgtgaggcgagcggcgcggagagcggtaggggcgaaatttcgcgggttagatgttcgagggcgcggcggcgttgttaggttgtcgttgttgtttttgcgggtttcgagcgcgttttcgtaggcggtattgttcgcggcgcggcgtgtgtatcgagcgagtgaaggtatgtgtggcgggcgcggttggagttgtcgtcgtcgtcgtcgtcgtgttagtaggttttaatgtttgttattttttaggacgttggtagtagtagtagttcggagttttcgagttttcggtaggtttgcgtgttttttttcgcgatttgattggataaagtgggggttcgacggtggtcgacg

SEQ ID NO: 6439 - DNA, 1808 bp, synthetic construct
  misc_feature 1..1808: note = Description of Artificial Sequence: Synthetic polynucleotide
  source 1..1808: mol_type = other DNA
gcgcgtcggcgttggggatggggtgggggcgttggggtataagggcgtaggggcgtacggttatcgatagtcgggtgcgtttagtttgaggtcgcggagaggagtcgaattgggatgggtggggggttttcggttttaatattgtttgttagttttagtgcgtttaagttttttcgttagagttgtttttttggaggggtttttcgtacgtattgttttttttatttttttggttggaatttttcggtcgttattgtagtgtttagagatgttgcgttgtagattcgggattttttaggcgttttttttcgtttttttgttaaagcgtaacgtttgtatttttttagtttttttttttttttttgaaattgaaagttattgaggtcgtttagggttgttgttttagtagttttttttttcgttttcgagttttttttcgttttttatagttatttttttttttttttttttttttgttttttttttttttttttttttttgtttttttttttttttttttttatgtggtgttttcgggagtttagtttaatattggagcgttttttgttcgcgtacgttagaagtagttcggggttttttcgtcgttttttggttatggtcgttgtgtcgacggcgttcgtttttttgcgttttaggggttttcgtcgttgtagtcgtagtcgtcgtagtttttgagtttaaggggtcgtcgttgtagtcgtcgtcgtcgtcgttcgttcgttcggatttcgtttgcggtagttgtcgtataatatgttatttgcggtcgtttcggcggtttttggaatttcggttcgcggcgatgttagttattttagcgaagtcgtcgtagtttagtgtttggataatttgaaagtataatagttggtttttttgtttattcgttttatttcgtttgttattatagtacgtttatcggatgtgagaggagaagtttcgttgttcgggtattgtttatatacgtttaatatttatatatattttaaaaatattaaatataattaataattaaaagaaagaggagaaaggaagggaagtattattgggttattatgtatttgcgattgattttttggttttttattattttgaattttatggaatatatcggtagttaaaacgtttttcggggaaggcgttagcgaagaagtaagtgtagggttttttacgcgtttgttttttttcgtcgcgtttatttgtcgggtcgttttgtttgttcggagtcggtttttaattgtagcggttttttcgttttgcgtttcgtagaggagatgtaggttcgggttttgggggtatggacggcgttttttatttttgtttttcggcgtttttgtttttcgtagtattttagtcggtgcgaggggcgggcggacgcggcgttaaggtggttttcgttttatggtaattttaggttcgcgggaaagttcggttttgggttagattcgtattcgggatttgtgttttttttttgaggatcggataggggtatttagtcgaaggtatttgggatttttagacgtaggatgtttttgatcgttgagtaaatgataagggaggcgcggtcgcggtattcgtttatttagcgtaatcgtttcgcgcggggagatttcggttgggtttttaggttggatttcggtagtcgaacgttcgttattcggttaggaagttagggagcgagcgtttgcgcggtcgtattttcgatacgtattagcggagttaaagggcgcgcgaggcgatggggttcgcgtgtttgcgcgtttgtagagttgtcggacgtttttcgttcg

SEQ ID NO: 6440 - DNA, 1323 bp, synthetic construct
  misc_feature 1..1323: note = Description of Artificial Sequence: Synthetic polynucleotide
  source 1..1323: mol_type = other DNA
tcgaatattcgtattgtttatcgaagattttcgtgttttagttttttttgttttttatttttttcgtttatggttttcgtttttttaagtcgtttttcggaattttttgtcgggtcggcgggaagcgtggatcgagcgggttttggtcgcgtttttttcggttaggtttggtttagttcgcgtagcgttcgcgtagttcgttagggggatttcggttcgtcgggcggtatttgaggagaaagcgttcgaggggcgtggagttagggttttgcggtgtttgtttcgggaatattgcgagtcggttggagttttttagtcgtttcggagaattgggggagtcgggtttttggttcggtaatcggtggtttcgcggtagttagaggcgggttttacgggtgggtgtgttcgttttcgtacgttagttttttagttcgggaagagcgtttgtaagcgggtattttgtttttaaagatgggttttgtttgcgggtgatttgggttttcgaagtgtaattttgtggtcgggacgcggatcggtcggtttgggtttttgtagagtagattttgtttgcgttttttaggaggagtgggtggtaggattggggttttttataggttttggggcggcggcgagattggtacggttcggggtcgtaggcgcgtagttacgtttttggaagttcgtttcggttttcgtttttaattcgttttttcggggttttatggcgtgaggtttggggttgggatttatttggagtcgagtagaaaattttttttttttcgttttcggttttttttgttttttttggacgcggtggcggcgtcgtttgagcggcgatttttttttttttgttcggtttgttgcgttcggtgtttttcgagggtaggcgcgtttggattttgcgttcggatggcggcggttttttgtgagtatcggtagcggcgtattttttgtttcgaggttttcggtgttttttcggcgcgggtataggggcgtttttatttttcgttcgtttgtattttttgttattcgttttttcgtttgatttattcgttcgcggtggtcgttcgagttttgggatggggagggagatcgcggttgttcgcggcggtcgagattttcgttgacgttttcgattttgtcgtttttttcgttcgtttttagaggcgttcgacgtttcgatagtttttggagtgagattaggattgagaatagggagaggcgattcgatttttagggttcggtgtttaggataggtgaggggaaggaaagggtgttgacgggagtggggaggtgggtgggcggttatcgtagtcgaaatcg

SEQ ID NO: 6441 - DNA, 1501 bp, synthetic construct
  misc_feature 1..1501: note = Description of Artificial Sequence: Synthetic polynucleotide
  source 1..1501: mol_type = other DNA
tcgatagtggtttttcggtttagggaggagagcgcggtcgcgggtttttttttttagtttggaggttgtagtcgttcgagtcggttcgggtgggggcggggtgggggcggcgcggagggtacggagattacggcggcgttattcgggatatttagggtttcgaggttttgggcggtttttacgcgagatcgtaaattatgataataggtagttattcgaggttaaataaaaacggagtgggtttttcgcgcgtcgtcgtttttcgcgtttttggcggtttttttcgaggttttcggcggttttacgagttcgtagtagtcggtggcgacgtcgttttcgttttatttttttgcgtaagtgcgaggttgtcggtagcgcggcgtacgtttcggtcgttttcggttttcgcgtaaaatttttattttgtttacgtgaagttgtcgttgttttagagagggggaaagagttgcgggaaaagtcggggagtgacgattgcggcggttgggcgcgtttttttattttttttttttttttttttttttttgtcgtagttcggagttttggttttttttttttttttttttttttcggagtcggttttttttttcgtttcgtttttttttcgtttgtgtacgttatttgttgtggggtggtcgaaggggatgttttgtttttattagaggtatagcgcgaaggggaaatttcgatattggaaggaacgagaataaatatttaattacggacgtattgaatcgcggttgggatagatatttcgggaattcgaggcggatcgggcgacgaggtgagtgatttttttttttaattttcgttttagggttttcgggggagtttgagttgagagaatttttaaatttttcgggaaagtgcgcgaggtttcgtcggggacgtcgagcgttgggtattgaggacgcgtagttggacggtgcgtgggcgtttgcgttttcggggggcgtttggaggtcgggtgttttacgtttgagggttcgggtcgttcggatcgtagcggtgttttttgttttagaagacgtttttaagttttaagggtttttttcgagtttgtttgtttttttcggggtcggcgcggagtttgcgcgtaacggagtttatttagtagtttagcgcgcggtttttatttgtatttcgtttttatttggtagaggcgcgagtatcggggttttttttatattttttttatgacgtgtattattttttgatgattttttagatggtttaggcgcgaggatgttgatttagagtttttcggagggttataggcgtttgggttttttcggtgtcgggtgcgtgtgtattttaaaggttcgcgttttaatttttaggtattgatcgggttttttaattgcggcgattttattttaatagtttttatgtggcgtggattgaatgttttttgtagtttgttagggtcggtgaaattagaggcgttttgttagagtagtcgcgtttattggttcgagtagcg

SEQ ID NO: 6442 - DNA, 1744 bp, synthetic construct
  misc_feature 1..1744: note = Description of Artificial Sequence: Synthetic polynucleotide
  source 1..1744: mol_type = other DNA
tcggtgggtcgggggcgtggcgagattttgttttagtggagggagggtttatgtattgtcgagacgtcgattattagattttgattttgtcgtttttagaaaaattattggtagaagattcggattatggttaatttgtcggttataagtttttttaagaagcgttacgtttgggtgtagttggtagggtatattggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttataggatttatttagaggaggagttgattaaggttcgtgagcggtttaagttgcggaaggatatgtataagaaaatgttggcggtggattttgaagtttttacggaggaggagtacgcgtagcgcgtcgttattaagtcgcgttatatgtagtggcgggaaggtattagttttagtattattttcggttttcgtatcgagggtattaaggtgaggtaggcgcgtttcgttggtatcgtcgtagttttattgcgcgttgtttttttcgatttttcgttttcgtttcgtttgttttttcgtttttttttatcgtttcgtcgttttttgtaattgggaggtatcgttgttttacgttgtttttttttttattggcgggttcggggtttttgatatttttgttttatatttagaaagcggacggtttttgtagtatcgattttaagattacgcgaagtcgagagtaggtgtttcgcgtttttgaagagtttgtgtaaggagatgaggaagtgttggtgagagcgggattttaaattttgaggtgttggggagtttgaagtcgaggattgtttttgttatttggtttagtgttttcggttgtgtttttattatggtttttatcgcgttggttcgtaattgttttacgtttttttttttttgggttacgttgggcggggttttgggttttttttttggcggtatttgttaagtatagcgtgggtttcggttttttatcgttagtaggggtttatttggcgtttagttaatttgttttttttttttattttattttttgtagaggcggtatttgaatcgtttgtagtagattcgggatattttggaggtattcgagttttttaggaggtacgaggtaagcggcggttgttcgggtgttcgggtcgcgagggttagggcgggaattcggtaagggcgtttttgggtagggtcgcggtttgacggtgcggggttcgtaggtgatcggtagttcgtttttttttgtgtacgattattgttatcgcgtcggcgtgtggtttatcgatttcggtaagattacgttttttttcgatggttagattttggattatcggcggttttgggaggagggtaatcgcgaggacg

SEQ ID NO: 6443 - DNA, 1801 bp, synthetic construct
  misc_feature 1..1801: note = Description of Artificial Sequence: Synthetic polynucleotide
  source 1..1801: mol_type = other DNA
tcgttttcgggcgataggggtttttttacgtgaatcgacgtttcgggtttcgggcgaggcgtagggtttagggcgtagggcgggtttcgtacgtagggcgggcgcgcgggtatttttgtggttaggcgatttcggttcgttttttcggagtttagggattttcgaggttggcgcgggttgttcgcgataaggtgttagtagtttcgggttcgcgaggagtagtttttattcgcggttttcgagtttagttttgttttttcgttattttttagtttttcggtatttatttagggagatagggaggtagagagaagaggagaaagcggtcgtgtttgtatttagtttttgtcgtagtattcgatgagggatagtagggaggttggcggggaggtagagattaaattatgattttatcgattacggaaagattattattatttatagtaaaggaggtttcgatgcgtttattcgggtagcgattcgcggttggtgggcgtttttcgttttcgttttttcggtggttgtggaatttatttcgcgtcgtatacgttaggatttttttttttttgattaaggggaggggaaggaataaaagagattttttattttttatatatatatatatatatatatatatatatatatatatatattttttcggtattttattgttggttaaaggatttattttcgtaatttttttttcgaatattttttttatttgagtagtgtatttttttaaaggtaaagagagataagggaggaaatatagtatttaaggtgattagtcgattggatattgttgatggtatatttttttcgtttttaattaatcgtataaaattcgtaatatttcgcgttttcgcggggtttttcgcgtttttggttcggttttttcggtcgtttttagtaggcgtttcgtttttcgcgggaattttgggatttggtcgagcgtttttcggcgggtaggatattcgttcggttttttgtagtagttgagggcggcgagcggatcgcgtttaggtagcgacgcgggatttaatttttcggattcgcggcgcggttttcgttttcgtttagggcgtcgcggttatagttgagattttagcgtcgcgtagtcgttttcgtcggggtatgggcggtcgcgtttttcgtttttttttttttttattttttttttattttgaaaaaaatttatttattggtgtaaagtagatattttgatgttatttatttagtatcgtttgttttggaggtagcgttttattcggtcgtttggaggtgtgggtagcgcgtcgatgggttcgggggagcggggttgggcggttcggttttttagcggagtcggtttgttgttattcgtttaattttagtatttagtgggcgaggagagagggagagcggcgaggatgtagaggagggggagggggaggagggagcggtgggcggggagggagcgagagtcgttcggtagcgcgtatgcgtttcgcgggtcggcgtagtttttcgttcggcgcggtcggaggggtagttttttagtttttgcgcgcggtcgcgagagtttcggtttcgtttttttttcgggcggttttcggtttcgttcgatttcgcgcgttcgtttgggcgcggcgtttatcgtgcggaggggttcggtcgggattttcggtttcggtgacgttcgttcggagtttcgcgggaggttcggagtttcgagagtttttttgggtgatagcggtttttcgttcgggtttttgtaattttattcgttcgtagttcgcgcgttgttgttttgggttgcgcg

SEQ ID NO: 6444 - DNA, 1801 bp, synthetic construct; identical to SEQ ID NO: 6443
  misc_feature 1..1801: note = Description of Artificial Sequence: Synthetic polynucleotide
  source 1..1801: mol_type = other DNA

SEQ ID NO: 6445 - DNA, 1684 bp, synthetic construct
  misc_feature 1..1684: note = Description of Artificial Sequence: Synthetic polynucleotide
  source 1..1684: mol_type = other DNA
gcgttgggcggtgagtttagttaggttatttttgcgaggatatcggtcggcggcggatagtagtacgcggcgtttaggattcggtttttttagagtttaggttattgtagtttttaggggcgtttcgagtttatttggagggtcgcgaggtttttaggttggaaggaggaatagggagaaggaggaatagggagatttggggtagtgttataattatagaaaagggagaggcgaggttcgttgagtttttggtttgggtaataaggtatattgaaaattgggttttttttcgattcgtatcgtgcgcgttttagaaatgatagttagacggagtagggtttaaggacgttgaaaatttttgacgtgggcgcgtcgggtgcgggtagggacgtggaaggattgggttagttataggaattatagcgttgcggatcgggtgaggggtttcggttcgagtttttatttggggcgtagaggtgtttttgtaaggggataaagggtatttttcggcgcgatgggcgatttttttagttagaaaatgagagggttagacgaggggaggaatttttttagttatttggttcggtatagcgatcgttttaagtttagaatcgttaagttagttcggggcgtttcggttttttcgtttcgcgtttcgttcgtttttagttcgggtttcgtcgttttcgtcgtttttgtcgttcgggtcgttttcgtcggttttggtttcggtttcgtatatcggtagggggcgttcgagcgtagttaaaaggttcggcgggaggtcggcggttttagtggcggagcgcggttgtcggtgtgcggtcgggagcgatcgtcgcggggtaggggcgcggcgggtatcgcgtagagcgcgtagaatagacggacggcggcggggattcgacggcggcgtttcggtattttttagatttcggttagcgtttttttgttagtcgtaagtatttagtttcggtttatttcgggttttcgatggttttcgaggtcggggcgattttgcgcgcgtcgcgtcggttgttttgggcggcgttgttgtttttggtcgcgttgtttttcgtcgttttttcggcggcggttttaggtacgcgtcgcgttcgggttttcggcgttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtatagcggggaaaaaaggaaaagaaaggcgatttttagcgtgcggattggggtaatgtttttttttgtttagaatttttcgggagcgtaggtggttattttatttttttcgcgtttatttttcgcgaggtaggatgacgggcgtattcgggagatcggagggaggtagagtagggttgttttagaaggtcgtgggggaaaggttgcgagttgtcgtagggcgtcgggtgtttttgcgttttagaggagaagcgttttagtgttagttcggttttaggcggtaggaggttcgcgcgttcggggggaacg

SEQ ID NO: 6446 - DNA, 6657 bp, synthetic construct
  misc_feature 1..6657: note = Description of Artificial Sequence: Synthetic polynucleotide
  source 1..6657: mol_type = other DNA
tcgggttcggttcgttttgtttttttgttttttggaggtttgggcgttttcgcgtagggattaagggttggatagtcgtaggtaggggtttcgtttttggtttttatttttcgtgtttagtaatttcgggagtaggcggcggtattttttttatgtttcggttttaattacggttttagtttttttaatttcgttttgtaggaataagtgtggtagaggttcggggtcggagggcgggcggtcgtttcgcgggttggacggagtttttgggttgcggagaggtcgttggatttacgttcggataggagtttcgcgcgtttattttcggttcggttattttcggggcgcgttgtttgcggtttttcgcgttatttttatttttgtttcgggatttttttcgggaaagatattcggggagtagtttttttttttttagtagttttttttttttttttttttttgtttttttgacggtgtggggtttttcggtcggaggggcgcggcgttggtagcggggtttagagtgtcgcgtttagcgcgcgttgggggtttcgggtttcgtagtttcgtacgcggtcggtttgtgaagcggcgcgcgggggtttagtcgggcgagggcgtttttgagtttggtttggaatttttagtttatacgaaagtcgtaggttggggaaggggcgggtgggagcgggagacgttttgggaagtcgtgagatcgttcggcgagggttcgggattattagggagcgacgggggatttttcggtttagagttcgagggcgcgatttcggattcgttgggatttcggaggtatatgaagggagagggaaattcgttaaatcgaatttttcgggaatcggaaggcgtcgggtcgtttttacgttttttttttttttcggtcgaaaggcggggggcgacgcgtaacggggagggaagggagggaggggtcggcgattttaggggagggcgagtttttggggacgcggggtcgttaggggttcgacgattttttcgttttattttttcgtttttaagtgtttcgtttttttttcgtttcgtaaacgcgcgttttgcgggttgtgttttggttttcgcggacgcgcgcgtttatagagggtttgatttggggttaatttttacgaggttgtcgggcgtttgtgagtatagtcgtgtttttatttaggggtttattttttagcgttattagggtttcgatttttagattttcggacgttttttttttaaatcgaagtttgggagtttttgggtggtttggggcgggggtagggggcgagcggggcgggttaggaggagggggcgaggtcgttattcggttttttacgtcgttttcgcggttggttttaatttttttttcggagttttttttcggttattttttagtttatcgacgtgcgggtagcgatttcgtttttcgttttttcggtcgttttcgtcgcggttttcgttttttttttattttttttcgcgcgtttttttatatgaaattttttattacgtttagaaagaatgtgttataatttcggcgttgtcgcggtcgttattattgcgttcgcgttcgagttcgagtcggagtcggagtcgtcgttttttcgtttgttcggttagtttcgggtttcgagcgcgcggttttcgtcgtcgtcgtttcgcgttcgtttcgcgtttgacgtagtgagcgtcgtagtttggttttcgtcggtttcgttgggtttcgggtcgtaggtcgagtttagtcgggcgggtttcgggaggggtcggtagggcgggagggggaggagggttgtttggagttagcgagttcggaggaggaagaggaggaggaaggaggggaagtcgtcgtcgtcgtcgtcgtgttcggggaatcggggtgcgcgcgttttgttcgttcgcgatagtgtttttagttcggggttcgtatttcggtttaggtaagaaggggtttgaggggtagggggttgttcggggtcgggggatttttttgtcgtcgttgcgggatcggagggttttcgtttttaggggaggtagggaagaggatgttttttggggggggcggcggggggtagcgtagggtttttagcggttttcgtagttcgggttattttatttttggtgttttgatttcggcgttcgcgttagggtcgagttttttcgttcgcggggttttggatgcggcgttcggggttcgcggttttcgggcgtttttatttatttatttaggttcggaggcgggcgtattcgaagttagcggtcgtcgagtttgggtcggataaattttttttttcgacgtcgcggttggaagggttaggatttcggatttttagggttagggaggcgtcgcggggatttcgaaatttttcggagcgcgttgagagtaaaaagtcggttgggtagaaagagggggagggggttgggcgcgttttcgagtgcgttggggtagtcgcggcgttttaagttgaattatagacgaatttttttttatttgaaatttggtttcggagtcggaggtggggagggagtgggttgtgggtgtttcgatttcgtaaagtcggcgtgggggggcgtagcgtttcgtttcgcgtcgtttgaattttcggagggggtgttacgggattttcgtttttattttagtcggtggttgggttttgtcgatcgttgcggagttttcgggaaggattcgttcgcggttattaataggcgtcggtgattttagtttttttcggttcgggaagttggcgtggcggggttgggttgggttgggttgtcgagtggggcgggatttcggggtttagagcggatttttagtttttttggtttttttttcgtcgtttttttttttttgtcgtttgttttttttttatttttttttttcgatttcggggtgtcggttttttttcgaattttttttttttttaaattgtacggtggttattcggttacggttttgggtcgtattcgcgtaattttagtattattttcgatcgagtttttcgtcgcgggttgagcgcgagttttcggggttaggttgtttagggaggagtagggattttttataattcgcgtttttttttttaatttacggcgagcgtaatatattcgttcgtttttgcggttttatttgagggcggggagaggtcgttgggggtagtttcgggggttgtggagggtaggggggattcgcgaagtttttggagcgtttagggatgtagttcgggcggcgtgtgtagggaggaagtagcgtttcggcgttttttttttagcgtcgttttcgcgcgtttcgagggtttaggagggttcggttttttttattttatttggatatttaggtttgagtttgagtggatttgaggatttgggggacggggaatacggagtttttttttttgtttcggtgtttgtagagtttagtttttaggtagcgtggggatttttgtttttagggttagcgtcggtttcgtttttcgtttcgttaatttcgggatttcgtcgttttttaggttttaattttttagttttatcgtcgcgtttttttttcggttttgggtttgggggaggggtagggggcgtggagcgcggcgttgggtttcggatagatgttttcgcggcggcggcgtcggcgttcgggtaatagtaggtcgttaatcggcgcggttacgggggaggggcgattcggtcgggatttcggggattcggtcgtagtcggacggcgtagttttcgttcggggtggggggggggggcggtcgcgaggattcgatttttgtcgtgtagttcggtttttagttttttgtcgtttttttttttagttttaggtttcgttttttgttggggttttggttttttaggttgcgggatttcgttttttacggtttcgcgcgcgtatttttattcgttttttaagttgatttttgaggtttttcgtggattttagatttcgagtgatcgtagaattgatttttggggttaggtagtatcggttaagggcgttttgaagaggttttcggttttagtttgtatttcgaggaaatggatttattatgtttgtttttgggaagtagtaggacgttttggcgcggttttttcgggtaggcgtttagtatagcgtagggtatacgggggatatttgcgaaggtaaaggaggtttattttagagtttcggttgtatttggttagtataggtttgggggaatttgttggaaatggggatttagtattttttttggggtttatgtttggtaggcggagtggataggttggggttcggagttcggtggttattttttgtataaggttggttaggttagaagttggagggtagtttattgggattttttaagcgtgattaaggaagttttgggggtcgattagtttttttttagtggagttgtagttggggagattttatagataggtagggaggagagggtgtttcgtttatcgtcggtttcgttttataggtttaggtttggtatattttaggtttgtagtatttatttggtgggtaaataaggatttgtttttggtttgcggtttggttttgatcgtggtttaggtcggggtagagggagaaaggttatagtttaggtgttttaaattatcggtgttttttttgtcggtttttggggttgtgttgggtttttagggtttttgttttttagtatttgtatgaaatcgtgggggcgtattggttttcgttttagtatttttttttaaggttttgtatttttattacgggagttttatttagttagtcgaaggaggttataagttttaaattattaaattcgggttagtgttgggggtttgggagttaaggtagtttagagtttatttttcgattttggtttttggagaattttaggattcgggcgtgttaggttttgtagtcgggttaggtcggtttatataggattgaacggcgtcgtgggcgtttatttatatttttttttcggtttttatatattataggatttattttgatttgttgtttttgaattgagttaatttttttgtatgttcgttgaattgtttagttgttggcggcgagcggagagcgtgtcgggggtattgaggtcgggaattagaggcgggcgggggataggaagcggggagggggcgtcggcggggacgcgcgggttgcgcggggattggagagggtttttaggcgtcggtcgttttgcgaacgcgggtttgtttaggtatcgtcggggtttgttcggtttgagcgtggagtttcgaggtttttgtcgggggtttaggttgtttttggggttttgttttcgacgcgttgtgtagggttagattttgggttttttttgatttagtttttttttttgtaatatgcggacgggggttttcgtataggtaggttgttagggtgaaattgagtcgaagagtgttttagaattttttgaagtttttatagaggttggggtgaatgaaggaaggaagcggggttagggttgggtagaggaggttcggtttgcgttttgcgtttttcgtttttaggtttttgttttttcggataaggggcggatcgacgggaggatttgagaacgttttggttttgtttgaggtggtgggagtcgcgggtagtttgtttagttaatagttgtcgtttttattttttttatttatttatttattttttttattttttagatgtgggcggggagggtcggggacggatcgcgaggacgttttttgcgttttttaggattttttttttttttttagtttttgcgcgtcgtcgggagagggaaggagcgggttgtcgcggggagtcgaggagagtagggggttcgggaggttagggagagaaggggagggttagaggtttcgagtcggattcgcggcggaggaagagggggtggaagggagcgcgtaggcgggtgagggagcgagggagggagagaaggagggagggagggagggaaggggggcgggagggggtagggcgagtttgaattttttttcggtcgcgcggcgaggggcggggtcgcgcgcgtagatcgatgggcgaagttggggaggaattttaatttcgggagcgaagttagagtttgaaggacggcggcggttgcgggcgtagtttcggaatcgaggtcgggcgggtaggtaagcggcgagcgcggtcgggcgttgaatttgggggatttgggattcggattattttcggggagcggcgcggttaagtttttcgttatttcgaatttcgggcgttttcgagtgcgtagcgtgcgtttttagtttttgttgcgtttttaggtttggcgcgcgattcgagcgtagcgggtaaagttggaggaatttggcggcggcggagcgggcgtaggtttagttcgataaagttcgggggttcgggtcggggtcgttgtcgtagttcgtacgttgtttcgtgttttcgagaggttttttttttagcgtttttttttttttcgttttttttcgtcgttcgtattttgttcggcgttttttagacgcggttttttgttttttttttttcggaaattagggggttgtttttattttttggtcgagtcgttgatttttttttaggttcgtatcgttttttttgttgggtcgtttttttttcgacgttgcgagttttttcgtttcgcgcggggatcgtttagttacgtacg

SEQ ID NO: 6447 - DNA, 546 bp, synthetic construct
  misc_feature 1..546: note = Description of Artificial Sequence: Synthetic polynucleotide
  source 1..546: mol_type = other DNA
gcgggcgtttcggttattttattttagcgagaagacgaggttgtttgggttttggttttttcgggcgggggttaggggttcgtcgattttttttagcgtttcgggcggcggggttcgagaattaaggtggttttcgcggttttcgtcgtcgcgcgttttttttttttttttcgcggattttcgcggtcgtcgtttatttcgcgtatttcgttttttggaaatttagtagtcggggggcgaatatcgcggcgtttttatgggaatttggtttcgggtttagagcgcgggtagttggtagagtttggggggcgcggcggcggtagtagtaggttggagggcgcgcggcgggggttaaggggatttggtcggcgttcggagtcggagtcggagttcgagtcggagttggaggcgttcggagtcgtcgacgttaaatttcgagtagatggtggcgggggcggggcgggcgggggtacgggggggttttcgggttcgcgttgttaatcgtttaagttcggttttttttttttcgcgatttcgtcgttttcg

SEQ ID NO: 6448 - DNA, 288 bp, synthetic construct
  misc_feature 1..288: note = Description of Artificial Sequence: Synthetic polynucleotide
  source 1..288: mol_type = other DNA
tcgcgagaggaagagagttgagtcgttgtaattttgggtttgggattgcggggacgggacgggtgggaagcggttaaaggcgtagcggtttttggttagagtcgtagaggtttgagacgtgggtcgcgtttcggtttaggagatttcgcggtcgcgttttaatttttagtttttcgattgcgattgcgattcgggaaaacgtttacgtttttggaaaggaagttttattatagggagttgattcggtgttagcgcgtagtacgttttcggttcgtagtgcgtcgcgcg

SEQ ID NO: 6449 - DNA, 947 bp, synthetic construct
  misc_feature 1..947: note = Description of Artificial Sequence: Synthetic polynucleotide
  source 1..947: mol_type = other DNA
tcgtatttgtttcgcggttcgtttttttgtatatacgttttcgagtcgggagagttttcgtagtatttagagaagagatcggaatataaaggatgaacgaatggggagggggggtttggggggttgggagaacgaaaatattagttgcgtttttaatatttaaggaaggaagtggtagcggggacggggagaggatgggaaggggatgttgattgcgagttggggcgggacgcggtgatgggaggggatcgggtcgggaatgcgggaggcgaggggagcgacgggatttgtcgtttcggcggtcgggtagttaatcgattcgttttttttaggaaggagcgaggggagggtggtttagagagaaagcgtcgcgcggtttcggttgttttcggttcgggatatttaaatagattaaagaggattcggagtggagttcggagcggatttcgtagttcgcgttcgtcgcgtatttattcgcgcgttcgttgttgggttttcggtagtcgcgttttttgcgttggcggagtcggaggagtttgcgttgggtcggcggggggcgggcgtttggggagggcggagagagggttcgttcgtcgggatttttgttcggttcgggcgttttagagtcgcgggattggtcgtcggaggttgcgggaggggttcgggttagattttttagaagttttagagagagtcgttttttttttttcgtgtgattttttgggagtcgggttgttgacggtttagcgtttagtcggagttttcgcgcgtttttcgggatttattcgggagatgtcggggtttttcgggaagagtgggttgcgtttgtttttcgcggtcgtttcgttttttcgttgcgcgggatcgtggggtttgagagcggcgttttttcgcggggtcgaattcgttatttatagtggagtgtggattgatatcgcggttttacg

SEQ ID NO: 6450 - DNA, 1313 bp, synthetic construct
  misc_feature 1..1313: note = Description of Artificial Sequence: Synthetic polynucleotide
  source 1..1313: mol_type = other DNA
tcgtgttatacggcgttgggttttgtaagttgttgtttgcgtagtcgttttcgtcgttgtcgttttcgggcgggtgtattagggttcgcgtgggcggggcggggtcggggcgggatcggggcggggtttgttttttcgacgcgtcggtttcgtttttcgtttcgtttttttttagcggatcgtaatgatttagaagtttaggaattttacgtgacgttatcgggggggtgatgtaatgtattttaaatagaatgtattgtaatttttgtttagtttaacgtggtttttttattcgggtttcgtttttgttttttttatatttgtttggtaagtttttaaaaatacggttcggttatttttggggtttttgtatttagttatttttgttgtatttgtcgtaggagttatttcgggagtgtatttgtttgtaggggttggttttcggtagtagtcgcgaggttatttggtttagtgggtaggttatagggtaaggagtagggaagatgcgatgtatttttttttggagggtgatttgtgtttgtaaatattttggcggattagagggaagttcggtttcgagtgttggtagattgtggaattcggttgtgttttgaggttattttagagatttcgcgtcgcgtgagtgtcggagcgttcggtggtcgtcgcgtcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggcgcgcgcgtagggggttcgtttttttcggtgcggagttgtagttgttatttttttcgtcgggttgtcggttgtagcgggtgggcgcgcgttcggggaggggaggtcgttttcggagggcgtttggttttcgttttaggcgtttcgggttggagagcggcgaggtttcgttcgttttagtttattttttcggtcgttttttgttttcgttgtttttttgttggtatcgttattttttttcggtcgttgttttaaatgatagtttcggttcgagttttggcggcgtttaggtaatttttaagatttggcggcggagtttttttttgcggtagattttcg

SEQ ID NO: 6451 - DNA, 848 bp, synthetic construct
  misc_feature 1..848: note = Description of Artificial Sequence: Synthetic polynucleotide
  source 1..848: mol_type = other DNA
tcgttttttcgtttagttcgcgatgtttagttaggcgcggcgcgcgtttgttcggtattttttcggcgcgtttttttttttgcgtttttagatttcgatttagagcggatttcgatcgcggtaaattatggttttaggtgcgtttcggaggtagttgcgggaattagttatggtttcgggttaatgtttagggataagtatagggatagggatagagatagggattgggattggattttagttttaagagaaagtatttcgggtttattcgtattttttttttatttttaaataaagttatagaagcgattagcgcgtagttaaagggtttggaggtgaaaaggagggttgggtggggaggagagaaagtgagaagggagagaaaagcggcggttgagtaaagcgggagtcggcgcgggcggtggggtttgattcggacgtcgcgtattcggtttcgtttcgcgtttagcgtttcgtttattttttggtcgcgtttgttttcgcgtttttttgtttttttttatttattagtagttttgttgataagcgagaaaattgataagtgagaaaagtcgtttgttagcgttcgggttggtgtttgggttgttatcgcgggcgcggagggaggggcgcgcgggtatcgtcgtttgtcgggtatacgttgggtttcgatttcggtcgggtatatttattttcgtagggtagtcgcggttattatcgatttgcggagttgcgtgggttttcggaatttttattttaataagagttcggtttcgcgcgtaagtaggagggaagggaaatttttattttttcggggttagggtacgtagaagtcgcgaggtttcgcg

SEQ ID NO: 6452 - DNA, 2406 bp, synthetic construct
  misc_feature 1..2406: note = Description of Artificial Sequence: Synthetic polynucleotide
  source 1..2406: mol_type = other DNA
gcgtagcgttatagtcgcgattgcggcggcggcggcggcgtagggggcgggggaggagagaagcgtttatttcgtttcgttgttttcgtagtagttttggttttagtttcggcgtattagagcggtttttgggaatttttgggtttgttgtttcggcggtcgttagttgggagtttattatcgttcgatggtatcgaatcgattcgtgtagttttataattttagtttaatttcgaggagttagcgtagatcgtttttcgtttttagttgcggcgaggtaagggttggtagcgttcggacgttttcgttttgttttttttatgtttaagcgcggggaattatacgttttcggtgtagaatagacgatcggggttattagggttgggcggtgggagtgggggttgggagtattatttttggttggacgtgtgtttagatttatcgtttttggtttttaggattttatttttttttgtatttttaggtgtcggtttttttgtattcgttttttacggggttcgttcggcgaagggtagtcgtagtttatatttatttttcgtttttaatttttgttttttttgttcgtcgtagttattcgtttggttgggagtaagttttttttttcgttgagggtgtagagagcgtttagggcgttaagagtagaggggttaaagtttaagcgttattagttagtcgaaggttttgagtttttagggtcgcggtcgggacgtagggaggttaggacgcgacgttcgttttatttgtttttttagcggttttttggtcgatagcgtcggtttgggggagggcgcgcggtcgtagacgtagttttttagtaggtaaagtttcgagggtcgcgagttcgagtcgttttcgaagtagaagagtaggttttgtagtagcgcgaattatttggtttgttattttgtgttgttcgaatttcgtttgtttaggtagtttttgcgcgtgtcgtttttgcgcgttagtagttttagggacgcgacgtggttattatttagtcggatttttttttgtatggtgtttagaggttagcgagattttacgcgtttatatttttttcgcgtagtagtttttcgttcgtgcgcgttgcgcgttgtttttttttggcgttcgttcgttcgttttttttagtttttttttttttttaaatatttatattttaggatttggcgtcgagtcgcggttttttgaatttagatatattatttttcgttggaatttttttttcgtttcgtagagttttagtattcggaagatgtcgttcgattttttttcggtgtcgggtaaattgagggattggcgatttgcgcgttggcgaggggtaggcggagttatgtgacgtcgatttttcgaagagttcgttttagtagcgcggatagggatatacgtacgtagtttcgtcgaggcgtagagtcgcgcgtaggttgtaatttggtgttttttttttttttttagatatatatatacgtatacgtatacgtatatatttaaattttgttttttttttttttatttttttttttttttttcggatgttaaaaagtaaattagattaattttcgtttaatttaatgaaatttcgaaggttcgttatttcgggagtttgcgtttttgcgttttatcgcggcgtattgtagatttggggttaagtgttagttgttatttttttttttaaaggttcgttttttttttttattttatttttaatacgaggtggaaggaggaaggtgggtggcgaaatagagttgtaaaagcgtttagttttagtttttgtatagttagtcgggttatattgaattttagtattcggttgtattttcggcggtttttttagttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagtttttattcgtttatatagttatacggtatttattcgagaacgttatagcgttcgtatgttgtatcgggagggcgcgcgggtcgtcgggcgagtcgggagttggggcggggagcgcgtatcgttgtttgtcgtagagggtagcgagttcgtttcgattcggagtaagtcgcgtttggttcgggcgttttgtagcggggatgggtgttcgcgtagttttgtgaaggaaagatattattttttcgtacggaaattgcgtatatttttttttcg

SEQ ID NO: 6453 - DNA, 1218 bp, synthetic construct
  misc_feature 1..1218: note = Description of Artificial Sequence: Synthetic polynucleotide
  source 1..1218: mol_type = other DNA
tcgcgtttgtagttcgtgtattttttttcggagttgcgttagggaattacggacgaattggaaggggtcgagaagggttttggttattatttttagttttaagttttttcgtttttttagatttgggatttttttcggggaggattttttggcgttttttggtagtttttcgtcgtttagggtcgatttttttatttttagttttcgggcgggggaggtttcgtacggtcgtttagacgggttggggcgggaagattgtagcggttttgggtttattttttgtttttttataatttttagtggagttgggttaattttaggtatagtttattcgagttaggcgaggtttagaaaggtttgattcgtttggtagttttaacggatttgttttcgtagtcgttgattagtcgttgacgagcggatttttcggtcgttatggcgattgtgaaatgtagggtggagcgtatgcgttcgaagttattcgcgcgggtagtttttgcgtgtttttttgcgtgtttttttacgtgttttttagcgcgcgtagtatttcgtttttgcgttttttcgagcgtgtagttttcggtgagggtagttttacgtatagtttttaatattttttttagcgtttgtagttttcggtgcgcgtagtttttaagtttatatgcgtagtttttattttgcgcgtagttttacgtatagtttttaatacgtttttagttttattggcgtagaatttattatcgtttgttttttacgcgttttattgggagtgtagtttttatttcgagcgcgtagttttacgtagtttttttatattttttttagcgtttgtagtattttttagtgcgtatagttttgttagtagtttttcggcgcgtcgtttttgtatcgtttcgggttataattttgttggcgattaagtttgaagaattttttgtggttttatttttttttttaggtttagttttagttttgatattttaattaaaaggttatacgttaattaacgaggtattaaaggggaagattttagttgaaagaaatgattgtaggaagtgtgttagggaagttaacggaatcgttggttcgtcggtggtgcgttcggtattaggaaagtttttacgatcgttgaggtatcgggtagttagtgttcgttgttaacgcggagggaacgggcggagattgcgggtaatacgtggtagagtcggcgtgagttcg

SEQ ID NO: 6454 - DNA, 1848 bp, synthetic construct
  misc_feature 1..1848: note = Description of Artificial Sequence: Synthetic polynucleotide
  source 1..1848: mol_type = other DNA
acgacgaaggcgcgtttttttttattcgtttatattatattttcgtttttcgaagtatagttcgggttggagaagttttagcggcggcggttttcgcggcggaggttttcgcgcgtatttattatgtttttcgttttttttcgtttatttcgagcgtcgtgcgcgttcgaagttcgagtcgtagagcgttatcgcgtaaaggaaggagttaggcgcgtgcggggttcgcggagtttttttgaattttttggatgggggcggaggcgaggggcgtcgttattattgcggtaaatttcgtttttttttcgggaggtgaaattttttaattcgttttcggtcggttcgcgggtcggatttttcggaaaggattttttaggaggagggagcgaatgtaagttttgttcggacgttttatcggcggttttttaaatttgggcgttttttgatagttatttttattttatttcgtttttacgttggggattatttttggtttcggaggcgcgggcgcggtcgtaggagcgggttgcggggttcgcgaaataaagaatttcgagcgggacgtatttgcggcggtagcggttgttaagttttcgaattttttatagattcgcggacggggcgtaggttggcggtttttcgtttcgcgcggtcgcgggcggttacggttattgcgagcggtcgggttgggcgcggggtgcgttcgtcgcgggtatggtgcggcgcgggcggtcgcggggcgcgcggggaaggcgggagagcggcgcgggtgagtgggagcggcgggtgtgcgcgagtgcgagtgtgcgagcgcgtcggtggcgttgtttttgttcgttttttttcgttcgtgtagtttcggtattagtttcggggatcgtgtaattcgattttttttgatttataagttttgagtgatagttttgatttggtttaatcgcgggagggaggggaaagagaaagaaagaaatttttagtcgtacgttttttttggtatttaatcgattttttggaaaaaggttttatttcggtttggtgtttcgtgttgggtggagaagtttttcgtttcgatttggtatcgtttgtattatttacggggtggaaaagttgtttttcggtttcgcgtttttttttcgcgcgttttttttttttttttttttttttttttttttttttttttcgcgtttttttttttttaagttttaatagatgttgtcggatttttttcgttttttcgtatttttttttttttcgtttcggttttcgtttagtttttttttttttagttattttcgggttcggaggggacgcgttgagtagtaggacgtttgtcgtcgtagggggcgaagttgggaaaatttggagtgttgttcgttttatttttgttttttcgttttttttaggtcgcgtcgggagttttcgtttttttcgttcgtcgggtttttaagttcggagtgggttttagttgcgaggcgggcggcggcggttgggaggcggcgcgtcgcgggtcggggtcgggggttgggggggagttcgggcgtcgcgagttacgcgcgcgtttttttttcgtttttcgtcgtcgtcgtcgtcgtcgtcgtcgttttttttttttttttttttttttttttttttttttttttttttgttttttttcggtttttatatagatatatttatgtttgtttttttttttttttttatttgatttcgcgttttttcggcgcgtcgaagttttatttattcggcgaggggaagggggttcgggcgtgatgttattcgcgtttttttttttttttttttatatcgttaggatattttttaaatgcgcgttttggtattcgtgttgcg

SEQ ID NO: 6455 - DNA, 2119 bp, synthetic construct
  misc_feature 1..2119: note = Description of Artificial Sequence: Synthetic polynucleotide
  source 1..2119: mol_type = other DNA
tcgtcgtttttttagtatagttttcgtagttcgtattcgtttatagggttttcgcgattttagagtttagggaagaattgtcgaggggcggggggttttttatgcgtatggaagggacgtacgttttaggtttttattttttttttgatttcggggatttttggacgtcgatttttcgtttcgtaggggcgagggttttgggttcgtagttagacgcgggttttttttaaatttagtggtttggttttattgagtgggggaaggtatatattttttaagattaattgtttcgtaatagggaatttcgtaggattttagtattttcgattttttaggtgacgttaagagggtgggttttattgtgtacggtggggaaattgaggttcggaggggataaggaaggtattcgaggttacgcggttttttcggcgggcgggaacgtaggacgcggagttggggcgcgggttgtgcgcgtttaggttcgcggttttcggggttcggttgtcgtagcgcggtcgtcgtcgaggattacggtcggggcgcgggcgggttttagtgcgtaggcgcggcgggcgggaggggacgcgtttcgggcgcgcgcgcggggtagtcggcgttttaatttcgttcgtttcgcgtttcgcgtttcggcgtttcgtcgttcgtcgttcgttcgtttcggcgtcgtcgttcgcgtttcggcgtttcgggtcggcgaggggcgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcggttggagtaggcggttacgttgaaggcgttggtcgtttttagtttgttggcgggcgcgttggcgttggtcgagttgttgggcgcgtcggggttcgcgttcggtttggttaagggtttatattcggtgtattgcgttttttttttggcgttgttcgtggtaattaacgttcggtttttgtaggtgttttagttgtagtaggtcggttagttggcgttgttttttagttttattttcgcgttgttttgttgttttttcgcgttgggcggtttcgttcggggtttcgtcggggtcgttggggggttagcgatcgtcgaataaggggtttggtagttttttttggttattttcgtgttttatgttttgttgttcgtgcgtagtttgttggttataggttttgggttcgtggtggttgcgtcgtatttgttggttatagttattttggttttcgttaagcgtttacgtttttggaggacggtaagtgtagtcgcgtattttttatttggtttcggatatatttgttgggacgatgttgggaatgttcggagtcgggcgcgtttttttttatgcggcgggtggggatattgaggtttcgagtgggggtgtgtttaaggttatttttacgagttggggacgtagtcggggttggtatttttcggttagggttttttttagagttataatttacgaagcgtttttggcgtgaagtgtggagaggggagataggtgtggagagagaaaggtttggttaaggttagggagttgatgagcggttagacggcggttagaggggttcgtcggttttttgtcgtatttatttttatagagggattgaaagtgggcgaggagagtagatttttagggtaagttttaaggtcggttttgcgcgtagcgttgggttttttttttgcgtatttagagcgcgtgttgggttcgttttttaattttgcggattcgagggtggtatatgggtggtgggaaaggatttcggtttttttagttttgttggttatttttttgtggatatgttttcggtttagaaagagtggggtttgttaaggttaaatatagtttagtttttgtcgttgttattcggcggttgttttgattttgttttttttgcgttcgaattttgttattgtttttttagtcgggcgggcgagatggttgtaaggacggggacgttgtttgtttttcgcg

SEQ ID NO: 6456 - DNA, 562 bp, synthetic construct
  misc_feature 1..562: note = Description of Artificial Sequence: Synthetic polynucleotide
  source 1..562: mol_type = other DNA
tcgtagggcgaaggggtgcgttgttagatgtggtattttcgttttacggagatatacggtgttttatacgttagggagaggtttgagacgtaaagagtcgtcgagcgggttgcgggattgtttcgttgttattttcgtttgtagttattttttcgtacgtatttgtgtgtgtatttaggttaatatggaaggcgttattttaatttttgtcgtgagtaggtgggagggaagagagacgagaggtattttattggttgtttgggaaaatgaattgtattttttttttttttgcggaggattaattttttttattttttcgggtgggtattcgtattttggggtcggagtttgaattcgggagttaaggggttttagttttagggacgtgaagttgagcgtatagcgggcgtttttagatattggggaaagtgttttacgatgtttcgagtttttttagtttcgttagcggggcgagcgtgagggtgtttcgatcgattagcggtttcgggtgtagggtggcgggttcggcggcgcgcgttttttttttttttttggcggttcg

SEQ ID NO: 6457 - DNA, 1404 bp, synthetic construct
  misc_feature 1..1404: note = Description of Artificial Sequence: Synthetic polynucleotide
  source 1..1404: mol_type = other DNA
tcgtttcgttcgaggcgaaatcgttgaaagttcggttatttaatttttgtttttataattcggaatttcggatattagcggttttagttgttggcgcgcggtttttttttagttttttggattttaaagttttttgttatagcgcggcgttttttttttttgttaatttttttttttgtattgtgacggaggtaaagtaatttagtttaggaggttgaattcgagttattagagaaggagaaatagtgtcgaaaacggttcgtgcgttattagggtagtttattaacgtattaattttaggttcgttgggtagaagtcgggaggaaatattttggggatcgtatttttggttaaatgtttagtacgagttaaattcggtttttttaaagcgagttaagtttattattataaagagatttttcgagtgttttgttttaattatattttagatagttagttttgtggttgttgtttgattttaattttttttttaaatttaaaaggatgtatatttttattagacggaacgtcgcgatttttcggcgaagaaaaaggcgtcgtttattttttttttaaaacgttataataaaaattattacgtttttttttttttttttttgtttttttttttttttttagattaataaggaaaggagcgagcgagggcgtagatgttttttggttaagtatttttcggatgttttcgattaaagcgtttttaaatgaatttgtagtttgcggaagtcggggatatatttatagacgttttttgttgtttagattaggaggggtggtgggggaattaggaagttagggagagagtaaagtttttggacgcgttttaggaggaaaattttgtgtagtgttgttaggcggaggttcgttagaaggtttcgtagttgttgaggcggggtgggattgcgttttaggggtcgcgttgaagttggcgtcgcgattattgcgtatcgatttcgtttattttttgttcgttttcgggagttttttttgttttaggacggttttttattttttaaattatgttcgttttttatttcggatttatagttatttttaaatttcggttattttcgtttagtatcgcggtttttagtatatttttttattggagtagtaggtgatttaaattagatttatttgttgtgaatttttttttttttttttttttttttggtgtttttttagggagaggggaacgggatgtaggttgaggtttagcggcgcggtaattcggggtatcggcgcgcgtttttttgagtcgtagttttggttgagtaagcggagtcgtcggtagttttggtagagtcgggaagttgcggtcgtaggggttaggtcgggaggtagggggcgttgttgtttttttcgagagtcgcgttaggataggcg

SEQ ID NO: 6458 - DNA, 819 bp, synthetic construct
  misc_feature 1..819: note = Description of Artificial Sequence: Synthetic polynucleotide
  source 1..819: mol_type = other DNA
gcgagacgtgggaaattggcgaagttgttattagtcgtcggcgtaaggagcgcgagagttttgggtgcgcgtagggtatttattttttattttttagtaagtatcgtcgtaagttttttaggtgtagaaattgttggcgttgttttcgtagttttcgtataggaattggcggtagttttgcgtgtatttgtcgtagtagtaacggagaagtagggttcggtagggttcgtagtttaggggtaggagatagattttcgcgttattttttgaagaaggggtagaaggagagtaaaagagagggaaagtggttaggcgtagtttttaggaggaaagaatatttcggggagttttgttttttttcgagcggaggggtttttgtagagaaagtgtaaatttgggagcgagttttttttgttagcggagcgcgcggtagggatttggagaaagcgaggtttggagggcgtttatacggggttttatggttcgttgcgtttttttcgtcggttggggagagaagtttttggagcggttagatatttgttggtttttgagtagtatcgtttagtgtagttttcgttaggaaaagtagtagaatcgatagttttagggggcgagcggggtttatggtgtagggggtcgggcggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcgcg

SEQ ID NO: 6459 - DNA, 1128 bp, synthetic construct
  misc_feature 1..1128: note = Description of Artificial Sequence: Synthetic polynucleotide
  source 1..1128: mol_type = other DNA
gcgttggcgggcgtattcggcggcggcgagcgcggaggtgttgcggtatttattatggtatttttgtttcggaacgtagtaggtggggttgttcgtaatatgtagggaaatgagtatttcgttttgttttttatttttttttagtttttcgtggtgggtgtataggaaaaagaagggcgaaaagcgggggtaatagttagtcgtcgcgcgcgtttttagcgtcgtttttagtaatagcgttaggaggaaagtttgtcgggtttagttattgcgttttatgtcgtcgtcgtcgtcgtcgtcgtcgcgcgttttacgcgtcgttcgtttatttagttttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcgtttcgttttatatttttttaaagtttcgggcgtcgcgtttttttcgtcgtcgttatacgtgtttcggtcgttttttcgttttcgcgcgtcgtttcgttcgtttttcgttttttcgggttggttcggcggtatttcgcgcggcgaggggcgtacgcgttttcggagttttcggttagcgttcggttcgtattcgggaggatagggaggggcgttcgtcggggagcgggacggggacgttgtcgaggatcgttgagttcgcgatttttttgcgagggacgttaaagtttcgtagagggtatttttcgtttagttgtttgaaggggaaggttagtttttttggtcgttagtgtgttttgttttttttgggaggatgcgtgagggaaggagaggggcggtagggacggtcgttggcgtcggtttttttgtttgagtcggttgcgtttcgcgtttttcggggttcgtagtttgttagttcgggcggttcgtattcgttttgggaattcgttcgaggtcgcgaatcgttaggggttttcgcg

SEQ ID NO: 6460 - DNA, 1128 bp, synthetic construct; identical to SEQ ID NO: 6459
  misc_feature 1..1128: note = Description of Artificial Sequence: Synthetic polynucleotide
  source 1..1128: mol_type = other DNA

SEQ ID NO: 6461 - DNA, 1128 bp, synthetic construct; identical to SEQ ID NO: 6459
  misc_feature 1..1128: note = Description of Artificial Sequence: Synthetic polynucleotide
  source 1..1128: mol_type = other DNA

SEQ ID NO: 6462 - DNA, 1921 bp, synthetic construct
  misc_feature 1..1921: note = Description of Artificial Sequence: Synthetic polynucleotide
  source 1..1921: mol_type = other DNA
tcgcggatttgggtttggcgtttattttatcgttaggattggatagaaaggttttggtcgaggttattaacggagaggttagagcggagtttttggtttagaatggaggtagtagcgagttttcggcggtttttaggagtattaaggtggaggcggtggaggagtcggaggcggtttttattttgggtttcggagagtttgggttttaggtttcgtcgcggacgtcgtcgtcgcgtagtttcgtttcggttagggttaaggtcgagttgtttagttttacgtcgggttttagttcggtgttcggcgagttgggtttggtcggggttttgtttttttcgtagtacgtgttcgggttcgacgcggcgtttttcgtttcggagattttggttaagatgttcgagttggtgtatagtcggttgtagtagggcgcgggcgcgggcgtcggcggcgcgtagatcgggttttttttcggggtttttaagggcgttacgtgtttcgagtgcgagattatttttagtaacgttaataattattacgtgtataagcgtttttattgtttaggtcgtcgtgcgttcgaggacgcgtttgtcgcgcgtaggtttaaggcgtttttcggttcggttcgcgcgtttttcggttagttcgtcgaattcgacgcgtcgcgttcgttttcgggtttcggagcgcgcgaggagggggttgggggcgcggttacgttcgaggacggcgcgggcggtcggggtagcgagggtagttagagttcgggtagtttcgtggacgacgcggaggacgattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgtagttcgggtttcgtggttttcgggacggtttcggttcggagttttaggagtcgtcgttcggttcgttttcgttttcggtcgtcgcgttcgaggtcgtgtcgttttcgtcggcgttttttttttattcggataagggcgtttagatttttagtaagggtacgtcggcgtcgttgtttaacggtaattatcggtattgtcgtttttgtaatattaagtttagtagtttgtttatttttatcgtttataagaagtattattgtttttcgtacgtcgtcgagtacgtgaagtgagcgtttatattatagtcgtagacgttttgtacgtttcgttgcgatgcggggagggggtcgtttttaggtcgtacggattgtcgtttttgggaatttcgttacgtataggtttcggcggagggggtcgtagggggtagcgttcg

SEQ ID NO: 6463 - DNA, 2872 bp, synthetic construct
  misc_feature 1..2872: note = Description of Artificial Sequence: Synthetic polynucleotide
  source 1..2872: mol_type = other DNA
gcgtttttcggaacgttacgttttgcgattgatttgcgagtaaagtagcgggtttagtttgcggcgcgcggaaaaggcggtcggcgaagagtcgttcggttcgcgggtaggggagggatcggagggagacggcggggagggagcgttggtttttttttgggttggggtttcggaggaagtttttcgttaagatttcggtcgtgcgtttttttcggggttcgtttttttttttttcggttttttttttgttatcgttttgggttttaagtaggtcgtttagtcgggttatattcggtggatagaagtcgggatttagggttggcggttgggttcgtgtattttttacgcgggcgtttcggttttgaagtgcgcgcggagtaggttttgatcgttttttttttttttttttttcggttatttttgttttttttagttattgataggatttttttcgaaaattttagattttttaagttttagtttggcggttttttttttttaagtcgcgtttcggtgatttgggttgcgcgattacgaggaagttcgagaattttttggtttaagtgagataggaattagggtaataatgaagagaaagatattcggtttttttttattttaggtcgtagaggcgtatatcgtgaaaagaaaggttaattagcgttttaacgtacgttcgggttttttttttcgattattatgtatttttaattttttgttatcgagggttttggattttttcgaggttttttgtattttaagtggaattttttgttttatttgttagtagtttcgtttgttgagaggacgtattttggggattgttaagaagtagtagatataattcggttttgttaatatagtatacggttttgttttcgtttttttttttatttttttttttgattcgtcgtttggggcgagttggagaaggcggagtaggaggtggggagaagggtgggggtgggggaaggtttggcgtagtataaataagttttttagcgggttgtttatatagtaggtggatttgacgttagttaggaggtttcgttgtaaattcgaataatattttttttcgcgtttttttttttttaaagaagttagggaacggggggagataggtggacgggggagaaaggtattttaattagttggttttaaatttattaataataataacgataataataatgtaaagtaaaataaaataaataagtggttcggcggtattttagaattttttgcggcgttttgttttttatttcgttttttcgaggagaggtagtttcgcgagtagtgtgtgtatagttcgtattgttaataatacgcgcgcgcggtcgggtgcgcgcgtttgttagcgtatatttatatatatagatatatagatatatatatatatatatatatatatatagattcgggtggggggagcggttgcgcgagatagcgcgagttttcgagaaagcgcgagatacgtcggcgcgtgtagtttcgcggtcgtcgtttcgttttagttttagtttcgcgttattcgtagttcgttcgcgaacgttcgtttcggttatttatgcggcggtcgcgttcgttggttgcggttttttcggtttttttttttttcgggcgcgttttttattcgcggtagtagttgttcggattcgcgcgtgggtgtgttgtttgggggtttttgtttcgtcgtcgcgggtgttatttttcgggacgttgtttacggcgttttcggtcgcggtaagttttttggtttttattttggcgcgttatattttcgtattttattttgttttagttatttttacgttgggtcgagttgcgattttattttgtttcgcgtttttttcgcggtggcgataaagtttcgttttaaaggtagcgttttgtttgtcggggcgagtgtgatatgtgttaaatttgggttcggcgttggggtcgtatttcggatttagtattattatttgttgtttttttttattttgttttgtgatgggggaaaaaggggtggagaggggagatttgttgttggtttacggatgatttttagtttggataatgtaaaatgttgtttcgttcggagagatttcggttggaggagaatgtgtgtcgaaatattagatgtgtgtttgtttatttttttttttttaattgtttgttgttttttttttttttttttcgtatttttatttttaatttcgggaggagaaataatagtaaaaatatttggcggttagaagtatatattttattgatttaattgttgatttttatttatttagttgggtaagtgtacgtttttcgcgtttaagttgggtattttagcgtttattttagaagtatttttttaggaaggagagagatggaaaggggatatttttgtttttggagttaagaaatttttgggttttattgacgtttcgggataatcgtgtatagggatgattgttgttttgatcgcgtttttttttttgtttacgcgttagtacgatcggtttttttcggtgtttggtttggttttatttttatttcgttttagagaggtcgtttggttgtttgtgggtgggtttggggtgaaatcgtatttcgcggtatttggtgaggggacgtgggaggagcgtagatatttttcggtgatagggagggttttttatttggttgttatttggaagtttatagtggtttcggcgggtaggcgggcgggtagagcgcgggttcgaacgtttttcgcgtttgcggcggcgtacgtgcggcggcggcggcggcgtcggcggcgcgggcgggatttattgggtggtcgcgcgcgttattcgcgcgttttttgcgcgtttttgtttattcgcgaggtcgtaacgcgttttgatattcg

SEQ ID NO: 6464 - DNA, 2906 bp, synthetic construct
  misc_feature 1..2906: note = Description of Artificial Sequence: Synthetic polynucleotide
  source 1..2906: mol_type = other DNA
tcgcgggggtgcggttttgcgtaattgggtgattcgcgtgttttttcgtattttatttgtattaagggagcgcgtgttagacgaagggaattttttttttttttttggtgattttgttatttttttattaattgtacgaagtttaagggatattcgagttttttggttgggcggatgggtttcgcgtttggtatggttgagcggtttatttttattttttcgtttttatttttattataatagcgattatttagttcgttaggagtttttgttttttagcgtaggtttttttttttttttagttttttgggttgttgaagtcgggttttgggtagatagagattggggtcgtggggagagcgttaggttgtttttgtttttttcgcgtttcggggtatttcggcgcgttggggatgtagttttcgttttcgtcgtatttggtcgttcgagcgttcgcgtttacgtttcgcgcggggtcgttcgaaattggggtcgcgttagtcgcgggagttatcgaggagttgttggggtgcgtttgtttttgttttttaaataagattttcgagattttttttttatttttttaatttttagtaggatacggaatttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttagattttggttagatatttatttagtttacgtttagagggcgggggttatttcgatttatttcggaagtcgttaattttagaaattttttttgttaggttcgcgaaacgaaggtatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgttattttttagttttttattcgtcgattaaatttttgggggattatatttttaagttttgggagtttcgggtaaagttttttttttttttgaatttttttattgtaatgtaattatgggtagataagaggggtggttgttttgttttttgtaacgtaaaattaatagatatttaattaagttttaatgttcggttagtttttcgttttttggtgtttattttttttttttttttattttcgttattttcgttcgttattttttttatagattacggatatgtagggttatttatttgtgtttaggaaaaataaattattagagtgatatgagaaggaatggtgtatttggttgttcgttgaaaggttttagagaagaaaacggaaaggggaataaaacggggggattttttttttttaataagtagggcgttttggggaagtttgggggttaggggttttttgtttcgtggttcggtatttgtttttttcggagtcgttttttgttgtcgggcggcgagttttattttgtttttcgtagagggcgcggtgaggaagttcgtcgggggttcgtagttttatgttagcgtcgtcgtcgtcgtcgtcgtcgtcgtgtgaggcgagtatagcggtcgtatttgtggttgatttttgggttgagggggttgagttggtttagtaggcgttaagttttttttatgtgaataataaatatttttatcggcggtcgcgattggtttgcgttcggcgtttttcgatttttcgttcgcggttatttattcggcgcggcgcggggagtcgcggttaggatcgcgttcgggatcgttaatcgtttcgcgttaattagttatttcgggaagcgggaggaggaattttcgaggggcgggagtttttggatttcggtgttatttagcggttttggcgcgggtagggagggggattttcggttcgcggattttttttcgttttttagtttgaagcgacgaggagattagaaatgttaatagttttgatttttaaaaattattttttttttttcgtttttaagaaaaaggggaggatttaattatagagtgagagggtgggaagaagcgggagcggtagaagaaggaatatggttgtggaggagtttagcggtttcggttgtttggcgagttcgggatcggcgcggggaggcgcgacgttcgttcgagtatagcgggtagtattcgcgagttcgggttttcggtgaatatagttttagaaagcgttatcgagaataatatatggtagatgataagtgtttcgttatatgtttttttttcgggaatgtttaaagtagagtcggtaagtcgcgcggtttttttgtaaagtttgtttggcgtcgcgcggcggtttcgttatttgtttcgtttcgcggttttggcgattgtttttttatttttcgttttcgagggtttgagggacgcgtgtaatagagtttttagggttcgaggtattatatagcgcggttcgttgcgggtattgcgtaggaaggggtatgggtggttatcgggacggttattttattgagatgatttaaggagtcgtagacgcggggtaggaaatttcgggggagtcgtgttcgggttttgtagggaaatttcgggatttttttcgtatgtcgtatgcggaaatttgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgggcgagttagggagagcggggcgcg

SEQ ID NO: 6465 - DNA, 2906 bp, synthetic construct; identical to SEQ ID NO: 6464
  misc_feature 1..2906: note = Description of Artificial Sequence: Synthetic polynucleotide
  source 1..2906: mol_type = other DNA

SEQ ID NO: 6466 - DNA, 1696 bp, synthetic construct
  misc_feature 1..1696: note = Description of Artificial Sequence: Synthetic polynucleotide
  source 1..1696: mol_type = other DNA
tcggagtcggagtcggcgaagtcgcggagttgaggcgcgtttgggagagttaaggttcggcgggttatgtaggtgtatgttttttttttcgtttaaggagcggcgttattagcgtttttcggttttgtttttggattttggtatcggttcgttttagtcgcgggggaaggcgttttatcgttaaagtgcgtttcggcggtttcggttcgttttgcgggtcgtcgtcggagggagtgcgggggcgtttcgaagtcgtttaggtcgtattcgttggatgttgcgttttttttttcggcgtcggtcgtttcgggtcggcggtagttgattgcggtcgtgagttcgcggagcggcgagagttaagaggaggtgttcgcggcgttttcgttttttttagatatatatttttttttttttcgttttttttcggagggtggaagagataaaaacggggggttagttttttagttcgtcggttgtcggtacgcggggcggcgtttcgttcggttttcgaggattagcggcgtggcggttgcgttcggattcggttcgtcggtcggaggagcgcgcggcgttcgcggtcgcgttcgtatcgtaggtttttttagagagttcgggggcgggcgcgggttcggcggcggcggcggtcgtagttttcggcggcgcgtaatcgttcgtcgtcgttcgtcgttgttcggttttcggcgcgtcgtcggtttcggttttgtgcggagggagcgagttcgcggtttcggttttcggcgtttttagtggtcgcgtcgttagcggattgttgtagcggcgtgagtagcgggggtcgcggttgcgggaaacgtttcggagtttaggaatatagttttcgttggttagcggcggtagtagtagtagcggggtttttgcgcgcggcgtttatcgtttttttttcgcgtcgggttcgcggtgttgtaggcggtagttacgtagattgtttttttatttttttgttttttagttagaacgtgaatgtattgttgacgtatattgttttgggagaagattagcgtgatgtagtgtttttatgtattagcgtcgtttttttttcgtcgtttgtttcgcggggttaacgtcggcgttttttagcgtcgcgtcggtcggcgtcgcgtagtttcgcgttttcggtcgttcgtttttttttttttttttttttttttttttttttttttttttttttttttttttttttttttttcgggtcgtttttttttcgttttttttagacgagcggagcggggttagggcgagcgggcgagcgagtcggagtgagcgttaagtgaggggtcgcgcgtaagtcgtaggcgttcgtagttattttgggtcggtcggagggagtagttgggtggtcgttgataggttggagcggcgcggggttgcggcgggagagttcgcgtcggttttcgtttttcggttcgtattcggggttttttggttttgaagagcggggtttaggggttcggcggttcgcggcggggttgttgtatttggtttgtttttcgttcggttcgcgttatttttattttcgttgattgttgacggggcgcggattcgcgttcggagttcggaattgcgtggtggggattcgggggacggcggtcggggttacgaggtttttaggatcgagagttcgggtttcgttgttgtattgtcgttagtttttttttcg

SEQ ID NO: 6467 - DNA, 2054 bp, synthetic construct
  misc_feature 1..2054: note = Description of Artificial Sequence: Synthetic polynucleotide
  source 1..2054: mol_type = other DNA
acgcggcgatgttttaagtcgttttttgtttgaaatttcggcgtattttcggggaagtagtgttacgttttagaaaggcgtttgtgttgttttttattggggaaacgtagtgtttgttttatatgcgtcgttttatagaattgtagttttaatcgtttatttggtttttttttcgggcgttgggttattattttttttaaatatgcgttcgaatatttgtgggtttgtttttcgttgaaattttagggtgtttaaaggttacggggtcgcgatgatattgggtaggttttcggaaattttttaggattttttttattttaaagtttagttagggacgaaaggggttgggagttgaaaaattgtttttttaattttttcgggtgggaggtagagtcgggaatatatagaattttatttcgaaagtttcgggaaagagaagtttgagtttaggagcgtgagaggagaatatattcgggaaatttttgtttcggtcgttgtattttcgcgggcgtttaggtgggacgtgggtaggtgcgcgagcgtcgtgtgtgtcggtgtggatttgtgtgtgtgtttgcgtgtgtgcgtgtgcgtgtgtcgcgggttggtttcgggatattgaggattttcgggtcggtttaggtttgttcgattttgttgttttcgtcgttcgttcggttttatttttcggcgggtcggttttttatttggacgcgtcgcgttttttttttttagcgggagcgtcgtattgatattgtagatggagtttatgtcgttgtttttcgtttttttttgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtttaaggtgggcgtaatgtttaataaaaaggtcggaaaatggggatcgatttcgaatattttttttttttatttagtttcggagttcgagtagcggcggcggttttcgggggttgcggtggcgacgtcgggttgttttttttcgtttttattttcgcgggttgaatgtttttgatgttaagcgggtatagcggcgttatttcgcgtcgtttatgttcgttcggtcgggtcgttgttcgggcgcggcgagtgcgcgggggattcgtcggggagcgttttcggcgtttttgcgcgtttttttgggtagcggcggtcgtttttcggtagttcgcggtcggtcgcgtcgcggtagtttttatttttgtcgagatattcgtcgggtagtgttttggggtcggggttggggggtcgcgggagtcgtcggttgtttttcggggaggtgcggggttgcggcggtggtggttgcggcggttggcgttgcggcggcggagagttcggtcgcgggtcgagtcgggtttttcgggcgcgttttcggtttttcgggcgggttgttcgtaaagtttgtagggggtagggagcggggtcgtcgttggttcggtcgtcgtcggagttttcgggttgtttgttgtcgtcgcggttcgttgttgttgtgtattgaagttcggttaagcgttgtaaaaattttagttgtttggcgttttttgggttttttttttttttttttcgttttttttgtttttttttttttttttttcgtttcgtttttttttttttttgtcgttcgtcgttcgtcgtcgttttttttttggttcgttttcgttggttcggagttcgcggttgatatttagagcgagggagagcggtcggtagagggggtagggggcgtttttttatatgtttttattcgtcgtcgttcggtttgtcggttttttttcgtattaacgtttgtcgatatttttttgggttttttcggttcgtacggagttattttggcggtggcgatgtggggcggagagaggggtatatatgggtgatcggagcgtacggcgcgcgtttagagggaggcgtttagtcgtttcggaatttgtagttttgggcgttggtcgtcg

SEQ ID NO: 6468 - DNA, 1258 bp, synthetic construct
  misc_feature 1..1258: note = Description of Artificial Sequence: Synthetic polynucleotide
  source 1..1258: mol_type = other DNA
tcgcggaagcgttttttgttgggtagaagagtgggtttttcgtcgcggcgtatttgtttcggttgtcggtttttcgtatttatttgtacgagatttgttttcggaaagttaagttttttagttttttttttagcgtttcgtttttttttttttggtcggcggtcgcgggttcgtttagggtagcggttttcgtcgtcgcggttgattttgcgtttcgcgggttcgcgtcgttttcggcgtttaggtagtagttttcggcgtcgttttcgttgttgttgttgtcgttcgtcgttttttttttttttttcgtcgaggagttggggtttatggcgttcgtttcggcggtcgcggagggagcgtaggcggcgtcgttgtaggggtcgggcgggttggcggcggcggcggcggcggttgtaggagcgcgggtaggttcgcgcgtcgttggtaggggtagtaaatggtagttttttttcgtagtatttattcgcggttgtatcgtatcggggtattgtgggaaatttcgtttattttttcgtttcggttaattagaggtcgtcgtttttcgtttttcgcgttttttcgcgtcggttcgtattttttagtttcgttggtttttttttaaatttcgagcgaaagtttaagttgaatatgaattttgttcggaggcgacgggttgcggcggagggggagagagaggaggataggttgcgatttcgggttggggacgttagggtagggatagcgagtattaggaaggagagcgttcggggaattcgagtggtcgcgttttgggttttgtatcgtgaggttggggggattaggatcggcgggcgtttattttggttttgagtttagttgtcgacgttgggttagtattttttttatcgtcgttttttagtgagtagagttgggtttaggtagtagtttttgggcgcgggaaggtagcgggagttgtatttaggggaggggggaggtagtaggagtttcgttagtgggaattttggagtgaattcgtcggcgggtgttaagtcgaagcgtcgattttttgtttttggattggggttcggatttttgcgtttttaaattgcgttttcgttttgttcgtcgttcggtgttttttttaggcgtagtagattttcggtaaatagcggttaattcgatggaatcggattatagggttttcggtgaagtagaaaggcggaggaaatttaggaggtagaagtgaggattttggcgtttggcgtcgttgcgttgttcg

SEQ ID NO: 6469 - DNA, 628 bp, synthetic construct
  misc_feature 1..628: note = Description of Artificial Sequence: Synthetic polynucleotide
  source 1..628: mol_type = other DNA
gcgtggaggttgcggttcggcggggtaggcgttgagcgtatcgcggcggtattcggcgtagaggttttagcgcggggagtcgggtttagtttcggtttgttagcgtcgcggttttagtttattcgaggtcggtttggggggttcgtagggcgcgcggagcgtcgagtgcgcgtcgggttgggtttcgtatttcggtgtaggagcgcgggcgcggcgcggcggagcgtttcgtatggagtcggttcgggagtttttttcgcgggttcggtcgtcgtcgtttttcgtcgcgcgtttcgcgttcgttttcgtcgtttttaggtcgcgttcgttcgtagaggttgaggttcgcggtttcgaggggttgttgcggcgattcgggtcgggttacgagggtagtattagttggaaggcggttttggagggtaagcgcggagcggttttttttttttggtttagggatttttgtttaggttcgattcgcgattcggaggcggttagagttattttggtcgttgtttcggaggggagcgttgggagcgcggcgtcgggacgcggcggagttatttattttagggcggttagacgtcggttcgtggggtggggtgggagggaatcgggggttatcgcg

SEQ ID NO: 6470 - DNA, 1075 bp, synthetic construct
  misc_feature 1..1075: note = Description of Artificial Sequence: Synthetic polynucleotide
  source 1..1075: mol_type = other DNA
gcggtttttagggcgagtattttcgtttttagcgttttttggttattaaagaaaaattagacgtttgcgacgggtttttttttcgttcgggttttttcgtttttcgtttttcgtcggttatcgggcgttattatcgcgggtagtagggcggggcgttttgggagtcgttgggtgtttgggttggcgtttgtaggggtttcgcgggattaggtcggttgtaggggcgcggcggcgtagtttattttgttgttgaagagtcgcgagaggttgcgtatgggcggagggggtcgcggggtatttcggagttcgcgtacgttttagaggcgtagggcgtcgtcgtgcgaggcggtgtagagtatttggtcgtgtatttgcgggcgtaggggcgggcgttatcggtgacgcggtaggcgggggggatatcgttgttcgcgtggatggatcggggcggggtatttttttttttacgggcggcggtttcgagaagggtagagggatttatttggatgtagttgatgatgaatgtgtggtttcggaatatttttcgtagttttttagattgcgcgtcgaaggttcgggcgtaagcgttttcgttgttcgtgaatattgcggatatatagcgcgcgttgggtttttttttttgttcggtttttcgtaagtagggatggggcggcgagagcgtgatttggggcgttttcgagatttcgttttacgggggtattttgaggtttatatgggaagtggatagtgtttttttagagaaacgggtttttacggttattttgttttattttgtagatgtttgcgcgttagttggttttgtttttgttttgttgaatatcgttcgggtttagtttttatttcgcggtttggtgaagttggttttcgtgtttgtttgggaagtttttgtttggggataatcgttaggttttcgagtcgttttttttttatttttcgttgcgtcggtaattttattttttcgtttttattaacggatcggtatttaaattaaagtttagttttttggggtttatgattacgtattttcgggatttttagcgggggcgagttttcg

SEQ ID NO: 6471 - DNA, 5566 bp, synthetic construct
  misc_feature 1..5566: note = Description of Artificial Sequence: Synthetic polynucleotide
  source 1..5566: mol_type = other DNA
gcgtttttttagcgatcggggtagaattaggacgtgtaatgcgattgttttttttttttcgtttttcggtagagtttttgttcgcgttaatttatttattaggttttgttcgcgttacgcgcgtttttggtaggtttggggcggggaaaggcgaagcgttgggtacgcgagggtttgtgtattttagtttttacgacgtttttggttttttttaggttcgtcgttgtcgtatttaatttttttttttcgggggttattttgaagaagttttagattttagatttagttttttagatttcgttttcgagttcgttcggtgggtttgtaggtcggttttttttcgtttagaggagagcgtagatacgtaatgttcgttcgttggtttcgttcgttttatttttgtttttcgcgttttttcgtttcggtttttgtttataggtcgggtcggaacgttagttttaggagtcgacggtggttttttgttcgtttcggggaaggtgttgtttttttatcggttttaatttttcgttcggcgtttggggtttggttgcggggttcggtttttagtcgagggcgtagggttggttaggtttgttttggttgaggtggagatttcgtttttagggattgttgggcgtttttgtttcgcgagtaacgagatcgtcgcgagcgaacggtttttattgagtttatttttttaagtgttattacgttaagttagagaagcgaggcgagtggaggggacgtagaggggtcggaaaagttatttttttttggtttcgtttttagataaaaacgggagtttggttcggtattcgggcgttcggtgttttcggggcgttttattgaggttttgtttgtaaaattagcgttcgtgttttgaagcgtacggcgtttggaagttgtttttttgttcgtttttttcgaggtttttttttgtgtagcgagtttgagaaatatggaggatcgtttttcgtaagcgggtggtcgcgggcgtttttcgatttttgggtgaagttagagggaaaacggggttttcgggttagtgttttattttttatttcgggagaaattaatgttcggagagggttcgtttgattcgtatagaaaggtcgattttgagggcggcggtcgttcgggggagaaagcggaggttttgggttcgcgggagcgcggtagtcggggttggtatcgtagaggagagatacgttattgtttcgtatttttagaaagcgcgaggcgtcgttttagttggggtaggcggtcgaggtcggtttttatgcgcgtttttcgaagttttttgaaatattttgcggagtttcgtgtgtatagaatttagtatcgtttagtttttgggtagtttaattttttgtagttttattttagttttttcggttttttgaacggtgattttttttatcgtttttttagagttgtttcgtgtttgggtttattttggggggttcggtattttttagttatttttttttttatttattttttttttttttatttttttttttattttttattttttttttttttaggagagcgatttacgaatttttttttttttagttaattttagggtttagttcgtagattttgcgagggtaggtttttgtttatcggttcgttaggcgttttggaggtgacgttttgttttttagagtttttgttgtagttacgaattggggtttgggtcgtaggaaagtatagggttgaagtttagcgttttggggttatttatattgaggtagttagaggtaaagagttttaagaatttagaaaatattttttaggaagtcgtttaattggtttttatgggataggtggagttattaatttgggatggttttgtaggaattaaagagtttagggttttttttttttttaatattatgtttaggagatttagagtcgttggatttttttttttttgattggtgattattagagtttttagagttgtagaaaattttttttttaaaaaattaagtaagcgttaataagattttttataaatttttattagttttattttttcggggggtaggtagattgtggggtttgattttttgagattcggggaggatttttggtagatgtgtgtttagttagaatatttggtaaggatttttttaatgaagaaaaagtggaggaatttagttttagcgagaagaggtttttttattttgttttagatatatcggatagagggtatattttgattagagttacgtttagtggttaggaggttagtttagtatttttttttttattattttcgttttgggtgggggggtaatttttttgggagtagttgtgggaattgtcgttttttattttagtttagttagtattttgaagtttgtaggggaaggatagtacgtgggatggatattggggaaggagtttcgtaaggttagggtgtaatttttaggttttaggtggtttggtaggttacgttgtttcggagatgtttgttagattttttaagtttatttagggtttggtagtaatttgttggttgtttttgcgggggtttgggttgttgagtacggtgtagttgtttagggttaattagttttagggtgttcgtgttaggttgcggttttttcgtttttttcgtattgagggtatttatggcgtgtaaatgttttcgtatttttagagttgttttatcggatgtttttaggaatttatatatttttataaaaatgtattttaaatgatggataggcgagtttggggtaataacgggtgtttggtgggtagataagagtaaatgggaaggagttcgagggaggagggggaagagaagaggaaatagaatttttagttggatattttgataatagttggaaggaaagtttagaaaagatgaagagagaggaggggagaaattaattggggtttttatttttgtcgttggatttttaattttcgttttaaatgggttttgtttttcggtaaaattagtttaaaggattttaaaataaagaaaacgagatgatcggtttgggagttttttaattagagtagagaagttagaggggggcgggcgatttggttttgaagttttagttgaatagttattttttttttttttggtaaaaaggatttttttagaattttcgaggtttttggattttttttttcgtaaatggagtcgtatattgtattttttcgttttttcggatcgttaagtatgttttatgagggtcgttgttttcgggtggaatgcggtcgtatgtacgcgtttttttgtatacgtatatatacgtatatttataataagtgtttgtaggaggagtgttttgcgcgttagttttgcgtttaagataggaagttgtcgggttatcgagttaaatgggagtgatattatttttttttattagtaaggaaagcggattataaaagtttttttgtatttcggtagtttatttaatattatttatgtattttgtgtaaggaattgtgggatttcgttttacggtaaataatatggaaattttaaaaatagcgatttttttgtgcgtgtttatttacgcgtttcggggtgatttggcggggttgtcgtcgggtgatttatatttttgaatcgcgaagcgatagggaaagcgcgggcgagcgtaggagacgcggtcgggggttttttcgggtttttgggttttcgtattcggagcgggggacgcggtcgttttaaggggaggaggggcggcgggttgtttttgttatttagcggcggtcggagcgttacgtgggcgcgcggcgtcgcggttattggttcgaggtacgtgtttaggagatcggtttgcgacgttattcgagggggttttgttaaaaataagaataaaaatttagagtgaaagtgttttaggttgcgtcgagtggtttggaaattttcgagttcgcgcggaggtcgaggcggcgagggcggcggacggtcggggagcgcgggcggtttagttcggttcggtcgggttttggtttcgcgttttttatttatgcgattcgggtcgcggagttttgcggggttcggcgggggcgcggtcgtacgtcggtggggcgtttcggttcgtagcggggcggcggtcgcgaggagggggtttttatgtgcgtgcgggcggtggcgggcgcgttgatcgcgggcgttcggtattttcgagggtcggttagggcgtgcgggcggggacggtcgggcggcggcggcggtcggagtcggttcgggcgggcgtgagcgtcggggaacgcgttgtttgtatgcgcgtagttttcgtttcgggcggtttaggcggcggcgtcggagttcgaggcggtcggacgcggagaggagcggggagttcgggaggcggttcgcgttttcgtcggattattgcgattgtttagatttcggttgcgcggcgaagtcgaggatttggttttgttgaattttttatcgtttgggcgagcggggcggttcgtggtgtttttaatttagttcgtggatttaaaggtggtttcgcgtcgagcgcggtcggcgatttgtaggattttagttttggtcgcggtcgtcgcgtacgttttcggaagattcggcggggtgggggcgcgggggttttcgtgtgcgtcgcgggagggtcgaaggttgatttggaagggcgttttcggagaattagtgtgggatttattgtgaatagtatggaggagaatgattttaagtttggcgaagtagcggcggcggtggagggatagcggtagtcggaatttagtttcggcggcggttcgggcggcggcggcggtagtagttcgggcgaagcggatatcgggcgtcggcgggttttgatgttgttcgcggttttgtaggcgttcggtaattattagtattcgtatcgtattattaatttttttatcgataatattttgcggttcgagttcggtcggcgaaaggacgcggggatttgttgtgcgggcgcgggaggaggaaggggcggcggagtcggcggcgaaggcggcgcgagcggtgcggagggaggcggcggcgcgggcggttcggagtagtttttgggttcgggttttcgagagtttcggtagaattcgttatgtgcgttcggcgcgggcgggtcgtttttagtcgtcggtagcgatttttcgggtgacggggaaggcggttttaagacgttttcgttgtacggtggcgttaagaaaggcggcgatttcggcggttttttggacgggtcgtttaaggttcgcggtttgggcggcggcgatttgtcggtgagttcggattcggatagttcgtaagtcggcgttaatttgggcgcgtagtttatgttttggtcggcgtgggtttattgtacgcgttattcggatcggttttttttaggtgagttcgcggggattacgcgtttcggttcgtcgcggggaggttcgcggagttggggggcggtgttggcgcgggaatttatcgggaggaaaatatttcgaatttttttcgcgtatacgtataaagatttacgcgatattgtgtgaagttgacgtcggttcgggtagcggttaggagtttagcggtaggattgattcg

SEQ ID NO: 6472 - DNA, 5566 bp, synthetic construct; identical to SEQ ID NO: 6471
  misc_feature 1..5566: note = Description of Artificial Sequence: Synthetic polynucleotide
  source 1..5566: mol_type = other DNA

SEQ ID NO: 6473 - DNA, 1164 bp, synthetic construct
  misc_feature 1..1164: note = Description of Artificial Sequence: Synthetic polynucleotide
  source 1..1164: mol_type = other DNA
gcgatttgtttagcgttaaatcgcggttttagttttttttagttttcggtttagtcggtttattagtcggttcgcgttttgtagtttttttagagggacgcgtttcgagatggagagtaaagttttgttcgtgttgattttggtcgtgtggttttagagtttgatcgtttttcgcggaggggtggtcgtcgtcgatcgtaagttttgcgcgtaaatttttttttatttgtagattcggcgggtggttattgttattcgaattgaggatgagaagaaggaagttggaaggggcggtggatgcgtttagggatttttttagtttgggttttagtttcgaaacggttttcggagtgggatttaggaggggtcgggagggaattttttttcgatcgtgaagcggcggcgtttagttttcgttttttttttttgtcgggttttcgcgttattttttttattttggttgggatcgcgttttcgggttcgtaggtttcgtcggggaggtttcggggtgtgggggtcgggacggcggaggcggggagtaagggttcggttggcggtgatttgtagttatttttttgtcggaggggttttggaatgaaaggcgcgcgggttaaggtgatttcgttttggttggtattgcggtttagttttcgttcggggattcgcgggtcgattgtggttttttttggggaagtcggggcgcggggaggcgtttcgggtattttagtcgtacggggtacgttcgttttcggcggggtttttcgtttcgttgtgggagtggtagtgggtgtcggggtggagaaagtacgcgtggcgcggagttttggggacgcggcgttttattcgttttggggagtttcggattttttttagtttttaggttcgtatgtttttttttttttagtgttttgagaatttagcgaggggttgattttttcgaaatcgtggcgtagttattagtaatttgtggtcgtcgattcggggggttgttaggtttgcgtttggttattttttttgttttgggggttgaggttagtttcgggcgttcggtttcgtcgcgcggttgcgagtacgtggggttgacgggcgtcgcgtggaggtagcgagtataacggtggttatcgtcgttagggaatcgttcgttcgttggggtttaggcgttcg

SEQ ID NO: 6474 - DNA, 1495 bp, synthetic construct
  misc_feature 1..1495: note = Description of Artificial Sequence: Synthetic polynucleotide
  source 1..1495: mol_type = other DNA
tcgtaaatttttttttgcgtcgttttttttcgcgtggaatgggacggagtagtttttttaggcgttgtttggttgcggaggggagcgggtagcgagagtttcgggttttcgtttgggttttcgggttttcggggcgttggtttcggttttcgcgtagcgtttagcgatttttgtcgggggttttcggtagtcgcgtcgttatttttcgttcggttagcgcgggaggaaaaggggttgcgttcgggagcgtcgagtttaggtttttttcggtggcgtgttcgcgttttggggtgggggtgtggtggggaagagggagggggcgaggttaggggagggtgcgaaggaggcgtttgtttttaatttgcgggcgggaggtgggtggttgcggggtaattgaaaaagagtcggcgaggagtttttcgaaatttgttggaatttcgggttcgcgcggaggttaggagttgagcggcggcggttgtcggacgatgggagcgtgagtaggacggtgataattttttttcgatcgggttgcgagggcgtcgggtagaggttaggacgcgagtcgttagcggtgggatttatcgacgatttttcggggcgataggagtagtttcgagagttagggcgagcgttcgttttaggtggtcggatcgttcgtcgcgttcgcgtcgcgttttttgtaggtaacgggagacgttttcgcgtagcgcgagcgttttagcgcggtcgttcgttttttttttcgagggataaattttttttaaattcgattcgagtttttggattaaattcgtttgcgtcgagagtcgttcgcgtagagcgtttcgttttcggcgagatgttcgagcgtaaagaaggtagaggtaaagggaagggtaagaagaaggagcgaggtttcggtaagaagtcggagttcgcggcgggtagttagagtttaggtgggtgcgtagcgcggttcgggttttacgattttttttttgttttttttatttttttttttttttggatgtcgtggtttttttttttttttttttttcgtttgtttttttcgttttgcgttttgagcgttcgttgagtcgcgcggtgtttttttttttgggggtcgtcgtttatttgggcgtcgagttttatcgggcgtttacgtttagagtttagggtaagggatagtagtttcggtcgtatttttttagagtttcgggagcgtttcgttttttggtacggtttttttttagcgttttagcggttgagtttagttcgggagtgggatttgggttataggagtcgaggttgcgtgcgcgcgtgtttcgcgttataagcgttttgtacgggggtcgtgtgttttttagcgggaaacgttggaatgggtcgtttggagggagagtcggttttttcggtgtgtttggtagcgtagaagtgggtggtcgagtaagaggtcgcgtgggaagttagtttcggcgttttggggtatagggtaagcgatgtagagtgcgcgtcg

SEQ ID NO: 6475 - DNA, 352 bp, synthetic construct
  misc_feature 1..352: note = Description of Artificial Sequence: Synthetic polynucleotide
  source 1..352: mol_type = other DNA
gcgtttttggtagtagtcgtttacgttttcggttttgcgtatcgggtttgtttcgggaggggcgcgtgacgttatcgcggggtagtcgagaggggatcgcgggtttcgggtagggtaggcgttttcgtagttttagttataatataagggagagaaagtaacgttttggttttagaaatttttatcgttaaggttagttttggttagacgtatagttaaagagtttttttagtttagcggatgaatcgttcgcgagtggtattttttaaaattttggttttattttttaagatgtttttttattgcgtaatttagaaagtattcggatcgtcgttatttattagcggcggcg

SEQ ID NO: 6476 - DNA, 1141 bp, synthetic construct
  misc_feature 1..1141: note = Description of Artificial Sequence: Synthetic polynucleotide
  source 1..1141: mol_type = other DNA
tcgtttagtttttagcgttgcgttgttttcgcgtttatcggatgattacgaatatgattagcgagttgtttattaagtttacgacgaatattacggagtagatcgtcgtgatgatgatcgggatggtcggggagatgtgcgcgggttttagttgcgcgtttttcgagtcggcgttgtcgttgttgtcgggttcggtttagtcgggaaattaggcgttgttgttggggggtaggtaggcgttcggggcgtaggtagggttcggtttttcgcggaagatttggatcggggagtttatggtggggcgattgtagtaggaaggcgaggataggcggtatttgcggcgttgcgggagcgaaagaatcggttggacgcggagaggtaaattttgttcgcgttttggttagcggcgttggggattcggagtttgcggatttttattcgggtcgtaagtcgtcgggggtaggatagggagaacggatttttcgttgttttttcggttagtaggcgcgtcgttgggtgttagagaggggcgaagagcgttcgtttttttttttttagtttttgaggtgttttttttattaattttaggtatcggtttttggtggaattgtttttagattgtttgagtttttagggttaagttttttttttattttttagtacggagttttatttagaattgtatttcgaaagtttaaagtttatttatggtttttagagataggcgaaggcgaggttttttacgggacgttttggtaggtgttgaatcgcgcgtttacgagtttcgtttagtttttggtattatttgttttcggatttcggtttcgtttttcgttcgagggttgttgtttcgtcgagcgtagttttcgttttttagcgtacgttttttattattggcggcggttttgcggggcggggcggggcgggatcggcgggacgtagtcgggacgcggttgggcgttgggggtttgcgggcggagagttcgtttggtgcgttcgttttaggtcggtaggtttttgtttcgtttcgttcgttcggagttagtttttagttttttagttttttagtttcgcgttttttttagtttcgtaggttcgttcggtttattaattgttcgagcggtatatcgtttggttttcg

SEQ ID NO: 6477 - DNA, 3297 bp, synthetic construct
  misc_feature 1..3297: note = Description of Artificial Sequence: Synthetic polynucleotide
  source 1..3297: mol_type = other DNA
tcgttcgtcgtttcgaagttgttcggttttttttttagttcgttttttagtttcgtaaggttttttttttatttttttcggcgattttttttcgaggtttttcggaggcgtttggattttttttttttgtttttcgttttgtcggtcgttcggttttcgagggggtacgaggagttgtcgggtcgtttttcgtttttgttcggggcggcgttggtattgttcggtcgattttcggggggtcgttcgttgaggtttttttattcggtagttaagtttagggaagaagacgttatcgttgggtagagttcgtttatgtcggtgagtatcgtggtttttattacgttttatatttagtttttttaggatattagtttttttcgattttttttaattttaattgattcgtttcgttggggttagtagtagggagggtggtaaggtcgggaaggtcgggacgtggttgggtaagttttaggacgggatattggcggttttcgggatatcgttttttttcgcgggaagatattttaagttatttttttttgggttattttttttttatggtttaagaaaacgggagggagttttcgttttttttcgaggttgttttttaaatttttagcgtgtcgttttttttcgtttatttcgagttttttttaaacgcgttttcgtttgtttttagcgttcgtttttttatttttttgttttttcggtaggtaagggaggaaatgacgtgatgttatttttgtgttaggttagtttttagttttagtttagtttttcgggttttagggaattaatttcgcggttttatcgggttttattttcgaagggacgttgcgggttacggggatacgcggtgttgcgagttcggagagttgggcggttgggttttttttttcgttgttttttggtttattttttttttcggatttcggagtttttggagaaggggacgcggagggcgattgtcgagggttttagcgggatttggagttaggggttagtttttttttttatttttcgttcggttgttgggtggggttttcgcgttttggttagttgggagggggcgagggtcgttttttagggcgggaagatcggaggtttaggttgcgtcggggtggggcggggatagagtttagagaggcgtttcgggtcggggagaaggtagggggttgttttttagagacgcgtagtttatagacgcgaagttttggggattaagcgttttttttatgtttgtcgtttattttcgtttttttttttcgttttttttatttacgaggttcgagtacgtagtttagtatattttagtttcgttcggtttcgcgcgtcgaggggaggcgatgatatagagggtttcgcggacgttttttacgcgcgtttggtttcgtatttatatttttgggatttgttaatgcggggttggagtagtggggttgcggtcggggtggaggtcgcgtttcgcgtggggtttcgggggtatttttagtattcgcggcggtggagtgcgtcgtcgttggagggaggcgagacgtgggattgttcggtcgggtaaaaggagtgagggggcggggaggaggtagagtaaggggaggaagaggtcgggagaagagggttagagtaaagatcgagagtcggagaaaggcgaaaggcgcggtgagtaatcgtcgacgtagagagggtagtttttcgcgttgtaatattgagaaggtattcgcgggacgtatgcgtacggcggacggaggcgagtcggtcggggtttttttttcggtcggtagggtggacggtgggttcgtgagtattttagtttttcgaatttttttttttcgtttcgggttcgttttgaggtttcgtgttggaaagtggtcgaggttgggaggggcgcgtcgttcgttcggattttagggtgtcgtcgttgttgcggggcgggagtcggtgcgagtcgggggttttttttcgtagtgcgagtttgggggagtggggttgcgagtgcgttcgcgtgcgaagaggggtatcgcgttattaggattaatatgtttcgggtttgttagggcgttcgcgattttatttttgcggtttcgcgtcggtgttttggtggggaacgcgggagtttagtttttagattttagaaatcgtattgattattcgaagcgtatttcggaaagattaggcgggtggaagcgtcggtttttttacgggatagggagaggataaggaaggggttgggcgttcggggttggtggtttgagcgtcgttgggaagggtaaggagatagagttttttggaatcgtagcgtttttttttaggagaagtgtaattagggtaggggtatcgaggggtagggtgaggaagtggacgttttacgcgtggattttagaagatcgattaggtatgggcgtttattcggagtttttgtttacgtttttgaaaatcgaatgaatagagaagtgttttttatttttcgtttgcgttagggtagttaacgtgtaggcgtcgtcgggatttttttggaataaattcgggtatttgatttttcgtattttcggagttgttttgggaagtcgaaataagtttgggcgttcggattgcggagattggaaagtagggggcggagggcgggagattgggggcgggaagtggaggtgtaggttgtagttggggatcgcggtgggcgttggaggggagggtttgtgtgcgcggttgttttttagcgttgggggagcggacgggttaggggtttttagggaagcggcgtttcgggatcggggtggttttttcgtttttgtgtgcgcggcgatttttatatttagttcgggcggaggagttttgagagaagcggttagttgagagtggggtgggcgttttggggaaaggtttgcgtgcgttgcggttttatcgttgttagagaagtggaagagagagagtgggcgtcgggagggggtttataggcgtcgcgatttattttatttttttttacgtttgtgggggagtgagtggggaaggggttttgggagaggcggcgcgcgggtattgaggtgtatcgtgagtttttcggatttgatagtattaaaggaaaattttggcgagtagttagggttagcgagcgattttagtagtagggacgcggtcgtgcgagagttcgcggataggcgagggggattttaggggagtagttgttgtttacgggttacgggcgatgtacggagtggagaagtgaacgtggtttataggatttttgttcggaaggtggagagcgttataggggaattttttcgatttttgttcgtttcg

SEQ ID NO: 6478 - DNA, 2213 bp, synthetic construct
  misc_feature 1..2213: note = Description of Artificial Sequence: Synthetic polynucleotide
  source 1..2213: mol_type = other DNA
tcggttttaaacgtttttttagttatttgtgaatcgcgaaggagtcggttttcgcggcggggattttgttattagtattttcgcgggtcgaggtcgttttttcggtcggtttttcgttttattcgaaaaggaattagagtatttatttaagacggtgattggtagggtagattaaggtgttttggtttcggttttagtttcgcggtgcgtttcgttcgtttattttgatcgggtgtaggtagttatcgtcgcgtagggcgtttaattcggcgttcgtcggcgtttcggcgtcgttttgtaggttgcgggtgagatgcgcgatgtaggtggtggttagtagtagtacgtttagtttggatagtttggtgtcgggcggtacggacggtagcgtgcgttgtagttttaggaaagcgtgtcgtagggtttgtattcggttgcgttttcgcgtcgtattcgtcgtcgtcggtcgttcgttttcggaacgcgagtcgtttttagggttcgtcggtttcggttcggttcgttcgggacgcgagtcgcggatggcggcggttaggggcgcgggttcggcgttggcgttgagggggttgttcgttgggcggtcgcggtttatggtagtttttcgcgtcgcgcgcgttgtaaaggatcgaaggtgcggtgaggtcggggggcggtcgggtttaattcgagaggcgtagttttttggtttttttcgtgcgtttattagtagtttaacggggttaagggcgtttttaagcgagttcgttttgtttgggacgcgatttgttttcggacgtttggggagagttgcggaatttcggagtttttgggttttttagaaggataagaagaggcgtagtgtcggttttgttttttaggggtaaattaagtaaaaggtttattttattcgggaagaaagatttcggaagtatagtttaggattagtattcgttcgcgtttgggtgattttatttaattcggtacgtacgagaggtggcgcggttttttttcgtcgacgtcgcggaaaattacggtttattagtcgttttcggttttttacgttaggggggatttttgttcgaggagcgggggatttttagttttatttcggggtacggtattcgttatcgtttcgagttcgagagttgcgtagtacgcgtttgacgggttttttattttttttggagcggttgagtggagtttcgtttcgtcgtgagggcgggcgaggggcgtggagtagggtttgtgtggttagggtcgcgttggttattttattttcgttcggtcgatgtttaagtcgacggttgtttttaattttcgttggttgtgatttttatgcgggcgtttcgcggttaggcgtgtgtgtttcgatcggttaaggtaggtcgggcggaggatttggtttatcggagaggttacgtcgggggttgaggcggtttagagggttattaattaaatttttcggcggggcgggttcgggggcggggcgtttttttggtttcgtttttcggtttattgttttacgttgtttttttcgaggcgtttcgttgagggcggcgtgtggagagtttggggtgtttgtcgtcggttgcggtggggtcgggttggaggtcgcgggtgaggtttgtggttaatttcgcgttgtcgaggttttattttttcgagtttagtttgattttaggtcgtttttaggtcggtgtttagttgaggcgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcgaatgtttttagtgtttgtaattttttaagaagtttttagagtagatagtttttggatcgtgggtattttttttcggggacggggattttgttgatcgttttcgttgttttcgcgggggttatcgttttttaattatttgggcgaaatatttttttttggttttgtatttgtggatttacgggaagcgtgatttgtagcgaggtaggattcgattttaggtttttttagaaagcggacgttgcgttttaaggtttgtttagagtcgttttaggaagtcgtgggttttcgatcgttttaaatcgtagcggtttttgtaggttttggattcgtcgttttcg

SEQ ID NO: 6479 - DNA, 363 bp, synthetic construct
  misc_feature 1..363: note = Description of Artificial Sequence: Synthetic polynucleotide
  source 1..363: mol_type = other DNA
gcgtttagtacggcgggtagcgtcgcgttgcgtatcgtcgtcgattatgagcgaggatagtcgcggagatagtcgcgtcgagagcgttaaggatttggagaagtagtttcgtttgcgcgtgtgcgtgtttagcgagttttagaagatcgagcgggattatgtgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcg

SEQ ID NO: 6480 - DNA, 960 bp, synthetic construct
  misc_feature 1..960: note = Description of Artificial Sequence: Synthetic polynucleotide
  source 1..960: mol_type = other DNA
tcgtttttcgacgttttaattagttattattttttcgaaggaaaataaatcggtttttgatatatttttttacgtgtagcgttcgacgttacgggttttgggcggttgtattttttttttgtcggttacggtttaaggttttattattgcgcgtatttagtttttttttaggtgattttcgcgtatttggcggcggcgttttaggtttcggaggttgttcgggcgggttggggttcgggcggcgttcgttgagagtcgcggcgttttttagtcgtttttcgggcgtcgatcgtcgtttttttgtttcggggtggggtttaggggtattagtagtcgcgggttttcggtcgtcgtttgggaatttagggttagatttagttttataataacgttttttcgttacggtaatttaattggaggtagaagtcggcggggcggtcgagcggggcggggcgggagcgcggtcgtcgcgagttacggtggggagcgggcgcgggggattttggcgggtttcgggtagcgcggttgtatttatttgtgttataattgcggcgacggggggttgaggaatcggtttttttaaaagtaaatcgaaaatgggtaatagagaggtcggggtagcgttaagaggggttttgtttcggtgtttagggtaaaaaattcggtttcggtttttagaaattcgagttagcggtggtttttttttttttttttttttaaacgtttttgtgttttcgggtcgaggggcgtttttcgcgcggtttcgagtgtatagcgatattagggttggcgttggagaggggagttttttttttagtatttttcgggtttttttcgtatttttatttatagttttttttttgggttcgacgttttttcgttttgtagtcggagtttgggtttggtgtttattgtttcgcggggtgtttcggacgtttggtttttgtagcgttttttacg

SEQ ID NO: 6481 - DNA, 1404 bp, synthetic construct
  misc_feature 1..1404: note = Description of Artificial Sequence: Synthetic polynucleotide
  source 1..1404: mol_type = other DNA
acgcggggttttcgggaatcgtcgtttttttttttcgttttcgcgttcgcgttttttttttcggggtttcggtttatttatttttggtgcggtttcgtcggatttaggagtttcggtcgttcgggttgcggggagggggcgtttcgggtcggttttagaagttattttgtaaagaggtagggggcgcggggtcgcgcggggcgagttcgggattcgcggggaagaagtttttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatgagttgatagcgcgcgtttattggttcgtggcgtcggaggggcggggcgtcgtttagggtcggttaatgggcgtcggttttcggtttttcgaggaagaggggggttcgggcgtcgtcggggggattttttttttggggcgggcggtaggtggggggtgtgggtttggtcggtcggttcgttaggcgcggggtttaggttaggttggggttgtttggaggttgcgtttttttttgttcgcggcgtttcggttttcgtcgtcgagagtggacgtttttttggggtaatttttttcggtttagaggtagtttcgggggcggggattttgcgaatcggggatttcgtgaggtcgttcgttattcgtgggtagtgaaacgcgttagcgcgtagagtagattcgtttgcgttgtcgtttgttggacgttttttgagtatttattggggatcgagtgcgggcgaggtagtagcgaaggaatcgggaggggaaatttcgtgaagattatttgaaaattgacgtttaaaataaacgaattttttagtattcgttaaaggatagtggttcgttagtgtgtttgttacggggcggtcgtaggatttgcgtttggaatcgggcgggcgttcgggacggataatgtcgtttggcggtcggtttcgcgggaggttttcgtacggggttaatttcggtcggcgaagttcgttgttcggaatgcgaggtcgaggtttttttttgtgatagatcgggcggggttaggaggaggggtagggcgggtatttcggttcgaagatttaggaattgttttggtttggtttggggtttatatttgacgtttggcgagggttggtttcgggtttggttttatcgggtttgggagggacgggcg

SEQ ID NO: 6482 - DNA, 1247 bp, synthetic construct
  misc_feature 1..1247: note = Description of Artificial Sequence: Synthetic polynucleotide
  source 1..1247: mol_type = other DNA
tcgtggggtattacgcgcggatttttgtttggcggtttttgcgttcggggttgttgagttcggggttcgttttgaggtcgcggttgtggtttttggttttttcggttcgcgttattgtcgcgcggcgttcgttgtattttgttttttttgcggtttcgtatgtttttggtggaatttagttcggcggacgacgaggaggatgagatggaagtttgttggaaatcgggtaaattttatagaaaattgatgaggaagacggtcgagagtaggattttgggagtatttatggcgggtaagtggttgcgtttttttaggaggcggtggcggcggcgtaggacgcgcggggtacggagcggttggatagcggtcggggttcggtttttcgggcggattcggagtgcgaggagtcgggttttagttatataaatttcggtttcgttacgttttttttcgtttttcgttgggaggggaggaatggggagggagggtagaggaggggtggggagggtgggaggagagtcgggtggtgcgggtcggaggtgtgggggagaggggtcgcggtgcgtcggtgtggtaggaagacgtagcgttttcgcgggacgcgcgcggggttgtcgggcggtgcgcgcggcgcgggtcgtaagcgttgatcgggggaaggcgggcgttgtcggttcgtggtcggggagtaaaggttggttcgtcgcgttagggtttttttcgaattttcggaggtgtggttttttcgtagcgcggtttcggttttcggttttcgttagtcgtttttatttttttgggagcgagcggtttcggaggagggaagcggcggcggcgtttttaagagatagtttggagtaggcgtttttgttgtaggttgcgtgttgtttcggggcggtggtatttttttttttcggttttaatcgttaggtttgtcgtttgcgttttttaggggttagttcggagttagagaagtttcgttttgggttaggcgtagggtttagttcggaatagttttattttttcggttgggtatcgttttttataaagataggcgtttattttcgattttcgaggttaggtaaaggttacgagtttttagagtttggatcgatgttaaaagttgttgcgtttttttgtaggttttagttttttttttcgtagtttttaattttttttgacgtagattttagttgttttattttttcgtttgttttcgggattttttttttttcgcggtttgtttttcg

SEQ ID NO: 6483 - DNA, 1861 bp, synthetic construct
  misc_feature 1..1861: note = Description of Artificial Sequence: Synthetic polynucleotide
  source 1..1861: mol_type = other DNA
tcggtgagtagagtcggcgtagttatagcgcggagtcgcggcgtttattggttttcggagttgttaatcggcgtgtaattttgtaggaatttttttcgggtttatttgggagttatattgtcgttttttttttttagtcgtttaggggagtttggagaagtaggtttaggagggagggagttagaggaaaagaagaggaggagaaggaggaggattcggggagggaggcgcggcgcgggaggaggaggggcgtagtcgcggagttagtggtttcgtttggacgcgttgttttttagatattttcggagttttagtcgcgcggatcgcgcgttttcgtcgttttgtttttaaatttttgtcgtagtttttttttaagttagcgaatttattttttaaaattagaaattgaatttcggtacgggaaaggagttcgcggaggagtaaaattatagtagagtaagaagagttttagagagtagttttttcggagtattaatttcgtgtcgggagtgtagaaattaataagtgagagggcgtcgcgttttcggggcgtagttgcgggcggcgggagtaggcgtaggaggaggaagcgagcgttttcgagtttcgagttcgagttttcgagtttgagtcgtaatcgttgcggtattttgtttcggattcgtgtgcgcgggttgcgtcgagcgttgggtaggaggtttcgttttgttttggttgtaagtagcggttgggagtagtcggtttttggggaatatgcggcgcgcgtggattttgtttattttgggtttggtggtttgcgtgtcggcggagtcggtgagtgggttaggcggaggatgcgcgcgtcgtttagggtgtttgaagttacgagaggagttcgtagggaataggggagcgttatttggggaatttttagtttttaagtatatatcggagattcgttgggataaatgcgttcgttcggttattttttttttttttttttttttttagaaaagcgttgttcgttggcgttatttcgcggttcgcgggaatgggggtatcgagaattgcggtttggtttagtcgtagaggtttttgaagttatttttaattttttcgttttcggcgggttttgttgcgtggtttgggaaggacggaggggaaagggtggtaggaggggggagtttgggtcgggttcgcgagggaacggttttatttcgcgcgtttttcgagattagggatgatttggaaatttcggggttttttttttcgtatattatttttttcgcgttagtttttttgtttgattgtatgtaagttttggggagatgggggttagatttaagagattcgcgagtgtttagagagaaaagtttgtaaaagtttttttgtttgatgttttttgcggttagggcgaggtaatcgatattacgtggaatcgtagtaggcgattttttaaggggatattgggggaggtacggaacgcgttcgaaaatgttgggacgtcggttattggatttttagttttgcggcgatttttttttcgttgaggggtggaggttgtatcgcggggcgttagggacgggaggatatttttataggagttatacgggagtgtcgtaagtagggcgaggcggggtacgtgtgatacggcgttcggtttcgggtcgtttggtcgttgggggatagaggtttttttttcgttacgttcgttttttttggttttggcggggcgtttttggggtcgggaggagtttcgttttcggcggagcgtttgtcggtatttagtttttttttttcgttttggcggtgggaatttgatttttttttttggtcgcgtttcgggggttggagtttgtttttttacgtcgtttaatgagcg

SEQ ID NO: 6484 - DNA, 3044 bp, synthetic construct
  misc_feature 1..3044: note = Description of Artificial Sequence: Synthetic polynucleotide
  source 1..3044: mol_type = other DNA
gcgcgcgtgtggaaggttgggtggggtgcgtatatacgtttatttgtgtacgtatatatatatatatatatatatatatataggtatatatattcgagtttagttatttatattgtttgtttagggcgtttggaagagttggcgagttcgtttagttttgtttattcggtttcgtttcgtttttttcgggagggtttttcgggcggcgtttagtttcgagtagagtaaaggacggcggcggttattttcgtttttcggtcgttggtttttcgttttttttcgtttttttattgaatttattttcgtgtttcgaaaatttgattttaattcgattttttcgcgttttcgttttttttttttagagtgagcgttaaaaagggtttgatagatagaagtttttggttttagtatcggtttagttcgtttttagacgatttttgttttttttatttttatagtttttagtggtcgttttattttcgtattttttcggttaattttaatttttttcgttttttttcgcgttgtttcgcgttttttttttaggattttttcgtatatttttagcgtttagcgcggttttttataatttttttacgtttcgtttttttcgttttgttttcgttttcgatattatttgcgttttttattcgttttaatttttttttttcgttatttttatttgtgggtttttagttttttgttttttttttggtttttatttttgatattttagggattttttttttttttttacgttttttttttttttaggatttcgtttcgatatttcggggttttttcgttacgcgtattttttttttttaggttttgatatttgggcgttttttttttgttatttatttttagttttagttttgattttcgggcgttttgttatttttacgtttttcgtttcgtttcggtttttcgggcgtttttattcgtcgtttttatttttttatttgttatatttggtatttttgtttttatttttgtttatatttttttttcgttttcgatatttcgggcgtttttttatacgtttttattttttatattttcgttttcgaaaattcgggcgttttttttttttacgtttagtttttttttttttttcgttcggtttcggatttagtttggagatcgcgttcgggaggggcggttgtcgttcgcggggcgttcgcggtgttcgggtttgggtagcgaggaggtgacgtcgttttcgcgggatgagttcgggaggcggaggggcggaggaggtgttggcggcggtattgagcggcggcggcgtagggcgcgcgggtttttcgcgtcgattttatcgatttaaggggcggcggcggtggcggcggttgagcgattttgggtcgggcgcgtgatgaggaggggtcggcgttagatttcgttgtacgtcggagttcgtttggattcgggcgttggtagtcgaagggttttggtttcgggatttttcgtcgttagttttcgttatatttttttcgttttcgtttttttattttagtcgggggtggggtgggtggggttggggttttcgcgggggttttcggtttcgcggttcgttttcgggtgtgtttggaggagttttttttttgtggcgcgcgggagttttgtgatgcgttagtcggcgggacggatgagttgttttttcgggaaatcgttttcgtttttttacgattttttcggttttcgtttgggtgtttttcgggtcggtagtatttcgttttcgggcgttcgaagcgagtttttcgggggtttgttcgtaggtattttttttttttcgaggcggcgcgcgcgttttcggttttgatcgcggtcggatatattcgcgtttcggttcgtttgtcgttttttcgtttgttttttttagttattttatttttagttgttttcgttattttattttattattttttttcgttttttcgcgtatttcgcgtttcggtttttagttttttttttttttgaatcgtttattttatagtttttcgttttcgggaagaagaaatatttttcgaagcgtattttttagttttttttttttacgcgttcgtttttttttttttttgttttttttgggggaggggggttgtcgttttggattgaaggttattgatttgtatgtatttgttttagcgttggaggttgttttagtcgtcgcgtcggtgtcgtcgttgttagtggagttgttttttcgtttttttagggtggttcggttttattaaatatgtcggtttttgtcgggtttcggggtcgtttggtttttatttcggcggttttttagtcgtttttgtagttcgagatgtttgattttagttattttacggaggaggagaggaaaattattttggtcgttatggataggtagaagaaagaagaggagaaggagtagttcgtgtttaagtaaggatttggttttatattttcgtttttttttttgtttttcgttttttcgtttattgttttgcggtcgtttgcgcgttttagttcgtcgttttttttttcgttggcggcgtttaggttacgagggttgcggttagcgtcggtcgttcgggttgttttaggggtgtttgagagtaggggtgtgtgtcggggagggagggcgttaaggtcggttgaggtgagggtggcgagttttaggcggtgtgattttttttggcgttttttcggattttttcgttggttattttggtttcggggttttagcgggattggggttgaatttaggttttgtgcgtatttttttttttttcgtcgcgttgaggtagtgattggggtatagaatttaatatggtcgtgtataggtgttttttggacggattcgggcgaaggcgcgttggtaggggatgcggacgttattttggttttacgttttcgcggggcggttttattagtaacgcgggatagagtagggttgtttatagtggttgcgagtagcgggcggcggcgcgggttaggggtttaagttttgtcgcggtcgggtgggtgtgcgttcgtcgttattttttagtttttttttttcggcg

SEQ ID NO: 6485 - DNA, 1603 bp, synthetic construct
  misc_feature 1..1603: note = Description of Artificial Sequence: Synthetic polynucleotide
  source 1..1603: mol_type = other DNA
tcgtatttcgttcgattaaggtcggggtcgtagtttgtattcggattggatttggatgtagttaatttttttttggttgatggaatagttttttttttttatagtttcggcgcgtttttttttcgcgcgtttcgtcgtttttcgtcgtagaataggagttgcgcggttcggagcggcggcggcggcgtcggagtattcgtttcgtacgtcggggcgaggggcgagcgagcgcgttttttttttcgcgttttgcgttttcgcgtttttttttttttcgttgttcgttttttcgtttttttttttttttttttttttttttcgtgttattttttttttttttttttttttttttttttttttgatcgttcgtttgtatatttttatttttttttcgtcgttttttttttttttttttttttttattgttatattttttgtgttttcgtttttttttttttatttgtttgtttattttcgaacgtgaattcgcggttttcggaggagtttagcgttcggagtatttggagttcggtcggcggcgggtcgagtttggttagcggcggcggcggcggcggcggcggcgggagtcgagggagcggtagtcgcgatcgcgggtatcgcgggagttttagcggtagtagtcgtcgtcgagatgtttcggcgaaagtaaagtaaatttcggtagattaaacgtaagtttgcgcgcggggtcgggagttggtgggattattgtttaggagcggggtgcgcgggacgggaaagcggtgggtgggtggcggggttaggggagattcgttttcggttttttagatgttttaaattttgtttgagtagtcgaagggataattagatagttatagatagatagacggttagttcgagtttcgggtaggagagaggttgcgaggagtagtttatgtttgtttcgtttagttttcgcgttttcgggttgtttttttaatttcgattcgcgtacgttgcgagttttcggcgttgtcgtttagtcggaggggtagtttcgtttttttagacgtttattattgttgttgttattgttttgtgcgattgacgtgggattatttttgggaattatttttagtaattagggtagaaattttttagaaaagttgggcggtcgagatttcggggcgagggaggtaatttttttacgcggtggaaaattagagcgttagggtttcgattttgggcggtgttagagttatattaaattcgaagcgaaataaaaagtaggtgtaaaagttcgcgtttttgcggcgggcggtcgtgcgtttttgttttgcgggcgcgggttggtggttggtaggtcgtgttttgggatttcgggcgggttcggtttacgtcgttaggacgtttagtcgagcggggattcgggtggtgtttggttttggtggcgcgcggagttttttttgggaggggtcgttagttattttttagcgcggaagttgtgagtttaaggcggtgggcgcgtaggggagtgtatggttttgagttttcgggtgttcgggggtttcgatggtgtttagaggatacggcgggttaagagatatttttcgaaataggtacgttcgtagagattaagtcg

SEQ ID NO: 6486 - DNA, 1365 bp, synthetic construct
  misc_feature 1..1365: note = Description of Artificial Sequence: Synthetic polynucleotide
  source 1..1365: mol_type = other DNA
gcggcgaatatgagtgcggatcgtacgatttagttttgagcgttcgattggcgttcggttcgtcgagtttttagcgcgtttcgtttcggtttttcgcgtttttagggtatagaaaatagagtgttttgtagagttttagggttttaaaggtggggattggggattcgtaaaagttggggtggagagtatagttttgattatttgagttttcggagttagggcgtgagtgagcgtttttatacgttatttttgaagtttattacgtatttttggtagagagggatttatttcgtttattgcgtttttatcggttgttttggtagtggttgtaatttatgtagtttagaatgatgagggtaaaggagaaaaggcgaaattgtatttgggcggtcgggcgggggagagacgttttttaaagtttaggaattggagggttcgtttaaagagtcggcgtcggtcgcgttgttggggaggatttagagggagattcgttatttattttcgggtcgtatcggttagtttagcgcgattagtattttttcgttacgaatttgagagataagaagcgaaaatagggtgtgtgggggatggagagagtttcggggaggtagttgcgttttcgtacgttttaatttaaagaagagagggaaggaggaagcgaatttattgtttagtacgagtcgcggagcggtttaatttagagcgggtagttgcggacgagttggagaggaaggtgattataattagtgaattagtaatttttgtcgagttttaagtttcgatttagcggtataatgcgttgtgtcggcgtttcggggaaaggaaagaattttaaaggtattgagagcgtagggttaaaagaacgtttttaggttatttggagtttacggcggtgtatttaagcgtcgtagttgcggttgttttggtgtgggttgtttatcgtgcgtacgtttcgggcggcgcggtttttttaggcgcggtgttttatttcgggttcgggaagcgagtcgtttggttagtacgtgggttggggaaaagtttgtcgagatcggttgggagcgtttggtagttttggaattttagcggtcgtcgcggggttggcgacgttaggtaggagcgcggagcggcgggtgtagttattgggatgtttcgttttcgttcgcgagcgcggtttttaggtaaggggtgcgttcgtttatattttttgtttttttaattaattgtgtcgttttttgcgttttttttacggttattttatagttaagattttttttttttcgagttgtagaaggtagaacgttttcgggaggacgaagtgattcgaagggatgtggtaagcgtatttttcgatggagatgtagatcg

SEQ ID NO: 6487 - DNA, 419 bp, synthetic construct
  misc_feature 1..419: note = Description of Artificial Sequence: Synthetic polynucleotide
  source 1..419: mol_type = other DNA
tcggggaggcgatttttggatgcgttttgtgcgagtaaagtcgggagagcgagttttaagtatttggtagcggtgtttttagtaggcgtcgaggaattcggttatttatttttggtgaattttgcgtttattgaggtattcgaggtacggatgtgttcgtttagtattcggagacgaaggagagagagcggggatatgcgttttagttttgttaggttttagggtttttatttttgtatttaaagtttttattttattttatttttcgttatttattttttgtttcggttattcggtgcggttttagtatcgcgcgttttttcggtacggttttcggagaaagttttttaattattagttacggtatttgtagtttttgtacgtcgttcggtttcgtcgggtgggtagcgttcgttacg

SEQ ID NO: 6488 - DNA, 3675 bp, synthetic construct
  misc_feature 1..3675: note = Description of Artificial Sequence: Synthetic polynucleotide
  source 1..3675: mol_type = other DNA
tcgcgtagtttagttcgcgtcggggcggtgggtgggtgggtgtttgttatgggattatttttagcgttttatttttttcgtaaaagtggcgttttcgttttttcggtttaggtatattcgttcggggttcgtacgttcggtttagatattagcgcggtggagagtatcgggtggggttttcgaagggtgaggttcggaggcgtcgcggagggggggttttttagagaggagggggcgttgcgggaaggtttttaagggaggttgcgtttaattttcgacgttttgtatttagttcggcgcggcgcgtttagtcgttttttcggatttttttcggggcgcgggagtttagcggcgcgtttagtttttatttatggtggtgatgatcgtgatcgtaaagtagaaggagtcggcgaatttttattggacgtcggcgcggtgcggtttcgattgtaggattattagttttagttgtcggtagttttcgttgttgatgttgtatttttttttgattcggattttttcggttttgagtttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtcgtcgtcgttttttttttcgtcgtcgtcgtcgtcgtttttaagttgtaagcggcggcggtagtagtagtagtagtagtggggaggcggggggcggggaggttggggggggtttttttcgttggggtcgttatagttatcgttatcgcgaggcggttggcggggtaggggcggcgcgggttcgggtttagtcgagaaggcggataggtataggaggttgttcgagcgtcggggttaggcgttcgggaatttcgatattttgcgttagattcggtcgaagtagttcgttttattgcgtagggttatgtagggcggtttcgttgggtatcgcgcgggttttgttgtttttcgtatttcgtttttcgttttcgcgggaaacgtagggacgggaatcggagttagaaagcggtcggagggcggtcgcggggttcggtatttttgtgggtttagttcgcgggtggcggtgtttagtaaggagtttgtaggttcgcgcgtttagcggaatttgtttttttttttattttttttcgttttttttcggtggtggggaggaaaagtttgcgaagtggcggtgtttttggagttttttgtaagcggggagggggtcgagtaggtgtagcgggaggggtagttcgttttttaaaggttcgcgcgtttagcgtttattcgggcgcgcgggtgcgtagcggggttttcgtcgggcgtcggtcggtgcgcgaagtttgttcggtttaatttttaaggcgcgggagcggggcgcggttttaggacggtagggatcgcgatggagcggtttcgggggcggtcgggggacggcgcggtggcggtcggttagttcgttttttcgggggcggcgggcgcggcggcggcggcgggaggggtttcgcgggtttcgcggagtagcggggcggacgcgggcgtatgagtcgcgcgggggtcggggtttttcggcgttcgggcgtttcgggaggcggtcgtcgcgttggtttgtttcgggcgttacgtgcgtgcgcgtcgttgggagttcgaatgtgtgtgtgcgcgtgtgtatgtgcgtgtgtgtgtgtgtgtgtgtgtgcgtttggtagtttcgtttcggcgggagggtttcggggagcgggggtcgggttacgtcgaggtcgggttttttttttttttttttttttgtagtttttagggcgcgttatttttcgtttggtttttagttagttggcgaggttgttgtggtagttttcgttgtagatttagcgcggcgtagggcgtacgcggagggagttcgggaggggcggtttgagtcgttagggagggggcgggggcggagtcgtcggcgggttttggcgggggatgggaggataaacgcggttttttgggtttttttagtttcgttttttaagagcgtaagtagttttggcgggtggagagtttgagggattcggggttggaggaggaaaacgggatttagttagagatggtaggttgatagttttaggtagattgggtagagagtggggagtagaaggggagggggttatgggtatataggagagcggtagtagcggtttacgaagttttttttattttttattttttatttagttattcggcgcgggagcgtgttattggttagggatatggtttcgtggagtggtggggtttcgagggttgtttcggttttttcgttttttagcggtatagttcgtttgggttagtatttgtagattcgagtcgtttttttggagagcgttaaggatagtatgggtcgttatttttggagttaggatagcggggaaagatatcgtaatttttcgatttagtaatttttttgttgttttattgaaggaaaaaaaaaaaatatatatatatatatatatatatatatatatatatatatatatatatatatatatatatatatatatatataattattttttgatatatataattattttttggttttttatagttgggcgtaaggtgcgtcgtggatgtagttttgagttacgcgatagttttttcgagattatttggggtaggaatacgaggttcgggttggggcgtatttattttttgtttttagatgagttttttttaggttttattttttttttattttggttttttttatttttttttttttttcgttttttttttttaggttatcgaggggtttttttttgattttcggttttttgaatttcgtttggagttttggagttttaaaaggatagatttaagttttagagatttttgggttttttttttttttttgattttagttaaggaagggatggagatgggaaagagttgtttggcggtaggttagtagttggttaaggggtggttggggaattagatttaattttcgggtagttcgcgggttttaggagattagttttttttgtgggtcgttttttggagcggtgttcgggttttttggttttagggatttcgggtttagagggtttgggattttagtgatttatcgaggttttttagttgggacgttttgtattttatttttagggattacgggtgtttattagggaaggggagttcgcgttgtgggttacgtttgagtcgttaggttttcgttgggtttgcgggcgttttggggcgagggagcggggagttttatttcgagtaggtattttttttagatttattttggaaattaaggttttcgcgttcggtaagtgagtttggttgtcgggtgagttatcgcgagcgggcgataaggatttttagtagttggtaattaattgcgtcgtggtttagtttacgacggaattttagttaggtttttcgtcgttttggtagcggcgttatttttgagttatagtcgtcgggttttcgcgcggttcggaagtcgtttgttcgtttcggcgttattagggggtattggatttcgatttacgcggcggtcgcgtagtcggtttcgttgcg

SEQ ID NO: 6489 - DNA, 3675 bp, synthetic construct; identical to SEQ ID NO: 6488
  misc_feature 1..3675: note = Description of Artificial Sequence: Synthetic polynucleotide
  source 1..3675: mol_type = other DNA

SEQ ID NO: 6490 - DNA, 3378 bp, synthetic construct
  misc_feature 1..3378: note = Description of Artificial Sequence: Synthetic polynucleotide
  source 1..3378: mol_type = other DNA
gcgagcgcggagtcggagagtcgggagtataggcggtcgcgtcgcgttttggttcggttcgggttcgcgcgttagtatcgttcgtagcgcgggtattcggatttttcgggcgttcggggggttttagtaggcgcgggggaacgggagggggtttgcgtgcgtcggcgggtgttttttagggggcgtttcggcgaggtttagagcgggtcgggggcggcggcggttggaggagttttttttattttcggtcgggcgttcggtttagtcgtcggcgacgcgaggcgttcgcggggatttgtaattcgtcggatcgagttttcgtcggcggggtcgttgttgttggggaaggtaaggaaggttttggcggggggttgggggcgcggcgggtgggggcgtagcgagggtgggagggggtcgggggaggggcgggcgtttagattttttaatttcgtcgtttggggtttcgtagtttcgaggttttgcgtttagagtttaggagtttggatttttattttttatttttttagttttttgttttttttagcggtggcgatggaatgtggtaggttttcgcgagttcgtattgggtaggttgaggagggggcgattttggacgtaggagaggtttttcggcgtcgtcgttttttttttatttatatattatagtttggtatttttttttattatatgtatagggtaggttggggagggcgttttcgttgtatttttagtatatatagacgttggcgggggtttaagggagttttttatggtttttaatagttatatatagacgtagtaggtttcggagagttttcgagcgtgttttttttttgttaattacgtttagggttttttatagatattgtaagggttcgagacgttttttttttacgtatagagttcggggtaggtaggagaaaattttagattttttttcgaagttttcgttcgtagaagttttcgtttgtagatttggtattggtagtggagattttttggaggtatttttttttatttcgggcggagggttatttttgcgttttttatttttacgcgaacgtttggtttttttttttttgtttatttttttattgggtcggataggtcgcgcggataagtcgtttttaattttgggtcggttttatgtcgttttcgttttaagcgtcgagtattttcgggcgtcgagtattttcgggttcgcgtcgtcggtgagtagaggtcgtcggttttttatcgtcgtcgcgttagtttggagtcgcgcggagttgtttcgaggaacgagtacggttttcgtttttttttggggaggttgggagttttggattcggttaggagttttttttttaggttttcgcggttttttgggcgaggtagagagttttttcggtttcgggagggggcggcggagttgagaattatcgcgaagcgatgcgatcgggagggtttgacggaggttgcggtttcgagttcgcgtttttttttttggtcgcggcggtttttgtttggttatttttcggtagtttgaagagaacgtttaatttggtattttagttttaggtcgttgggtattttatttttttttatttttattttgggtttttaagttttttggagcgtaggcgtttaggttgggattcgaagagttttaagttagtttttttttagtattcgttttcgtcgcgattttttcgtttttttttcgggtttggggcgtagatttttgggttgtaatttcggagtagttgaaaggtaggaaggcgtgtgggcgggtagggggtttgtattttcgttttagaggagtcgtttgtcgtttgtgttggggagggagttgggaggtttgttttttcgttttattttgggaatttacggagattttcggtattttttttatagatataaatatacgttttttcggagcgagagtcgtcgcgggggaatagtagaggtcgcgcgggcggaggcgggggaaaggggagttgggttttttttttatttgggagggaggtggtatacggtgtgtggggtttggggaggcgattgttacgttttttagaatttttatgttttttattcgtttgcgatttcggttgtcgaggaggtaacgagggaggtcgagtcgttttttttcgtgggcggtagcgaaattttgcgttcgtacgtcggggtgtcgtcgagttcggttttgagtatttagtaaggttaagtaggcgaaggagggggcgggggtttttgggcgcgttttcgttcgcgtatagtcggggttttggaagggggtgtgcgtagttcgtcgagttagtttcgttcgtttgtcgttcgcgttcggttttcggaggcggacgttgcgcgcgttcggggatttcggagcgttcggcgttttacgtttttttttcggttcgttagttgttttttggcgttgtttttagatttgttgcgtttcgatttggggggtagaaggttggttcgggagattcggcggttgagggtcgagtcgcgaagtttagggatgcgttagagaggcgcgcggtttcgcgggtgggcgttgcgttggggggttcgagtttggggtttgtcgttttcgattttagggacgggcgtttgtttttgtcggggtttcgcgtaggggcggatagagggcgattcgtcgtttcggttttaggtagtatttattcggatttcgggttagggagggggcgtagttaagttgtggagttttcggaggtttttttttttttcgtaggtttcggtttttttcggatttcggtggtcgcgttcgtgaaatggggacgcgggttttgttttcggattttttttagttttcgatttttcgtatttgtttcgagatttaacgtgttcggttcgtagcgtgttgggtttgcggcgttagggtggttcgagtttcgagattatttgcgtttgcggatatagtcgcggggtttggtatgaagggttttagggagggtttagtaagcgttcggggttcgagtagttttttgcggcgtttttcgttttcggtcggttcgatttcgttttcgggagtgggtcgtggggcgcggagttcgtttttcggggacgtcgcggggttttaggtttaggcggtcggcgcggggtcgtagtggcggaaggcggagggtcggcgcgttgtcgttgattgtcgggagagggcgttcgtatcgcgttcgcgcggttttgttcgtttttttcgtttttttcgcgtttggttcgcggtttcggttttattttgggtagtttcggtcgttatttttttttcgttcgttcgttcgttcgttcgttcgttcgttcgttgttcgttttcgtcgtcgggtttcgtgacgcgtttcgcgtttcggtcggagtttttttcgtcggttcggttcg

SEQ ID NO: 6491 - DNA, 1108 bp, synthetic construct
  misc_feature 1..1108: note = Description of Artificial Sequence: Synthetic polynucleotide
  source 1..1108: mol_type = other DNA
gcgtgtttagatgaaaagcggggtagtcgcggttcgtagatagcgggcggttgggttagatcgtagagggaagtttttagcggtaagttttttcgcggggaaggttgtgtttgttttaggagatgagtcgtaggtattaggggtgatgaggttcgggggaggtggatgtgggggatggagcggttttaaggtcgttagttttagtcggcgttttgggtcgcggggtcggagagtttcggagcggattttcgtcgcgtttcgaattcgtttcgcgtttttaggttatattcggttcgtatttttttcgttttacgtgcgtttacgcgttttttcgggtttttttttttttttcgcgcgggtcgggggcgcgggtttcggaggagttgggggcggcgggggcgcggggcgggcgattgtcgggtttcgggttagttttcgtttttcgtttcgttttcgatcgttcggttttttcgttcggcgttttttcgggttgcgtttcgcggtttttggcggcggcggcggcgggcgtagagcgcggtatgggcgttcgggtcgcggggtttggcggcggcgggcggacgggcgcgcggttgcgggcgtaggtgcggggcggcgggtcggggtcggggtcggggcgcggagtcgtcgttcgggggtcggggcgttcgcgttttcgtcgtcgttgacgtttcgtttgtttttttttcgtgtttcgttcgtttttagatttttttttttcgttttttcgtagttcgggttttggtcgtggcgcggttgtcgtacggtgtttttcgacgtttttcggacgcgttgtttttgtgatcggttttttattttcgttattttagtttagtttagcgtcgacgcggtgagatttcggtcgggtcggcgggaggggcgtcgggtaggggcgcgggcgggggttgtcggcgggtttgcgggtggggagggttcgtattcgttttgtttcggaggggtcgttgtggttcgtagtcgtcgtggtttggttcggtcggcggggtttatgcgtttttggagagggtgggtgggcgtcgagcgggtggtagtgtggagttggagacgggtttgggaggagtcgggattttcg

SEQ ID NO: 6492 - DNA, 1700 bp, synthetic construct
  misc_feature 1..1700: note = Description of Artificial Sequence: Synthetic polynucleotide
  source 1..1700: mol_type = other DNA
gcgcggggtgggcgttttcggttttttagtttttaattttttcgcgtattcgggacgggtgaaggcgtttagttgtcgagtatattcgcgacgcgggtttaaatttcgtcggtttttaggtatttttatttcgttatagcgcgggttgttttttttttttttttcggaggaattttttaattttttagtatttatattataataaaggaggttcggtttattaatgcgcgatcgtagtttatagggatttttaacgaatttcggtttagagaatgtatttggtcgtgttacgcgcgattttcgaggggtaggcggacgggtttaggcgcggataaaggggtttttcggggcgtttaagttcggggcgggacgtcgggagcggagttggtcgggaatttattttcgtagcggttcggttgtgtttttcgtggagtagaagggcggcgggtagtagtagtagttagacgttgagtcggggttttatggtggcgcgttcgaggcggcgagggacggttgttcggcgtgcgggggtcgcggcggatagttagttttcggaaggtcggatttttagcgttacgtatcgtttcgggtgcggcggttttaagcggagatttgagcgcggcgggtcgagttttttaatttgttggcgttgttttttttttttcggcggtgcgcgggcggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcgttcgcggatttaggtcgaggatcgaaaggggtcgttcgagttttcggggtcggcgtttagagagtttagtaaggtcggtcgttttgtcggtgtgtcgtcggcgggtgtttttggaagggttaatgcgttcgggtagtagtttttgaagtcgagttcgaggtgagagcgattttcgagcggcgtttagattttggttcgagagtatcgatttggagcgttttgtgtaggttagggttgtacgtttttttgtttgggagtagaaagggggagggtgggagagcgaagatcgagtttttcggttaaggagtatttataggggtttaacgggaggtttttttttttttcgggtcgtgggggggacggtttttcggttatttttgtatgcgggtcgcgtatcgcgttgttttcgcgtttcgcggatcgagatcggcggtgaggatgggttgttttttttattttgcgttaaattcgttttgtttgtcgtttttaggttaagtgggattgatcggggtttagagtggacgaatcgttagtatggggagagattagcgcgcggtggtcggttttgttttacggcggtaagcgattttttgtttggttttcgtgggttacgcgcgtatggatttttcggtgtaattttcggggattgataagtcgggttcgtacgtttacgttttttttttttttttttttatgtaggtggttgttgttggggatagtgatcgtggggtttttcgtttagagcgttttggcggtaagttttggttttcgcgtttggatttgcgcgttcgagagtggttgggacgtttgagtggttttggagaaggtagttcgttcgtgcgttttcgagtgtgtgtgtgcgtgtggatgttcg

SEQ ID NO: 6493 - DNA, 692 bp, synthetic construct
  misc_feature 1..692: note = Description of Artificial Sequence: Synthetic polynucleotide
  source 1..692: mol_type = other DNA
tcggcgattcggttatttttcgagggttttaggcgttttatttaacggtcgtttttcgttttttgttcgttattttttcgtttttttacgaaggcgcgaacgttttagattttcgtcggttttcgatagtatttatttagttttttttttggagattttaggttgtattttgggatagaaaagaaggcgggtacgatcgcggtgtcgggttttattttagtcgtttttttttttgagggagttaggcgggagagaggggaattatcgaggtttcggttttttcgcgttttagagcggtcgggcgagttttattttcggtttgtgattcgttgatttgtttttgttttattagtcgggcggtgaattggattgattggtgatttttggtattaggtttttttatgggtatcggagtaggcggataggggtggggtttcgcgagcgatacggaagggttagtgtggcggagcggattttgtggaggcggggttattgtgtttttgagaagggttttcgggggtggagtttattaaggttgcgggggcgtggttacggagcggagttaataaaagcggggcgtgtacggtcgcgggttagtgtttatgaagggcgaggggtgtggttatagggcgggatttacgaaggatgtaggggcgaggtcgggtttttgtaggatgtgcggtcgcgggtcg

SEQ ID NO: 6494 - DNA, 1924 bp, synthetic construct
  misc_feature 1..1924: note = Description of Artificial Sequence: Synthetic polynucleotide
  source 1..1924: mol_type = other DNA
tcgtcgtttgtttaatgttttcgttagttttgtcggtttttatcgtcgtttgattttattgtttttttcgtggtttttgttgtttttttaaattgtttaacgatcgttatttagtaaaaatgaatgaaacggggtcgtgtgatttaggtagtttggagatgagattttggaattataagttatattttaacgtataaatcgattttattcgttttggatattcgatgtacgcggaatgggcgttgtaaaatgcggttgtttcgtcggaggtatttgtttgggatttgttggtagtcgtcggttttttttgtttgcgattttcggtttagtcgtcgggattttggtgtatttgtttttgggcgttttttttattttttagtggtcgttagttttatttttagtttgtggtttcggattcgtcggtttgagcgttcgtagagggtcggtcgtcgttatagtttcgcgtttcggttttcgcgttttttggattttcgttttaggtcggcgtagtttagtttttcgggtaggttttacgttatcggggtttagtgcgcggcgacgaagcggagagttgtgtttagatttcggagagaaatttcggtttcgcggggcggcgcggggcggcgcggggttcggagttgtttaatttcgtcgtttcgggaaggcggtttcgggttcgtagggagtttcggggagggttttcggtttcgtcggtagcggcgtcgaggggtgtttgggtttttggggatcgcgagaggaaaaagaacggaaatcgtatcggggaggaaggacgcgtagaacgttttcgtgaagcggggtgtttcggttaggcgtgcgcgggagcgcggttcgggggagttcggcggcgtcgtcgcgcgtattcggtagaggtttcgcgggagaacgcgtagttcggggcgtggggcggggaattgttcgcgcgaggttttcggcgcgtttgggtttcggcgagagtaaagcgcgttttggtatcgggggcggcggcgtagaggtcgggaggaagaaattcgggttttggtttaggtcgggtttttatttttgcgattcgcgagaggtttaggcgggaaaggcggcgagtggcgttagcggtttcgaaagtaaatttggttcggtgttattgttcgagggtcgtcgggcgcgttttttaattttttcgagtttggaaaacggagattttcgtagcgttttttttagtgcgtgttgcgagtgttgaaggaggattcggtgtttggacgattcggagtaggggaagtattcggtcgacgttgtcgttgttatcggcgttattggcgggtaggatagtggggcgggtaaggggttttttcgcgtttttcggtttttcgcgttcggcgttagttttttggtttttttttttgcgtagttttaggtttagtttttagttattttttaagaagacgatttcgagggtcgaaggtcgtttttgatttttgattacggatttttcgtgtaattcggaagagtcgtgattttaaaattcggtttcggggttatagaagttcgagatttgggaggcgttcgggattttttttttagaatcgtagggattcggtttgggatttagggtgtggtttttcgttttgcgcggtcgggaaggcggtcgggttcggttatcgcgttaagtattgcgtatttttgggacgcgtcgttgcggggggttggggggttggggcgtttttacgacgtttggtttgttcggttagtgtttggtgtcgttggtgggttcgtggttgcgacgggtaaacgttcgtttcgcgagtcgggtaaggtaatttttgcgggtcgcgttcgaaggtcggatttttttaagtcgtttgggagtttttaaataggtggattcgaagtttttgtttgatcggagaataacgtttaatttatttcgtcg

SEQ ID NO: 6495 - DNA, 1991 bp, synthetic construct
  misc_feature 1..1991: note = Description of Artificial Sequence: Synthetic polynucleotide
  source 1..1991: mol_type = other DNA
tcggtgtatcgtgttttggtaatcgggttttggcgttttcgagagcggggcgaggggtgttacgcgatttttaggtcgttttgtatttttcggtgcgtttgtagggattttgtagtaaagttttggatgtttgtagtcggtgtaagtttgtaagtagttggagagcggtggttggagtcggggggcggtgggcgtggttacgtttttttttaggtagtttcgggaatgttttgaaaagtattcgaaagttttgagtcgcgcgcgcgttaaaagaaaaggtataattttttattatttcgggcgtggcgtgtttagatttcgttattttagttgcgttttcggttgtagcgtatacgttttttgcgttttttttttcggagcgtcgttgttcgtcgggtttatttttcgtagtagtttttaggcgagagagggggttagagtgttcgtattttttttaggggtattatgtttaacgacgaggtatttagtaagttttttatatcgtcggaagttttttacgttttcggggtatcgtcgtagggtagagtcgggggttttggtaaagcgtttggggcgttagtgggggcggttagcggttcgagcgtcgggggtagtagtagaggaggcggtttcggtttcggggcgtcggatttgggtgtcgggagtaagaagttttcgcggttgtttaagtgcgtacgttgtaggaattacggttacgtttcgtcgtttaagggttataagcgtttttgtatgtggcgcgattgttagtgtaagaagtgtaatttgatcgtcgagaggtagcgcgtgatggtcgcgtaggtgggtgcgggcgtgcgggagttcgggtttagttttagtttttttttttttttttttttttagatggagtttcgttcggttgtttaggttgtagtgtagtggcgcgattttggtttattgtaattttcgtttttcgggtttaagtaatttttttgttttagttttttaagtagttgggattataggcgtatattattatgttcggttaatttttgtatttttagtagagacgggggttttattatattggttaggtcggtttcgagtttttgattttaggtgatttattcgtttcggttttttaaagtgttgggattataggcgtgggttatcgttttcggtggggttcgagttttttgaatgaagtttttttagtatggtcgttgttatgcgggttttgggttgtggagagatgcggcggtatttgtcgatagcggcggcgtttggggttttgggttttcggttacgttatatcgtcggtttgggagcgtcggagacgcgtttgatttcgttcgtcgggtagagttgcgggtttcgttcggttcggggttttttacgattttttattttgtgtttcggcggagttgcgggggttttttttgttttcgggtttttgagatttttgatttcgtttttagggtagggaatttcggggttcgtttttttgggttttttcgcgattttagagttcgcgttttaatagaattgggagggtttattgcgttagaggagtttttaggattttcgttttcgtttttcgaggtgaggttagaggggagggttcgattttaagggaattttagggatttttagtttcgtttttttagtagagaattaaggaatttttttcgttttggggttttaaaaattttcgatcgcgttttgggagtagagggtttcggggttcgattttttcgagcgtttttagaatttttgattttttttttttgttgagttgtatttaaattagaaaggattttggagggcggtagcgttggttgttaggttagcgggaaagggaggttcggtcggttgttgtttacgcgggtaatttgtcggaaagttttgtttgtttttttggaaaagtcgttgtaatggatatagcgttgcgcggtttttttgcgcgtttggggcgttttttgttttcgtttttcgtggatggaggttgagcg

SEQ ID NO: 6496 - DNA, 1667 bp, synthetic construct
  misc_feature 1..1667: note = Description of Artificial Sequence: Synthetic polynucleotide
  source 1..1667: mol_type = other DNA
tcggggtgtaatcgtaatattttcgtaggttcgagttttttcggagttgagtttttgcggttaaatgtcgggataaaagcggttttgggttcggaaaaacgcggttagatttggattggagggaggagaagagagagaagcggagcggttattttattcgtttataggtatttttatttttattttcgttggtttttttttttttcgtttcgcgagtatcgtcgcgttttggagcgtcgtagtttttagtcgcgggttggggtagcggagagggtttggaggagggggtcgcgagcgttttcgcgagagtggtttggttgtaggtggtaaggaaggtgaagtgtaggtattcgaggggcgtaaaggaggaggaaggcgtggggcggggagtgtaaggagatagggattttaggggcgggggtggcggtgggaaggaggaggggttgggggagggcggcggaggtgttgggttcggtcggtttacgagggagttgtagaagagttggtttagattttaattagagttgtcgtcggttttttgtagtcgtcgtagcgttttcgcgaaggaggacgtgtcgattcggttgcgcgtttaaggtagaggttcgcgtcggcgttggttgggcgtgagttgggaggtcgagttgtgagcgcgaagggagttggagagacgattgcggtattttcggtcgtttcggagtatatacgattatcggggttgcgggattaagggtcgcgtcgttcggaggtcgtttttgagcgggtttcgtagtttcgtcgtttagcgttttttggttttttttcgtagttaggttgttaatttattcgggagttcggggtatgaacggttacggttttttttatttgtatatgggcggttcggtgtcgtagtcgttacgggcgtttttgtagcgtacgtttaagtgcgcgcgttgtcgtaattatggcgttttgttttggtttaagggttataagcgttattgtcgttttaaggattgtatttgcgagaagtgtatttttattatcgagcggtagcgggttatggttgcgtaggtggcgttgcgtcggtagtaggttaacgagagtttggagagttttattttcgattcgttgcgcgttttgttagggttttcgtcgtcgggggacgtcgtcgtcgtttcgtagtcgtcgttagttttttagtcgtcgtagtcgtagtcgtcgcgttttgttgtcgagttggtcgcggtcgtcgtgttgcgttggattgtcgagtcgtagttcggggttttgtaggcgtagttcgttaagttaggtaagagcgtttgaggtgcgggagtttggtcgggcgcgggggtaatttcggagtgttagttgtagttttatttgggaggattggaggtaaagttttgggacgtgggtttgtcggggtttttttttttatttttcgttaggtcggggttttttttttcgggagaagtcggttgagtttggatttagcgcgagtggtattcgcgttcgtagggaaggcgttttcgggtagttaaacgacgggattgtgcgttagtatcgttaggtgtttttttaggttgaagggttcggaacgtgttagattgagtagggagataacggagttgagataggataaaattaaaatttacgtgcgtatatttattacggtggggtcg

SEQ ID NO: 6497 - DNA, 433 bp, synthetic construct
  misc_feature 1..433: note = Description of Artificial Sequence: Synthetic polynucleotide
  source 1..433: mol_type = other DNA
tcgcgagataaatggtgattttttttttgtaggtatcgttatatttcgggtttagattttggataggcgagtcggttgtatcgaaggttcggtaggcggattttggcggagcgttttagagagaagagtgtagatcgcgggaggcggagggttttttgttagcgtgtttcggttaattagtatttatatcgtttgataatcggttaattagaggacgtaaagtttcggggtttgagcggatagtattaggaaggggagcgtagtttgtagattgaagttagtggcgttgcgttgaatgtaattgcgcgcgttcgtcgggtgagttagcgatttgagttaggcgggggcggttcgatttttttcgtttagtttgggttagaggaagtcgaaagcggttttagtaaggtgaggcgttcgaggttgtagaagatcg

SEQ ID NO: 6498 - DNA, 896 bp, synthetic construct
  misc_feature 1..896: note = Description of Artificial Sequence: Synthetic polynucleotide
  source 1..896: mol_type = other DNA
acgaggattaaaggtacgaatttgtttttacgttacggttcgggatttagggtgcggggattacgcggagcgtagtagagtttagggtaggagtcgggaggtcgcgtaggtagagttcgggtagggcggaggggaggtcgcggagggtcgggtggaggtttttatcgttagttttaaggtttgtagtatttttttttggtttttgtttttagggtcgatgtgttttcgagcgaagtcgtcgtgtttgggtagaaggcgttttaggaggcgcgaggttttagtcgcggcgttgttttcgtcgttattgttgttgtttcggtttcgcggcgtttagtacggtttcgattttttagttaggcggcggtcgttttcgatttcgcggtttaggcgtagtttttacgttttggtataggattgtatggtcgcggttatcgttttttgtttcggttcgtaagggttagtcgcgtttttggttttttttttggtttcggtttttcgggtggcggttgcgttcggtttggagtttttttcgttggatagtcggtcggatagatggatggacgttcgcgggtaatgaatgggcgttgcgtttaattaagatattcgcgtaaagttgtggttttatttaaggtatttgtttcgtatattttaagcggcgttttggaggcgggaggtgggttggggttaggaagtttttggttaatgaaagtagatagagggggagggggcggaatagttttcgttttcgttttttttttttattttttttttagttttttcgtggagtttcgttttttttggatcggaggttgttatttttagttttatttatttcgacgttggttggtgtcgggggtcgggacgtttcgtacgtcgttcgttagggtgtggagtcg

SEQ ID NO: 6499 - DNA, 1494 bp, synthetic construct
  misc_feature 1..1494: note = Description of Artificial Sequence: Synthetic polynucleotide
  source 1..1494: mol_type = other DNA
tcggggtttttttaagcggagtattttaaaagtcgtatcgcgtagtagaggtttttaggggtttttattcgtttttagtgattacggagcggtttttatttttcgtcggcgtttggttattttttttttttcgtagttttcgtttgatttttatgtgattgtaggtaagaatagtttagtttttgtgtttttgtaaagaacgtaaataaaaatgtatattattattatttaataaacgcgtaatttcgtaagatataaagcgttttttaaatatcgtttttttggtaatattcggtattttggggttgttaaatcgtagataaagacgtttattagcgcggggggtgaggagattaagggagagataagattaacgtgtttttattaacgggagcggcggttaaaagggcgtcggtgttaggggtgagggacggggtatcggtattaattagcggttcgtttcggggttttcgcggttaaggcgagaacgtaggattaggagtattgttgtttattttttatcgtaattcgtatatttcgggattacgtaacggcggatggggcgttcgggagcggtttttgtaggggagagtaataggttttcgcgttttggaggtttggtttgcgtttcgggtttttaggttaatattttatttttagtttttcgatattaagattgtgtttttttgggttaaggaaaaggaaaaatttttaaattttttagttagcgagagtaaaagaaaggggtggcgggggtgttgaaaggtttaggattatttatcgcggggttggggggagtggagatttgcgagtagtaaaggaaatttttagattttatttttttaaaaaagttatagtagcggttttcgcgaagcgtcgggtcgcgcggggtggggtaagcgtatcgttttatcgttttacggttcgtcgttatttttatttttatttttatttttatttttattttcgtttttatttttatttttaagcgtcgagtttagggcgttcgcgtatttttttcgtcggcgcgcgcgtagggcgcgggggcgcgtttcggtttttgggtcggggtttaagcgtcgtttattcggttcgcggcgttcgtttagggtcgcgacgcgagggggcggaggattggggagtaggggtcgtcggggtttttggatgtttcgtttcgtttacgtttattgtttttttttttgaagtaacgattcggcgaggagtttcggattaaaacgtatagatatttacgcgtgattgagaaatttaatttcgcggtggttcgacgttagtttagcgtttcgtcgcgtttttttttttagcgcgcgtcgtatttgcgtcgatcggggttgtcgcggaggcggtggcggggtttaggttgttggggttgtcgtgacgtttgcgatcggcggggcggcgggcgcgttttggttaattaggggacgcggtcgagtaggtttgtgcggggttttaaattcgtttttgggtcgttcg

SEQ ID NO: 6500 - DNA, 828 bp, synthetic construct
  misc_feature 1..828: note = Description of Artificial Sequence: Synthetic polynucleotide
  source 1..828: mol_type = other DNA
tcgcgattttatcggggaaatatcgcggatagtcgggttagtagcgttcggagtttattttaggtttttaaatttgtagtattttttagagcgcgcgcgttcggagcgggatttgtttgttttagtgtacgtcgcggagcgaattatcgggttggcgggggtggaggggtgtaggcgtgggggttgcgggtcgttcgggttttgggttttttttgtcgtcgtcgtcgtttttcgttttcggttaggagtcgcgcgtgacgcggttcgtcgtaggagtttcgaaggcgcggcgtcggcgagttttttttcggtaggcgcgtgggtggtagcggttaatttgatagtttttcgggtcgggcggttagcgcggaggcgttacgttcgggtcgggggcgggttgacgtcgtcgtcgtcgcgggaggagggataaaggggtgggttttcgcgggtcggtatttcggcggttgggttgcgggttagagtattgttcggtggtgtttaggaggagtaggagtaggagtagaagtagaagcggggttcggagttgcgcgtttacgcgggatttgtgttcgaaatgtcggtgcgaggagatcgcgggtttttatttcggcgggagttgttaggttggtttcgcgtaagtgtttttttgtgtcgcgcggttgggaggagggtcgtgagcgtgagcgtgggagcgttgggggttttgttcgcgtgttgttttgaagttgtttttcgatgcgtcgtaggaagttgggatttttttattcggacgtgggacgtaggggaggggtaggttttatcgttcgggttgatgattcgtggttttcg

SEQ ID NO: 6501 - DNA, 2705 bp, synthetic construct
  misc_feature 1..2705: note = Description of Artificial Sequence: Synthetic polynucleotide
  source 1..2705: mol_type = other DNA
tcgtgtttggtggttcgggtggggcgtagttgcgggaaatgtattcggagttgtgttttttttcggcgaatagtttgcgttattcgtcgtatcgggaggtggttgggggttgtcgagcgagtggtgaacgcgatgggtggagagcgttcgaaacgaggtggaaaagggggcgggggcgaggtacggcgtttttttgttttttttttagttatagacgcggcggcggcggttgagttttttagtttcggttatgtgatagtttcgaagcgttagttgcgggggtttcggcgtttcggggattattataaaacgtagttaggagagcgcgtcgttgttattgtcgtcgttttttttttttaagataagttcgggagaaaggcggtagttgcggcgcggacggttgagttttttcggttagtatttatttagtattcgtagacgttttttttagttcgtcgttcgtttttagagttttgcgttttatattttttagtagaatttgcgggcgttgtcgttttagaaattattaaagttttttttttttagcgatagtttagggttgcgcgttttttttaatttcggcgacgttgcgagtttcggagaaaagagaggcgttttagaagttaattttttttttttttattttgattttttattttaggaaaaggagaattttagcgcggtttggttaagtgtttggttaggggtttgcgtttagggtattggaagttttgttgttattggtttttaggatagtaggcgtaaatttagatttaaagggttagagtttttattgtttagattttttttttagttattttggtttgggtttttttcggatttagaaaaagtaaagaggtcgggaggaaatacggttttttgttatttttttttgtagttagttttagtatttagtttttggttattcgggggaagacgtagagaaggcggcggtaaatttggtgtatttcgttcgcgattgtgcgcgttagtcggtaatcgtcggggttagaagttgttagttttcgagagttgagtaggttcgaaaggttaaggtcggagatattaggtaattcggagaaggtaggagagagaagtagagagggtttggagggcgagagggtaaagtggcgggattggaggggtcgagtgggaattagtgggggtagttaggttttaggaacggagtgcggagagattttgtggtttagtgcgggtcggagggcggtggaggagtcgggggcgatgtcgcggtcggggaagagttcgtatagcgattaaaaatcgttttatttttatatttcgttgatcgttatggtaatttagtattcggtcgagaagatgttgtcgttgagcgatatttataagtttattatggagcgttttttttattatcgcgagtatatatagcgttggtagaatagtttgcgttataattttttttttaacgattgttttattaagatttcgcggaggttcgattagtttggtaagggtagtttttgggcgttgtatttcgattgcggggatatgttcgagaacggtagttttttgcggcgtcgtaagcgttttaaggtgttgcgcgtcgattatatttatttgtacgcgggaagtattaagagcgcgtcgggcgtcggttcgggagggtatttttatttttattattattattatttttattattattattattattacgttgtcgtatattattattattattattatttattttagtcgtcgtcgtcgtcgttttcgtcgtcgtcgtatatggtatattatttttattagtaatcgtttattgtttcgtagtcgttttcgtatttttcgttatagttttcgtagtaatcgttttagtagtcgtagttttagtagtcgttttatttcggtaagatgtaggaggcggcggtcgtggcggcggcggcggcggcggtcgcggtagtcgcggtgggtagcgtgggacgtttgttttagtttttattttacgggttgggttcggtcgtcgtcgttgtcgtcgcggtcgtggcgtttacgttaggttttaagtatttttttgttattgagaatattattggtcgggattataagggcgtgttgtaggttggagggttgtttttggcgttcgttatgtattatttgggttatttcgtgttcggttagtttggtaacgtcgttagtttcgtgtggtcgtacgttggcgttatggattcggtggtcgtcgtcgcggtcgtcgtagtcgtagtcggagtttttgtaggttcggagtatggggttttcggggtttcggttaagtttttgtgttattcggtaagttagagtttgtttgttatgtcggtgtttattaagtttacgtttgcgttgtcgttcgtgttcgcgttgtagtcggggtttattgttttcgcggtttcgtagtagttttcggcgttatttatcgtgtgtttcgcggtcgcggtttcgttcgttgtttttttgttggagtttatagtttttatttcggtcgaaagtaagggcggttttttgtattcggtgttagtgtatttttaggggattcggcgggcgtggggagattagcggggtgagagacgtcgggttcggaatcgtttaaattattcgacggggagagggcgttttggttaggtcgggtagagttggcgagttttagtttttgttggaacggaaggtatttaaatagacgaataatttcg

SEQ ID NO: 6502 - DNA, 704 bp, synthetic construct
  misc_feature 1..704: note = Description of Artificial Sequence: Synthetic polynucleotide
  source 1..704: mol_type = other DNA
gcggaatgtgggcggggcgtagttggggagtttgcggggaatgtgggcggggcgtagtggtgggagggcgtaggagtgtgggcggggcgtagttgggggagggtgtagagatttgagggtttgaggttgtttggttggtttcgtttttagaggcgggtgtcgcgttgtcgtttaggtatttggggtttttggtgtttgagtgttttattgtcggcgcgaatataattgttttagttataggcgaggtttggttaaggtgtgggcgtatttggggtaggttttgagaggtttagcgttcggtggtgcggatagaggcggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcggcgttgtagaataaggtggtggtattgtatttcgcggcggttcggtgcgcgtcgagtcgcgattttacgtcgttgttttgcgatttttatacggcgttggtggtcgaggcgcggcggttcgcgtttttcgaagtggttttcgtgttagtcgacggtagtttttaggagatgttggattttatgcgcgagttgtatggcgtttggttggcgttgtttttttacgatttttatcg

SEQ ID NO: 6503 - DNA, 950 bp, synthetic construct
  misc_feature 1..950: note = Description of Artificial Sequence: Synthetic polynucleotide
  source 1..950: mol_type = other DNA
tcgggacggagcgggttattcgagtggtaaatttttttttaatggatgcgggaaaagcgtatttgtagttttttttttatcgttgttaagcgagttgattgttaaggagtgcgtatttgtttgtttttaacgtgatagtcgcgggagcgtttcgtatttcgggttttagggaatgaaggagtttgtttcgaattggttttagaatttttagtttttagggcggttcgcgttcgtatttattttgattacgtaggtgatttcgggttttagtatttggtcgttggcgtgcggcgtttttcgagggggtttgggtagcggttcgtcgtcgggtcggttttttttggcggcgtttatggtcggggcgcggggcgtcgagggcgtattgtcgttcggggcggttaggttgggcgcgttgtagttgttcgagagtcgcgcgttcgttcgttttcgggcggtcgacgataggtcgcggaggttcgagttggagagttttaggtgggatattttgtggagtaggtggtttaggttgtcgggtttatcgtcgggcgttttgcgtagcgtttcgtcggatattaagtagggagtcgtcgtcggggtcgcgcgcgtcgtcgaaattttgttttcgtcgtcgtttatcgataggttgtggagaaggttatcgatcgatgttatcgagttatttttgaagcggttatatttggtgcgtggaagtatgttttttcgtgggttcgttgtattcgttcgggcgttgttggtgtcggtttcggcgcgggttgtcgcgtatagtaggcgagttattgttttcggagcgggacggagagtgggggtttcgggatagttttttggagaacgagagtagagtaagaggatggtgtttttttatcgttaaaagttagtatagcggcggtcgcgtagtttcggttcgggagatcgttgtttggggttgtacg

SEQ ID NO: 6504 - DNA, 4861 bp, synthetic construct
  misc_feature 1..4861: note = Description of Artificial Sequence: Synthetic polynucleotide
  source 1..4861: mol_type = other DNA
gcgtcgtcgttttgagtattttgcggaaaatgtgagaattttggggagttattgttgttgtaaggattcgcgggcgggttatcgcgttggtgggggggttttgtttaaattttgcgttttcgattttttattcgttttataaagggttggtgaagattattttaaggatcgtacgaattggttttttaagttttaggaaatcgaaataataatcgaggcggttttttgttcgggttattttcggagcgagttttgcggcggatttttggttttcgtttttttgggtattcgcggtgcggttagatcgtttttgttagcgattttttggttggtaagggagaggaggtggagtttagattggttttttacgtttagagtggaagcgatttttaggattttgtagttatcgagtcgttcgtcgtgtttagttcgggtttgatggtgaagagtatagttgttttcgatagagtcggaggaaaggaagtttaagaagtaattgttcgcgtttcgtttattttgtcgagtttatttttatttttatttttattttttgcggatttagaagttgttttatcgagttcgattgtgttataaaatattttattggaaaaaaagttatcgttttcgtaagagggggtaggggttttagcgatatcggggattcggtttttaggtcgagtcgacgggttgtttcggggtaattttaggtcgttgtggtttgagtttaatcgttgggttttcgacgtttagaagcgggtgtgtgtttggaggtttttcggtcgggagggtaggttttagacggggtgggggtgtaggcgaggagcggggcgtgaatacgcgtggagcgttttgcgttacggagtttagggtagagattgtagttttcgtcgggttggatgcgagttttttaggttagagtttagaagcgcgttgggatttgggtttggtttttgggtttgtgttttttttcgtttggttttaattgttcgtatttaagattataataaaaaggtttaggaagtaaattttttggacgcggaagggtcggttcgcgggttttcgtcgagtgagggggttgcgggtggcgcgggtattttaggtttcgtatcgtatatcgtttttagttttcgcggtttttgtcgttgggttcgttcggtattttcgtcggtttttttgtatttttggcgcgtttttgtttagtaagttgttcgttcgttggaattgagttttttttgggtcgttttttgggtttggtgggagattttaggtcgtcgttttgtagtatttgtacgggggatcgttagtatttgggtgagttagtacgtggattggggattttcgaggagatttgaatttaggtaggattaaggagtgtagggtttatatgaggaaatggtggggaaatgtttcgggaaatggcggttatttgtttaaatgtcgtttggggagcggttcggtttggggagtataagattgttaggaggtttgaaggtgtcgcgggaaaggacgaaatgttggtttatttaaggggtagaaaaaattgagaggatttcggtgcgtattaggtatcgagggaatcggggggttgggtagagttttagtggggagaaagaggagagtagttttgtatgtatcggggtatggtttaggaagttgaggggtgggaagttattaggtatatttattatttttttttattttatttttcgattttggtattacgtttttatttgtaattggtttaggtttagggatttagtaagatttattttggaaagagtagggcgtatttttagtaaggtaagtgattatatttttatagttcgttggttttagttttgtatcgttttatttgttcggcgtggaaaggtatttttgtttttcgaagcgtttttttaggtttattagttgtagttcggtgaatatagtgcggtttcgacgtttttttttggttttggtgtttggttttttagggtttgtcgtttttagtttttcgcggagttgtaattcgagcggtaggtgtggcgtattcgcggcgtcgggtagttcgggttttgtcgttagtaacgtagagtttagttttgaatagtttagcggcgttagtgggaatttgaatatcgtcgtttgttcggtttttagtacggttgcgaagaaagagaatgaggattcgggtgagttacggtcgcgtttttttgttttagggattgtcgtattacgtgtcgcgggggtgttcgcgtttggttagtgttttttagcgtaaaatttttacgttttgtcggtcggcgtcggtggcgtagatggagattttttttaacgttgtcgttttttagatttgggagggagtattttttcgattttgttcgtgttttgttttggagttttttaggttttagttgtttttgagatttcggggtttttgatgaatatgtttgtagttgcgagaaattcggagtgtgttttgtttttcggggaaagtagaaattaaaaagaaaacggtagttggttttaagaagatggcgtttgttttaattaaattagttttgttgcgttagaaaaagaatatgtacggagcgtgtatatttgttttttcgtgcgtggtataatagttatgcggtggttaggagttatttgggtcggagttgggtgtttttcggaaattttaaagtattttgagaatttggaaattattgtttacgttttttatttttagacgtttttttatgtagatgtttttattttttttagttttaaaatgattgtgtgttcgttttaaacgaattagtagtaatagagtagatggagacgaaaggtagtcgaatggtcgagttttagttggatttagaaggagcgcgttggttttgtcgtttttaggttagggagtatcgattaggaggtgggggggtgtagggaaggcgatttgaagggttggggtttcggttatagcgtaggagtttttttttttcgataggtttgttattgaggtgcgagttttagtttggttggagtcggaaagggtagggtaaggcgtaggtaaatgtggggtagaggattcgtagggaaaaggtgggagatgggaggtaggtcgattttaatgagagaagcgagggaggtcgatcggtagacggttggaaagcgagatagggaaagataagacgagggtggagtgcgatggagatagtattattagggtagagtaggtttcgttaaattagaagaaagggtagaagttgaaaaggtttgcgtaggtcgtttaagttttgtagaggtttagtcgatttgaaattagaagggatagttaggtagttgtttatagttaggtttttggttttaaggtaaggtcgaagtaggttcgtattgcggttaaggtcgcgtttttcgttcgttggagttttcggggatttcgggtcggtttgggttcgcgttagtatttagttttcgggagcgtaggttttttttttagaggttcgatttttttgggttgggtagtcgcggttattttcggttatttttttgcggcgaagtttaggcgttcgtggtttgaggtcgtttttatttacgagagttcgtagtttggtagtgcgtttgtattggggatgtttattcggggttttcgggttggaggtcgaagggaagtagtgaaggaaagagcgaatatttttttcgggcggttcgcgggtacgaggtttggtttttgtgaggtttggagtttgtatttttcgtttttcgtttggagggtttcgagagacggttttagaatttgcgtttttagagtagtttttcggggttgtttcgatgtcggaggaggttcggggcgttttcgcggtttagttcgttgtttttcgttaagttcggttcgcgatttcgcggtcgttatacgtatttaggtggttgtggaagggtcgcgtcgttagtagcgtttgtacgtcgaattttagtagttcgttcgtcgcggtagcggcggttgcgggcgcggcgtttttgggttcgggtggtttcgtgaggatttttttaattatgaagttgcgatagcggtgcggtcggtggttcgcgtagttttcgggcgggtcgaagcgcgcggcgttcggttttttcggtcgttgtatcgcggcgtttattgttgcgttcgcggtttggcggcggcggcggcgacggtttggtttcggcgcggggttcgcgcggggttttaggtcggttcgtagttcggggcggcgcgcgggcgtcggtttatgttttttttttcgtcggtcggtcgggcggaggcgtagggcgcgggcggggcgcgcggggttcggtcggtcgaattcgggattgcgttttttttttacgtcgtcgcgttttttgttcggttagtttcgcgttatcgtttcgtttcgtttcgtttcgcgtcgttgtttttaatttttaggttgagtcggagggagggatttagaagggagggaggcggaagggaggttaaaaaggagggggttacgtgaaagaggtcggtcgatcgagatcgagggagattgagcggagcgtacgttttggaaggagagagtcggagagttcgggaggtaagatttttagagacgagagtcggagggattaaacgatataggtgagagaaggggtagaggtagacggcgtgggttaaataagattttagatagtgatgtgagggtattagagacgttatcgagatgtgcgtagagagattaaaagaggcgtgagagttagcgggttgtgacgtgacggagggtatagaggtaggcggggtagaggaagggggcggtaaagaaatgggaatagttagaaaatcggcggtttgatcggtttttaggtagtttcggaaaggtcgggaggaggaggggtaaaggtcgcg

SEQ ID NO: 6505 - DNA, 999 bp, synthetic construct
  misc_feature 1..999: note = Description of Artificial Sequence: Synthetic polynucleotide
  source 1..999: mol_type = other DNA
gcgtaacggtttgtttgcgttttttgcggttatagtcgatatacgttcgtagacgtacgtacggatatttcgttttttattagcgtacgaagacgggacgcgcgtttatagttttagggttcggttttgtattacgagttaacgcgcggtttttagggaggtggcgtagaaggtatggcgtttttgtttacggcgtttcggttttggtagtttttatagagattttcgttgatggtttaggtttaaaaggttttttttttcgagtttgcgtttttttagttttttcgttgggttagggtttattattttttttcgtcggcgagcgtgggtttttttggaggcgggggtggttttgtagaggtagttttaggtgcgcgttggagaggtcggttcgtcgcgcgggagatattttttttaaagtggaagcgttgcgtgggtagtagcgcgggtcgggttttcggattttagtttttgttgttttcgagattttcgtttcgcgtcgtatttttcgagtttagcgttttcgggttgcgttgggcgtagtggttttcggttagggcgtagtcggtttgggcgttagagttttttttagttttcggtttagggcggggaagcgttagttttcgtagtttttgtgaaaggttttttgtgttttttgtttaggtgcgcgttgtggtatttttggttagaagtatttttggcggtttgttgggtttttcgtagtttttggttgagattttgtcgtcggcgttaacgggttgcgttcgcgttttcgttttgttttcgttcgggtttcgggtttcgcgtgtatattattttttggttttttttattaaaattttttgatttttagttcgatgttgtcgtcgcggttttcggaattgttgtttttagacggcgagtcggggttgggagcggtttttacggggacggatttttttcggaggcggaggtggtttttttgacgcgaaaggtaggggcgcgtttcggtttttagcg

SEQ ID NO: 6506 - DNA, 1750 bp, synthetic construct
  misc_feature 1..1750: note = Description of Artificial Sequence: Synthetic polynucleotide
  source 1..1750: mol_type = other DNA
tcgcggttttagggttcggcgatttttaaggttttcgttttaggcgttgcgggtaaatagggtttgggggtttttttttatcgcgggttgagttttcgttatttgttttttttgtcgcgggtatttaagtttcggaatttgcgagttaggtagcgttttattttcgcggcgtcgtttttgatggttattttgtggatttttcgtagtttttagttttcgatgtggtattttcgattcgcgtatttttggtttatggagtttaggagcgtttggtttaggcgtttttcgaaattgaagagtttttttatggtggcgattttttagacgttaattattcgttattgagtcgtcgcggtttttcgtggtttttttatttcgattaagttttaaattcgcgatttttttttttatttcgttatttatttttaaatttaagatttattattaaattagtaatttatttttaaatttaagatttatttttaatttcgcgatgtagtttagaattcgcgatttagttcggtttattatagtttttagtagcgatattcgtagttttcgattttttagatcgagtgagtttaattaagtcgttattcgcgtgttagtagttgggcgtttcgattttttagatcgcgtgagtttagtaaagcggttaggcgcgcgtttgtagttcggcgttagttcggatttcgggagtcgttttcgagttcgcgtggacggtagagggcggttgtagttcgggcgtaggcgtcgttggtttgcgggtttttttgggttcgcgtaggatatttcggaatcgtaggcgcgtattttttttcgtttgagggttcgtttggtcgtgattttcgttttttttttttttcgaagagagatggggtcgttggtaggggtttttcgtagttatcggggatggggttgagggtcggtttttgtttcggtgtagtcgtcgcgggtagatcgtttggtttggtcgtagttatagcgatatttagtttcggttttgcgaggttgggcgcgttagttagtttgggagttgtttggcgtttgtagttgggcgtttaggtggtggagtatggtttgggcggtttttggatcgcgagtgtttttggtttgagagttcgttagattttgtttttattcggttttttttttgttagagttcgagatttttagttaggggttttttgtaattatcggggatggggttgagggtcggttttcgtttttgtgtagttgttgtaggatagatcgtttggtttggtcgtagttatagggatatttggttttggttttgagatgtggggagtgcgggcgggttcgagagttgtttggaggttgttgtttgtatatagaaggcggttgtagtttgggtgtttaggcgggttggaggtgtatggtttggtcggtttcgggatcgttagcgcgtttagtttgagggtttttaggtcgtgtttttcgtttatttttttatttgagggggattggggtcgttggtatgggtattcggtagttatttcgtgtggggttgagcggcgggttttcggttttgtttttgtgtagtcgtcgttgggtagaatgtttggtttggttgtagttattgggatatttggttttggttttgcgatgttgggagcgcgagcgggttcggaggttgttaggtagttgttgtttgtatatagagggcgattgtagtttgggcgtttaggcggcggagtatggtttgggtggtttttggaatgcgtgcgcg

SEQ ID NO: 6507 - DNA, 391 bp, synthetic construct
  misc_feature 1..391: note = Description of Artificial Sequence: Synthetic polynucleotide
  source 1..391: mol_type = other DNA
gcgtaggtcgtagaattttttcgcgaaggtgtcgtaggaggagtcgtggcgcggtatcgtttcgtcggcgttcgtgttttttcgcgcgcgttttcggggttttcggtttttcgggttcgtatcgtcgttcgcggggttggttgcgtaggcggcgggtttcgttagtagtagtaggagtagcgacgtttagattttcgggtgttgtcggggcggtcgcgttattcgtgcgtatagatttcgtagttaggtcgttcgggtcgtagcgggggcgtcgcgggcgcgggtcgggattgagttttcgtcgaggttattagtacgcgttcgcgtagtcgcggagtttttcgtattttcgtttttttgtttcggtttgcgtattttcgttttagtatcg

SEQ ID NO: 6508 - DNA, 817 bp, synthetic construct
  misc_feature 1..817: note = Description of Artificial Sequence: Synthetic polynucleotide
  source 1..817: mol_type = other DNA
tcgggatagagacgggtaggtagcggtgggtcgaagggttcggggattagggttcgggtcgggaggggcgggcgttttatcgcggtttgttggaaggcgtttttggtgtaggtgtcgttatttcggtaggagatggtagggattttttggaggagtagcgcgtatttgtgttggcgcgcgcggcgggtggagatgtaatcgacgcgcggtattacgtagtttttggacgagaaggttacgatggttacgcgcgtggtcgtgggtattacggggaagtcggatagtagtttgcggacgaatatgagttcgttgcggaagttgatttcgtttacgttggacgaattatttattaggaagataagttttaggcgttcgttgagttttcgtagtagtcgtacgcgtcgtcggaacgtttggtttagtcgttttattttgtttttcgtcgtttcgtcgttaggagcgggcggcgcggggatattttcgggggtttcgggcgcggtttcggggaagaggcggaagttgaaattgcgcgacggggatatttgttgaaaggtcgtttagttcgaaacgagcgttagattttagtaataaaaggttaggcgaggttatatcgcgttggagatagagcggttgtttcggagcgtaggcggcggttcgggcgggaagaggcgttgggcggtcggattcgtagaggggcgtgcgcggagttgggcgcggggtagcggttaagagttttagcgtttttttatttgatattggggatagatataatttagattttttagtagttcgggaatttcggagggaacggcgcgcg

SEQ ID NO: 6509 - DNA, 814 bp, synthetic construct
  misc_feature 1..814: note = Description of Artificial Sequence: Synthetic polynucleotide
  source 1..814: mol_type = other DNA
gcgaagaaagtcgaggcgtcgaggtttttaaagttggtagtttcgggtggcggtgtaggggcgaagggggggcggggggaatcgtcggatatgcggttttggagttgggtgttgtatttggggttgttgagcgtcgcgttgggttgcgggttggtcgagcgttttcgtcgggttcggagagattcgcgggtcggtcgattttcgcgtttcgtcgtcggttcggttatttgcgttattcgggcggttcgcggtcgtcgcgtttcgtcgtcgtcgtcgtcgtcgtcgggcggtgtttgggaagtcgtgcgcgtttttcggcggcggtagtagcgggaggcgaggggcgttatcgaggagtcgagttcgtcgagtcgggcgttttattttagcgggcgaggcgagtagttgcgttttcgggtcgatttcgagttgtttcgggacgcgtttacgttgtaagtgtggttgcgagcggaggggggttagaggttttcggtagtgattataggtaggtgagggcgtttcggcgggcgttgtatcgtttttgcggttttagaggttcgcgggtgtttgggcgcgggtggcgggcgggtcgggggtttgcgggcgtgtttgtgcgagagttgtttcgcgagcggcgtagagatattcgggcgagttgagagttttattttgttttatcggtggaatgggtatattcggaaggcgtagttgttttatttttgggaggaatttggggagtttttttggcggtttcgcggattttcggttagtgagggttggttttcggagtttagggtacgtaattcgtgtttcg

SEQ ID NO: 6510 - DNA, 1429 bp, synthetic construct
  misc_feature 1..1429: note = Description of Artificial Sequence: Synthetic polynucleotide
  source 1..1429: mol_type = other DNA
gcgcgtataatgaagtagttgtttgtagcgttaattagttggcgattttgaggttattgcgtggttttgttttggtcgtttttaataacgggatagagcgtcgggtatcgcgtattgattaattatttttttttcgcggtcgttcggtttttttttttttttttcgtcgggtttggttttatttttttcgggcggtttgcgtttttttttttcgcggtttcggtttcgtggcgtcggtagtttcgggagtttcgggaagtttgcgcgcggtagtttcgtagtcggtagtcgggagtttcgtagttttcggggagcgtcggggttggtggtttttttgttggaggaggcgtggagggagcgtttttgttttgagttagttacggtggtcggttggaggttgttattttattatgcgtcgggtttgtttgtttgcgaggaagtagatggtggggaggtaggtagcggcgagagtggttagatttgaatttcgtttatttgttattttttataaaaggtaggttcgggggatttaggtattcgttgttattttttgggggagggggaggtcgaggggtcgtcgttttcggcgtttgcgaaggtttcgtatttgtcggtgttcgttttttttattttttgttttttttttggttgtagtttttcgtatcgcgtaaatgttatttacgtgttaggatgtgtgtttatagtttgtttttttgtttgtttagtttcggcggatagggtttagcggttgcgcgacgtttttcgtcgttgggggagattagtaaagttattcgtttttggatttcggggtttgggtttttagatttcgtttcgcggcgggagatgcgtttgagttttttatagacggagcgcgttttagtttgacgtagagggatgaatagataagcgtatcgggcgggaatttcgattgtttgtgtatttggggtcggtttagcgttggacgtgggttgttggttcgagaggtggcgacggaatcgcgtgtttatatgtatgggggagtggaaagtcgtagggtgtgtttttacgttttttgagtagttcgcggtaagagttgttgagtattttatttttcgtttttagattttaaggtagtttttcgagttttttaaacgtattgtatttagttttttcgagagtggagttgtattaaggataaatattttagcgttattataaattttttttgttttttgggcgatttttagatgaattttggtgatttttagattggatttttattttttattttttttgaaagaaagtgttttagatgcgttaataaaatatgtttatgtattcgtgtaggcgttcgtatgtttgcgcgtcggtcgtgtgtaggcgtcgaagtatacgtttgtgtgaatatacgggtacgcgcgtttttgggtttagtggtttttttttcgcg

SEQ ID NO: 6511 - DNA, 7708 bp, synthetic construct
  misc_feature 1..7708: note = Description of Artificial Sequence: Synthetic polynucleotide
  source 1..7708: mol_type = other DNA
tcgggaagagcgagaagttatacgttgggttgtagattgggttttagcgggtttggagcgtggatatgttggttggttttttttttcgggagttatagttttcgtcggtttcgttatttaggttttgtcgggtatttaggaggtttgtacggtcgtttgtagttcgttgtgtagagttcgggtcgaaggcggagttcgatgggaaacggtcggtcgaaggtttttgtaattttgttataggtttgttttttcgggttttttaggcgggtgtttgaggtcgcggttttaggtcgaggggagatcgtagtgagacgagtatttttttgttgcgtttttttaggatagagggtttaatttttttttttgaagatatcgtaggaagttgttcgtattttaaaaattttaaatttcgcgtttttttttttttttgttttttttttattttcgttttttagtttcgtttattagtttttattatttcgatttttttttgttttttttgtttttttttttttttttgggtttttcgttttttcggagtacgcgttgttagggtttggggcgtcgagcggttaatggtacggcggtaggacgtgatgttaggcgcggttgtagaaaaggcgcggaggtttgcgttggcgcggattgtagagtcggggttgggttaggcgcgcgtttggagagtattgcgcgcggttgggttcgcggtcggcggtttttttttttattttgtttttttttttttttttttttttttattttttttttcgtttttttttttttttttttttttttttttttaattttttcggtggttcgattcggttcgtaggtttcggagaaatttttattttagtcgtcgatttagcgtttaagagggtcgttttgggttgggggcgtattttagggaggggaggggtttaggtagttgggtcgtcgcggatatttagcggttttagggtgaatttcgatcgtagtcgtcgtcgtttcgggtagagtttgcgtttttgttttgcgtttcgggcgttgaagtcgggcgggcgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcgttttgtttcgcgagcgttcggggttcggagttcggtttgggggtttagtcgagttcgggcggggtcggggtcgcggtggcgatgtatcgggttcgttagcgttaggagcgttaggtagttgaggcggggggtaagttttttttcggaggagtcgcgttttcggtttcgtcggtttcgtcgcgatgttgttttatagtttgtcgggtttcgaggtgtacggggttatcgacgagatggatcgtagggttaagagcgaggttttcgttattagtttcgttatcgatcgcggcgatatcgagacggtaggcgcgcggttgtggggtcggggttgagagttgggatggggtcgggttagttagcgtttttgtttttcgaagtttggggagcgtttttcgtgtcgtacgggattgggtgttggggattttcggttagaatgtaaggtcggtggttttcggttcgggggaaattcggttgttgggacgtagaagggaaataaggttgaaatcgaaatttcggttttgggggtagaggagagcgtttttttcgaattggaagcgaagttttattcgcggttcggggcggttttttttttattttgttcggtgtcggggtcgatagtttcgcgtttttttttatttttcggtttcggttgttggcggcgtcgcgagcggcgttagggaagggcgaattagttgggagtattggggttttagtcggtttgggtcgtttttagtttttcggtaatcggggattttttttaatttttagcgtagttttagaggtcgaagttttcggggttaatatttgtcgttgatcgcgtttttagatttttgattggttagatttagttaggttagggttgggagtttaggtttcggtttggttttcgtcgaaggagattttatttggatttttatatttggtttcgcgggtttagttttaaatagttagtttttcgttttaggtttttttgggggttagacgagtagatattgttcgattagcgggtttagaagtgatttttaggaggtcgcggaggtggggagtacgggagaagtttttttgtttcgggagtaggagtagcggcgttagtgttttttcggtttttgagcgttttttcggttagattttttttgttggttagtttggatagggaagtatttgggttgaatttgttttttatttacggattttgagggtgtttttgtattttatttattttattttcggatttaagagggttttagttcgtgtggtagaggagttagaagttggttgatttgttttggttttaatttttggtttaaggatttagggattattggagttggggtttaggaatttcgttgtttttttaaagaggattttgtgtggagggtgatttaatggttattttatttttcgggtggtttatttaagaagtagtttagggaaagtttttggagggtttgattggagtagttgttttggtttttaaatatagttcgagtattttgggggaaaggatagggaggattggaaggaagagaggtaagtattagagttatttaggttaggagttcggtttgggttcgtggttggcgagggttgcgtaggtaggtttgggttttgaatcgtttagaaatggaaatgggttttttggggtggggggaagcgcgtcgtatgttttggtagtttttttcgcgtttagggtagttaaggttatagagggagttgtgggtgtcggtttttcggcggcggaggggtcgttggttgacgtaggcgttgttgtttttcgttttttttttttcgtagattatgtcgtttattagtagtgatcgcgtcgcgttgtgcgtcggttgcgggggtaagatttcggatcgttattatttgttggcggtggataagtagtggtatatgcgttgttttaagtgttgcgagtgtaagtttaatttggagtcggagtttatttgttttagtaaggacggtagtatttattgtaaggaagattattataggtagtttttttatttaattgttttttaggatttttttttttaattttaggtatagttttatagtttggttttttttttttcgtttagttttaggagagggtttattatttaggattttttcgttttttttttaagttttttaagttattataagttgggtgataattttttaaagtagtaatttggggagtttttggaaaggtttacgaagtaggagaattagaaaaaaagtagaagttgtttttttgttcggagtttagattataaaaaagtttgagttgggatttttgtttttttttttttttgaagttttttgagttaattcgaggttatagaaataggtatttttaaatttaggtagtttaagttggagtgaaatatagttggaaagagagttgtgggagtgggtgtatttttaggttttttgagaaaatgggaatgaaaggtggttaagattaaagaattagaattattagtagattttaagttttttgtttttttttttttttagttttaggattagggtttatgtatattttttttgtttttgtttttacgtttgtgtttttttttttttttttgtttttgtgttttttttaaattataaaagttagtaggatttttaggcgttggtttggagggaggagtaaaggttgaggagggggtaagtggtaagtgtttttttttatttttaggtaaaggtttttttagggtttgcggagattttgggtgaagtagaagtttttgtaggtataagtgtgttaagggaaattattttaggataggattaggtttgggttaaaatttagtttttttttttttttattttttaaataaaggtcgggttgttcgttttgaggaggggattgtttttcgtagtagtagcggtatttggaggaggaaaaggggggtatttaatcgtgtgtttttatagtttttttttttatggtttttataggcgtttttttgtgtagcgttgcgttcgttgttatttgggtatttcggtttcggagatggtgatgcgcgttcgggatttggtttattattttaattgttttacgtgtattacgtgtaataagatgttgattacgggcgattatttcggtatgaaggatagtttggtttattgtcgtttgtatttcgaggcgttgttgtagggcgagtatttcgtatattttaattatgtcgacgtggtagcggcggtcgttgtagtcgcggcggttaagagcgcggggttgggcgtagtaggggttaattttttgggttttttttattataatggcgtgggtattgtgtagaaggggcggtcgaggaaacgtaagagttcgggtttcggtgcggatttggcggtttataacgttggtgagtgcgcggcgtacgaagcgtttttatagggttgggggaaagtgtgcggtttcgacggtcgggagttggattgaatttttgtgtgttgggtaaatagcgagttttaagtatcggacggtttcgtagaagggatattagttttttgggtttttagattgtgcgttttcggttggagcgggaggagagggtgtagtggttttttgttgtttcgggtgtagggttttgtttttgataaattgtttttttggagatggttttttggtttgggtttttgttttattttgttaggtaggaagtggtagggatggagaaagtaaggcggcgttgacgttaaataggttttgggttggcgcggttgagggtcgggaattggggtagcgaaggaacgaggtagggcggcgagggttttaagagaaagggttggttgtggttcggggcgtcgagttcggtttggagtgcggtttgatttcgtgaaatgttttaagggcggtaggtttggggaattcgggtttggggaatttaggaaagtaaaggttgcggttttttttgttcggttcgatttttttttaaagataggttttagttttttcggattttttttttcgagttttttggcgtttgttggggtgagggtcgtgattttcggaagcgagtttttcgggcggggacgagatcggagtaggtttggtttcgcgttggggtggggtggggtggggtgaggtggggggtttggttcggattttcggtatttttgaattttaggttattttcggagaagttttgttttttttcgcgtttttttttgtttaggatagttgtagaggttttgagtttcggtaaatgagtcgttaatatttgttcgaagtttgtaaggttcggaaaggtttatgatttttcgggttttcgaattagagtttatgtgtaattattttttttttttcgtttgtaatagaattagatttggagattttgtgttttttttttttttttttttagtttaatgtataagtagaaaaaagtaaaaataaaaataaatttaagattgtgtagagggtgttacggcgggaagaagttagttatttttattttaaagaatttgagttgaatagagagggaaatgaggggcgggtgttcgttttaacgaaatcgtttggaggattatggggcgtgtgtttttgtgtgcggaattgggaggaaaacgtagtttttagtttggtaaatggtgaagtagcggtaggtcggtcggtggcgcggatttaagatttgttgaaggtattattatagatgtagttttttggaatttttatttttttttttttattattttttaaaaaaagataaaatcgagtttagatcggtttttttaatattaagtcgtttttatttattaagtgggttaatttttattcggaagtatttcgcggggttcggttttagggtatttggtggttggggagttgtattgtttttttgggtacggaggttcggcgtcggttttaggattgtgtaaaaagagagtagaaggtatagagatttatttttgttttttgttgtttagtcgtcgtttgttttagcgaggtgggttggaggttgaattttaagttttgtttaatttttataagagatattttttatttagttattttattttttttttggtttttttttttttttttttttttttcgtttttttcgttttttttttttatttttgtttttgtgtgtgtcgtgtttgttttcgtgttttttttttcgattttggtcggggtttttagttttgagagaaacggcgttcggtgcgtcggcggtggttatgcggttggttttttcggggttttcgggattaggttggggaaagagggtattttttcggtttttcggggtttagtttagtttttttagatttggcgttcgttttttttttttttttcgtattggtaggagagaaatggtcgtagtgtgggtcgcggggtagttaggattggaaagcggggattttggagggtgcgatcgcggacggggtgtgcgggcgcgggtcgtgtgcgtgtgcgtgtagggtttcgattacggggatacgagtttgtttgtggtagtgttttatattttgtggtttagttacgacgattttttgtaaagttttttgttttggggatagttttttcgaggcgcggcggtattttattgaagggcggcgagttgggggtcgagtggggagggggcgtcgtcggggcgtcgggcgttgggtttatagtagagtcgcgggtcgcggggtcggaaagttttttcggggcggggtcgtagcggttttttttcgtagtttttcgggttcgggtttcggtggaacggaaatttttttttatttcgggaggggttgttagcgggttgggggtgcgaaaacggcggtaggagcgggcgaggggttcgggtcgcgtattttgcgtttgggtttgcgcgtcgcggtcgcgggagtttcgcgcggatcggtcggacgttcggttttttttagttttagttttttgtgtgtgtgtgtttggcggcgtaattattgatttgattttaatttattatttagataattgaatttataatttcgtttttagtaaaatgaggcgaagttagatttgattataggtttagttttagcgataagagttcgaaattcgatgggttaataatagattacgagtaaattatttatgattttacgagttttttagttttattgaatcggtttaattgagaggaaaaaaaaaaaaaaggagagagaaagttcgggtttttttttttttttcggtttttcgttttttttcggattcgattttggggaatttcgattcgttttcgggtattgggggcgggagtgagggggttcggggcgtcggttaaatttgggttttacggttgtttttttcgtcgtcgttttttgtttttgtttttggtcggtttcggtttcgttatttagggtcggtttttttttttttttttttattttttttttttttttttttttttattttttcgttaataacggtttcggaaaaggtttttttcgtagggatcgggtttttcggagtttcgggatttagttcggttatcggattttcgttataagttgcgtttgttttcgggattcgttttttttttcg

SEQ ID NO: 6512 - DNA, 3969 bp, synthetic construct
  misc_feature 1..3969: note = Description of Artificial Sequence: Synthetic polynucleotide
  source 1..3969: mol_type = other DNA
tcgggagtgtgggtgtttcgggggcgtgggtgttttaggagtgtgggtgtttcgggggcgtgggtgtttcgggagtgtgggtgtttcgggggcgtgggtgtttcgggagtgtgggtgtttcggaggcgagggtgtttcgggagtgtgggtgtttcgggggagtgggtgtttcgggagtgtgggtgtttcggaggcgagggtgtttcgggagtgtgggtgtttcgggggcgtgggtgtttcgggagtgtgggtgtttcgggggagtgggtgtttcgggagtgtgggtgtttcggaggcgagggtgtttcgggagtgtgggtgtttcgggggagtgggtgtttcgggagtgtgggtgtttcggaggcgagggtgtttcgggagtgtgggtgtttcgggggcgtgggtgtttcgggagcgtgggtgtttcgggggcgtgggtgtttcgggagtgtgggtgtttcgggggcgtgggtgtttcgggagtgtgggtgtttcgggggcgtgggtgtttcgggagtgtgggtgtttcgggagtgtgggtgtttcggaggcgagggtgtttcgggagtgtgcgtgtttcgggggcgtgggtgtttcgggggcgtgggtgtttcgggggcgtgggtgtttcggaggcgagggtattttagaagtgtgagtgttttaggggcgtgggtgtttcgggggtgtgggtgtttcgggggcgtgggtgtttcgggagtgtgggtgtttcggaggtgagggtgtttcgggagtgtgggtgtttcggaggcgagggtgtttcgggagtgtgggtgtttcgggggcgtgggtgtttcgggagtgtgggtgtttcggaggtgagggtgtttcgggagtgtgggtgtttcggaggcgagggtgtttcgggagtgtgggtgttttaggggcgtgggtgtttcgggagtgtgggtgtttcggaggcgagggtgtttcgggagtgtgggtgtttcggaggcgagggtgtttcgggagtgtgggtgtttcgggggcgtgggtgtttcgggggttgtgggtgtttcgggagtgtgggtgtttcggaggcgagggtgtttcgggagtgtgggtgtttcggaggcgagggtgtttcgggagtgtgggtgtttcgggggtgtgggtgtttcgggggtgtgggtgtttcgggagtgtgggtgtttcgggggagtgggtgtttcgggagtgtgggtgtttcggaggcgagggtgttttaggagcgtgggtgtttcggaggcgagggtgtttcgggagcgtgggtgtttcgggggcgtgggtgtttcgggagtgtgggtgtttcgggggagtgggtgtttcgggagtgtgggtgtttcggaggcgagggtgttttaggagtgtgggtgtttcgggggcgtgggtgtttcgggagtgtgggtgttttagaggcgagggtattttagaagtgtgagtgtttcgggggtgtgggtgtttcgggggtcgtgggtgtttcgggagtgtgggtgttttagaggcgagggtgtttcgggagtgtgggtgttttaggggtgtgggtgtttcgggggcgtgggtgtttcgggagtgtgggtgtttcgggggagtgggtgtttcgggagtgtgggtgtttcggaggcgagggtgtttcgggagtgtgggtgtttcggaggcgagggtgtttcgggagcgtgggtgtttcgggggcgtgggtgtttcgggagcgtgggtgttttaggggtgtgggtgtttcgggggcgtgggtgtttcgggagtgtgggtgtttcgggggagtggatgtttcgggagtgtgggtgtttcggaggcgagggtgtttcgggagtgtgggtgtttcggaggcgagggtgtttcgggagtgtgggtgtttcgggggcgtgggtgtttcgggagtgtgggtgtttcgggggcgtgggtattttagaagtgtgagtgttttaggggcgtgggtgttcggggggcgtgggtgtttcgggggtgtgggtgtttcgggggtcgtgggtgtttcgggagcgtgggtgtcggggattgtagggatatgggtttttttttttatttttgtcgtttagggtattttttgtgaggattcggagttcgtgagtttttatttttttgagttcgattttttggtgttttcgtttgtatttttagtttttttttaaattagattagttttttaggggcgtcgacgtgtgaaattgattttaaagaaaataggtagtggtttttttttcggttttacgtggtttagtagcgtttatttttcgttttttttttcgcgtttagtaattaatttaggtcgtttttgtagaattcgggtttttgtttatcggtttatagcgtttatttgaggtttcgtttttttagtaaaggtcgttttttcggaacgcgttttttgcggtttttttagagtttttttcgcgcgtttttttagtttcgttcgttttttttcggggtttttttttttcgtttgtttttaggttcgttttttttcgcgggttgaggtaggttcgggtagtacggtcgtttcggggcgggggttattttttattatcgcgtggtgtttatagtttacggcgttttcgggtgacggttttttcggttgtagggcgttttgaagagcggtttgttcggagttgagcgtacggggttgtttcgttttgggcgtttttggtttttattagtttcgtttttttatgggtaaaacggcggttttgtttgtttataagtaatcgtcggggttacggaggggttaggagttgcggcggggggttgtgtttttaggatcggttttaggaggattcgcgcgaggtttggagtttttaggggtcgcgggggatagaggggttttaagcggaggcggggaaggcggtagaagtttaggatcgttaagagttggcgaggaagttcggggttcgttgtcgggggagtcgggtaggggtcgcgtttcggattaggacggaggtttggggaaggcggatttggtcgtcggagacgcggtgcgggtggagacgagggatttggattttcgcgggcggttgtacggatttttacgcgcggtttacgtgggttttagggggttgttcggtattcggggtcgcgtcgtttttttttcgtcggtatcgattcgtagttttacgtttacgcggcggcgttcgtagtttttttcggttcggttttcgcgcgtgttttcgagcgcgttttcgggattagttttcggaagtagagaggttaggtcgggaaggatgggcgacgggggtggttgattcgggagtacggtagggaggatatttagttaggttcgcgagtagcgtcgttttttttttttaggacgggcgggaatttgcgatgttttcgtcgcgtgggtcgtggggcggttttcgaggtattgggcggggtacgcggtgggcgttttacggaattcgtattttttagttttcgtaatttaggaggaagtttacggcgttttgtatcggcgtcggcgcgttaacgcgtttttggaggagttgcggtcgggttttttggagagggagtgtaaggaggagtagtgttttttcgaggaggttcgggagatttttaaggacgcggagaggacggtgagtttagtttcggggcgtttcgcgtcgcggatattgtaggcggcggtgaattaggtcgcgtggggtcgtttgcgtttttttggttgcggttgtgggcggcgaatacgtagcggcgttcgcgcggcgttttttgcgggggtcgtttttcgttcggggtgatttcgtttttttgggcgatgttttttatttttaggtacgcgtttttttcgtgcggtcgtatcgcgtatgtcggtttttatattagaaaatacgatttgtaaagtatatttagggtgttttttttaattttttaagggagtttttttagttttcgaagggtttagggtagtttgcgtatcgtagacgcgcgcggttcgtagaagggacg

SEQ ID NO: 6513 - DNA, 2490 bp, synthetic construct
  misc_feature 1..2490: note = Description of Artificial Sequence: Synthetic polynucleotide
  source 1..2490: mol_type = other DNA
gcgtttttttttcgttcgaggtttatttagcgttagcgttcggtttttttgtagcgattgggttttaatgtcgtacgaggggttttcgcgaaggttaatggtattatttttttagttttttttttatttttattttttatttttttaggttgtggggggttaggggtcgaggttcgcgcggcgcgtattttttaggcgtatttttatcgttaggtatttttggaagcggtagaagggatagcgtttgcgttgcgttttgtcgattttgtagttttggttttcggtgtacgtgtagtgtttgttgttttgtatcgtgcgtttgaagaagttttgcgggagttgagagttagcgaggtttcgtagcgttcgtttgtcgtatttttgtcgcgcgttcgtcgtttattttgtagtttttatacgtgagtagttcgtagtggtagtcggatattttgttttcgtatacggggtatagttcgtttaggttttcgtcgtacgaatagtttatgttcgcggcgttcgtttgcggagggatagcgggttagggagggtcggcggagatcggtagtttggggttttcgcggtcgtcgttttagtcgttgtcgtcggttcgtcgcgtaattttttttttgtgtttaggcgttgtcgtcggtatttatcgagcgtttcgcgtagcgtttcggggtgggttcggtgtagttttcgcgttcggtttttttttgttaggttttacgttttcgtttcgttcggggggtttttttcgcgcggatttcgtcgcgttcgatttggggttttcgggttcgatgcgtttcgattgggattcgtttgtttgagaataaaatttcgattttgagaaaaagagatgggtttagtcgcggggaagacgttaggggatttaggagcgttggggcgttcggttcgggtgttttgggaattcgatagagacgaaggaggtagagatagagttcgggggagttagagatgggaagaaattttggcgagagataacgatcgacgttatcgggcgtagatacgaggttagttcgagagtgttagagatatagatattgagacgtttagttagagagaattcggcggggacgagatatagggagggatggagagagatagggagatagagagagagagagagagagagagagacgagagagagagagagagagagaaacgaggggtgggggattggattagagattcggagagatagcggaggttcgaagagaaaatttaagagagattgacgtagagttagagatataacgatagacgatagatagagacgtcgagacgagaggagtttcggagagacgaggtcggggagttatagaaatacggagagaaaatttggaggcggaagcgtttagttcgagggtcggggataggggacgcgcggaaatttgtcgggtaggagtttaagcgttaaggcgaggtttcgtagggtcggatttagacgggggttcgggtcgtaggaggcggaaaacgacggcgtcgggatcgagagttcgaaaacgtagagtcgtcgggatttttttttcgggggagataaagtcgtagtagcgacggtaacgggaggcgtagttcgagtcgtcgttgttatcgggacgtcgggcggggagatttcgggcgggggtcggcgggtttcgggaagtcgagttcgaggcgagggagcgatttcgggcggagaggcgaagttcggaggagggaagcgcgaagagttagggttcgggacgcgagagggggcgcgacggcggttgcggtcggttcggcgtttatttggtcgtttttgcgagtagcgtttcgcgtttcgttcgcgcggagttcgtatttttcggtcgcgtcgtcgtcgtcggcgaggagtcgtattcgggcgtagcgtcgttcgttcgcgatgacggtcgttcgggtcggggacggggaggcgggggcgcggggttggcggcgcgggggtttcggtttttttttttcgttttttcgttttttattttgtttttttgttttttttcgtatcgtcgtcggggtcgtttcgaggcgtatttgggattcgggttttttagtcgttatttcgttttgcgttaattcgtcgcgttggggtcgggggtcggtttttttatatcggcgcgtgcggtattcgggggcggaggttcggtcgtgttttttttttaagttcggttcgcgtcggtatttttttcgtagtttagttcgagttttcgtttttattttttaggttttttagtcgtagttcggtttttcggatttcgagcgcggttagagagttgcggagttcgagtgtttcgcgatttgggtaggtatagggtagtgggggttttgggttattcgtttgtagtgggaggaggtagtttttgtttgtgaatttagttgggtcgtggcgaatgttacgcgggtggttggtcgtattatagcgtggaagtgggtaagggcgagtggcgatcgtggtcgaggttcggatttacg

SEQ ID NO: 6514 - DNA, 5370 bp, synthetic construct
  misc_feature 1..5370: note = Description of Artificial Sequence: Synthetic polynucleotide
  source 1..5370: mol_type = other DNA
tcgtgttcgagggaggcgggtagcgtagaggagagggtgtaaggttttaagaagaggagcggggggattagggcggggtttaatggagttggggcgttcgtagattggaaggagtcgggattttcgttttagagtttttttttttattttcgttttttttagtgatttcgagttttcgatttagttttttttttaggtagagagaattcgaggttgtttttgtcgttgaaatttgagcgggagagtatttcgaagtcgtttgcgtggagcgagtagttttcgcgttatgggttagaggcgttcgggagaatttgcgggttacggattatattcgtaggggtttggcggagtaaggtgtcgttcgtcgtttgcgggtaggagtcggttttgggtttcggtttttgttgtgtcgtttagtcggtcgttttttcgttttttcggtaagggaagcggtggagaggcgcgggagtttcgattgtgttggagagatttgggatttttgcgcgtttgcgtgcgaaggattcgagatcggttaatttagttgggagtacgggatacgaggagtgaggataaagggtaaggaacggggtttatagggagggtgtgtgtgtgtgtgtgtgtgtgtgtgtgtgtgtgtgtgtgtgtgtgtgtgtgtgtgtgtgtagggggaatgaatggatagcggggaaggtatgtagaggggtttaaggggtgtggatttagtagttttattttagattagagaaggtagttaggttttggcgtttatcgagttagcgtttttatttgggcgcgggtcgtatggcggtagattattttatattcgttttggtggcgtgggatatgattggtaggagcgcggaagaggcgttgagaatgtatgcgtattcggatagattagacgcggtacggagggggtattttttataagtttttttgttttgagattaggttttcgagtggttcggggaatgcgtttttgggtatagttagcggttttagatcggtattggacgttaattcgagttagagaagtttgggagattggatcgtaggggtttttatttagttaaggagggggaaaggagagttgtagggtaggagaggttaggtatagggaaggtggggaggggatggagttttgcgttaggagttgggggtgtagggtttgtgacgagagagtattattatgtgtattttgaaggagagggagagggtttgggtttggaacgaggattttcgtttgtaggtagtcgtttagtttcggttgtagggatggatcgcgattagtagagggtagaaagtgtttggttcgttcgtcggtttcgagtcgcgtttcgcgtttcgggattttggttttgtgcgtcgaagttttgttcgttcggtttttttttgtagtagtcgcgttttcgttttagatgttcggagaaggcggtttaggtttagtttaatttcgcgggtttaggtttggggtttttaggttaagtaaagaggggatcgagatgtgggagagaaattttatattgattgtttatttttttcgatttagttatataaaggcgtttagaaatatacgaaggtataaagttttttattatatataaatatatatatatatatatatgttaggagatacgcgagtatatagaagtatttagaatttcggagataagtatagatacgtaaagttgatagagatatttatatagaaaaggatcgtagatataatatagaggttgagatacgtataaagatttaggttttcgtatgaaatgatgcggatatatattttagatataggtacgaaggatttatatatttatatatatacgggtgtaggggatttagatatagatttatagatttatttttgggagtttggaaggttgtagggatatatatatcgtgtgtgtagagttaaggagtatacggaggtaagagtcgtagaggcgggggttcgatacgtatagatatatatagatatttatcgatatatacgtaggtagggtagggcgggagtttttaattttttataaagtcgggttttttcgcggggtttcgcggcgtagggggttatttttgattaagtttttcgtaggttttaaattcgattcgttttttcgtttttagcgaggttaggggattcgttttttatgtttttcgttttcgttcggtttcgcgtcgttgtttcgtttcgggaggggtcggggtcgtttcgtagcggatcgcggggggttagttcgtcgttatttcgggtcgtaatcgtttttttgtttttcggtgagtcgcgcgtcggtggggattacgggtcgtagatagtcggttcgacgttgtggtttttcgtatcggacgcgggtgttaggttcggttggcgcggaagtcggtagttttatttcgttagttttcgcgtttcgttgtcgaggtttattttgtttaggttggttagagtattgtttttgattcgcgcgttttagcgatttttggtcgggtattcgattcgttaaaggatttcgattttggtagttaatttaatttttttagagtcgttattttggggttattatttttttttagcgttttttattgtaaattttaggaggttcgggttttgtttattgtttttgtttttgttcggggattttttttttagttttagttgttttttaaattttcggtcgtttgaatttaggtttgattttttttgtcgttttagtgttttttattttcgatttcggggttttaattttttatcggtttagtttttcgtttaatttttgttaggttcggagtttttttagattttttatttatattttaggtttatttttcgtttttgggtttgggttttttttgtacgagtttagggttagtcgttttcgttttttgttcgttttcgtttttcgtttttgggagtcggtttttttcgcggattaagcggtttcgagtaggcgtcgtcgttcgggggatttcgatttagttttcgcgatttatttcggtcgatagtcgggggtttttaagcggttattttcggtcggcgtcgttttttggcggagtcgtcgcgttttttgtcgttcgcgtagtttggtttcgttcggggttatttttcgtagcgttggagttttataaaatattaataataaagaaggtagaggagaaaaaagaaagttttcgttttttaatttttaaattaattttttaagggggtggagtagagggatttgtttcgaagacgattaaaatttttgcgaggggttcgcggggcggtcgggtcggggagtcggggtttgagttcggggttaggcgcggcgcggggcgcgggttaggggcgcggagtttcggggcgcgcgggggggcgggacggtattatttgacgtggagtcggcggcgtatttcggcgtagggatatcggtcgcggggtttaaatgttaggaagtttcgggaggtgaggcggttcgtattttttcgtcgttagttttagttttaaattcggcggtttagcgggcgtattatggtattggagtagcgcggggagcgcgttcggagtttcgcggttcgttgcgtttcgttcgggatttcgttgcgtcgcgcgtttttttcgcggttcgcggggtcgtttttgtatttttattttttttttcgtttgtcgtcgtcgttatcgttatcgtcgtcgtcgtttttttttcgcggtttcgtttgtagtagtcgtcgtcgtcgggtttcgggattgataagtaggtgatagaggagtcggcgcgcgtggttgtaagtgttcgggagagcgcggcgcgggttgtagtcgtttcggttcgttcgtacgacgtcggggttcggggttagcgcgtcgtcgttttacgatcgtcgggggtcggcgtaatttttgttttgcgggggtcgcgttttttcggttttagggtcgcggtggcggagagcgggtggacgggtcggcgggcgagtagttcggtcggcggggttcgtagcgcgtttcgcgttttatggatatagtaataggtttcgagtcgttggagaggtgtttttttcgcgggtagacggattgcgttaagatgttggacggtattaagatggaggagtacgttttgcgtttcgggttcgttattttgggggtgttgttgggtgagtgcggggtcggaacgttcgagtggtttcgggcgtgggatggggcgtcgttcggttgtggatacgggcgttggggttaacggataaaggaaatgggtttgtaggatatggggaggaggtagagataggatttttggagtgatcgttagagggtcgtaagtacgttttcggtaggcgttttgaggggataggatagttttagtcgttatttattattttttttaggtttaggttttagagttgttatttcgatgtggtaggtggcgggtggtaggggtgatggaggatttagtaattattttggcgagtttgggagaggcgtaaggttatttggggtgggggagattttaagagaaaaacgtttttttggttatttaaattatagattttggggagatcggggatagaagattacgaacgttatcgtggggcgtgttagttagcgagcgttttagttttatttcgtttgttttggttttagtcggttattttgcgtcgtgttcgttgttatttgttttaatacggagcgcggatttttcggagaaggggagagtatagcgtcgagttaaggttcgaggttcgcggtttttttacgtcggagttcgaggattgggacggattagtcggggtcgttcggtttttggcgcggcggttcggggagcgtaggcggtaggcggtgatttcgggcggttcgagttttcggggtcgagggttgtgggttcggtgcgatcgggacgtcggggttgggtcgggcggcgttgacggtcgggttttcgttttgtgcgttataggtttcgattgttcgtatttcgtcgtttgcgagggttgttagcggtttattttcgatcgttttttgatgcgagttaacgagtcgttttggtacgaggagtgtttgtagtgcgcggcgtgttagtaagtttttattattagttgttattttcgggatcggaaattgtattgtaaataagattattaatagtaagcgtttttcgtttttttttttcgttatcgttcggtattcgagttcggttagttttttgtcgggttcggttcgcgttcgttttgtcgtcggttttgtgcgcggttgggtcgggtagttttaagggtttcgagagttgcgcgttttggggttggggcggattagtttagtttagcgggtattgatggggttttgggagttttcggacggtttttagttgttattcgttgtttcggaattttgcgttgggtcggtcg

SEQ ID NO: 6515 - DNA, 3120 bp, synthetic construct
  misc_feature 1..3120: note = Description of Artificial Sequence: Synthetic polynucleotide
  source 1..3120: mol_type = other DNA
gcgggagagtttttttcgacgttcggatacgcggatggggcggtttttagcggtttttattcgcgtatttttttaggtttatttttcggcggttcgtgtagtatgttttttattgggagtgggatgatattatgtataggtttttgggtttcgtagtcgagtcgcgggtattagcggcggttgatgaatttcggtgttattaggggtttagttcggatttgggaatcgcgcgttttaatacgcgtatacggttttgttttttttaaagcgtagtttttttatttagtagttgatttatggaggaattcgattttgggacgcgttaggttgaagttcggagtttagggttttgtagtagttttcgggttttttagcgtttcggggatttttggtggttcgggggtttttttgggttggggtcggggtgtttcgttaggtggggttttacgcggtttagaaagagttagtgattttttttggagttattgtaggttttcgttggagggagtaagattggcggggagagttggtatttttattttttgttgagtatagttttcgtttttttttaagtttttttgtcgattttttcgggttggttaaaagtagtaagttcgggaggtttgtttattgagagaatagaaaattaggggttgcgggggagaatttaagatttttttttcgtttgagaaacgtgcgaagttttttagtttttggaggtaattaggcggttcgaaagtcgagttttcggcgcggatgttagggtcgattttagtttttttttttttgcgttttagttcgagggcggcgagtggtaggtttttttttattttgtttttttttttttggatttggtttgtaggggggaaatgtggttgtattaatttataaatatttatttttaatagatttgtatttgtggagatttcgaataaagatagtttagggggattataaaaattttaaatttcgtttttttttcggatttggtgttttaaatgttaattataggcgagttatatttaatagtaacggggaaaggcgagtaggtttcggggagggaggtggggggagagttcggttattaaatgtaattttttattatgaaaaggatttcgtcggttttattttttaataagattatgttacgaatataagtatttaggatggtgttgagtgatagggttttgtcgtttaattagaggttgtgtcgtttaaatcgcggggttttttgttttacggagtgaacgacggaaatttgttattttaatttttttatttatgttaagtatagaaaagaagtcgagtattttataatcgtgttttttttatttttttcgaggacggcgggaagagggggtttcggttttgtagttttttgacgtttttcgttttcgagcgcgtttgggttttaggagtcggagcgttgtcgtgggggcgggggaaggggtggttttgcgggtgttttaattggtagcgtttggaaaatggggatagtgattttacgattagaggatgaatggggggagggttagtgggatgtgtttgttttttttgatcgagagtacgggttttgttttgttttttttttttaggaaaggtggtatttcgggtgtatatttattatttttattaaagcgggattgattagaagagagaggtcgaatggagatgttaggttggggttttcggcggggtagatttcgttggatttttgggattaatgtcgtagcgttcgtatttttgtaggtttttagggttggttattttcggttgtatgttcggtttttttttttcgagggtgaatttttttgttttatttttacggaaattttttttttcgttaggttcgtggcgtttttttcgttattttcgtcgtcgtcgtcgttattttcgttttatcgtttgtagggtttttttgcggcgttttggtcgtagagatttagttttgtttgtcgattggtttttcgacgtcgtcgtcgtgtttgagtttcgttgtttgttcggataagtagaatttcggtaggcgtagcgggcgtcgaggtttgggttttagtcgtggcgttcgtttcggcgtagtggggagtcgcgggcgtcggagaagcggtcgcgttgtttcgggttattgtatcggttgaaaaaattaaaagtaaaattaatatttagaaacgaagtttgcgtgttttcgggggtttcgttttgttttttttatggatatgggggtggggagttcgtggggttttagtttaaaggttttagttagtggaatcggagggggatttcggaggaatttgtttttgatgtttcggttttttggttttttattagaattcgtagaggattcgttttggagttttcgtgcgttttggtagaggtcggggacgttagagtgtacgtagttttttgcgcgtcgagtttaggtttcgggcgtagggaggatcgggttgagagtagggtgttatttcgtaaaagcgataggtaaggattgttttatggggagggagaaggagtaggaagtgatgtttttatttttgatagtatagggatcgggagtttcgatggaggaaatttttttcgggtaggacgagtagagggataggatatggtcggggattatgggattcgttgttattaagtatgggacgggtaggcgagagcggggaaggggatcgatggagttagaagttttgagtttatttttcgttcgtttttttttggagttttttttgtaatttcggtttagtcggtaatcggtttttttttttaggttaggggtgggggagagattttttttttcgaaatatttgatattaattttgtttttttggtaagaaaaataagttttgtttggaaaggggtgggtggggggcgtcgagcgagcgagggaaggagtaaggaggcggcggcggagtaaattttgcggattaggttttagcgttttcgttttatttttagtttcgcggcggtgatttgtgtgcgggggtttgtgattttgtaagtattaaacggttcgcgggaatcggtcgagtttagagggatagtgggtcgaagggcggtttaagataacgtagatggtttttattagttcggtcgggttcgtagcgttcgtcggttcgttcg

SEQ ID NO: 6516 - DNA, 3120 bp, synthetic construct; identical to SEQ ID NO: 6515
  misc_feature 1..3120: note = Description of Artificial Sequence: Synthetic polynucleotide
  source 1..3120: mol_type = other DNA

SEQ ID NO: 6517 - DNA, 7861 bp, synthetic construct
  misc_feature 1..7861: note = Description of Artificial Sequence: Synthetic polynucleotide
  source 1..7861: mol_type = other DNA
tcgttttttcggaagtcgtgtttttttttttttgttttttttattttcgagtttttgtatttttgcgttttcgattcggttttttatttgttttttttatttcggtatcgttttgttttagtttttttcgatttttgtttcgttttttttgtttttagaagtttgcgtttttgttttttttatcgttcggttttttggtgttttcggcgtttttttcgtcgttttcgtcgttttgattagtttgggttgtggcgttggtatcgttggtttggggatcggggtgtgggcgatggaagggggttcgagaggcgtaggggaggggttttttttttttcgtttttgggcgtttggggagattcgcgtgttagttatttgtcggtcggggcgtcgatttcgcgtttacgtattttacgtgggcgtttcggggcgcgtttttgtttttttcgagttttgaaagttaattatattgggaggggataggggtggggtgggagagggggtcgttgtttttatttattgagtcgaggtcgttatttcgtcggtagtttcgcgtaggtttggtttcgagttacgtttgttgaaatcgtttttttcggtttcgtttttattcgttttggtagttagtcgcgtttttgtacgcgtcggcgggggcgttttggaattttgaatcgttttacggggaacgggggtggggggaggggagcggcgcgggttttacgcgaggaaggaattttttgggttattgcgaaagattgaggtttagaaagttagagagagacgtgcgaggaggaagcggagagggtgtgcgaagttggagagggagtcggagcgttagcgaaagaggggagcgttggggaaggaggaagagaaggagagggggagaagagagacgcggatgttgggcgcgcgacggtagcgggcggaggaggggagcggtcgggaatttgcgcgtaggggaagttaggacggagcgtagtatcggtaggggagggttgtcgaggggttgtgtcgaggagttcgggtgggggcggttggatcgcgggtcgcgggatttatagatagtgcgaggcggcgcgggggtttttttttttatgcggggttggggcgtaggggttgggcggggcgggtgggcgtttgagcgcggcgcgggcgtatttttcgttttttttttttcgggtttatttcggtcgatcgatatttgcgcgggatttgttttcgtcgttaatatttttttaatgagttcgttaggtttaaagcgagcgcgatttgttttttagggtggattttttttcggtagatgtttcgggaggaggaggcgcgcggagttttcgggaggggggataaattttttttttcgaggggcgagaataggagatttttttttaaagtttaaaagaaagacgggtttttattcggtttttaaaaatgtatttttcggcggataatgggtttttttttgcgtttttgagggtcggcggggcgggtagggcggggattcgtgcgttttggtttcgtttgatcgattcgtatttttttttttcgtatttaggttcgggttttagagcgagggcgtaggagtcgcgaagtcggtcgttttttcgagcgtttttttgaagcgtattgtcgggatttggttttttcggagttaagtttcggcgtatcggcgagaacgaaagcgtcgtgcggggttttgggttgttttatacgttttcgtttttataggtgttttagtcgggtcgaagggacgcgcgttggtgttttaaggggaggacgaacggattttcgggtttgggtcgcggttttttttttttcggcgtttcgttttgagcggggtaataattagaaattagttaatttcgggcggttgtcgggttttgagattgttttgttcgtttcggtttagttattttttcgggtcgtttttgttttttttttttattttttttttaatgttttttcgtggggtcgtcggtttgtcgcggcggttttttttttattttcgtgggtttaggggaagagggtattcgggcggcgaggatgattttcgaagagtcgcggtaaattgattcgtttcgttcggagtcggggtcgcgtgaatgggggttcgggcggcggcggtagcggagaagaggataaagatgttttttttgaaagggggagggggcgcggagcgggaagcggggttatttatttttggttcggtttttcgggaagtcgcgtcgaagaaagggggtcgaggtttatttaagttttacgagtcgtttataatggatcgatatattgagggtttttttattaacgtttatgaatattaaagagatcgttaagtggcggttagcgggcgaggggggcgacggagtttgagagtttcggttcggtcgaggggagggggtttttgcgcgagtatatttcgcgtttgggtttcgcggaaaatgataaaataatacgggttattcgttgggaaagttcggaatgttttttttcgaaattttttttcggggagatgtgagtatagggttttgttttttattttaatgtattttgagattgggcgttatttacgggttttttttttttcgggcgggggtttaggtgggttttgtcgttagattagaagtataaaatgtgagcgcggtggagatttgggcgtattagttgggaggacgttttgcgtttcgtttttgttcggtttttagtattgtttttcgggtttgcgggttcggaggagaggaatgggattttttggtcgtagttcgagttcgtggttattgcgttagcggaatttaagtttttaattttaagtcggggtttaggatttaaacgttgtattttagtacggaggatgtatagatttgagggtttttcgtagtgggacgtggttttggagagggtaaaattttcggggttgtcgtggggtaaagtgattttatttaaagagagattaagtaaagaaattttagtttataaagtttaatttaaattattgtatagatagggatatcgaggtttagagaggaaaggggtagtttataggatatatagtagtttttatttttttttggtgttttggaggaattgaggtcgttttcggggtttgggagttgtcgtagcgtttggtttttggtagcgtttttcgacgtcgtttttttcgtttttagtattttgttttttttatttaggtttttttagaagttaagaagtaggtttcggtgaggtttttttgtaggagttatcggattttatacgtttttttagattcgagttttggttagggagtcgatgcgatttataagttgcgtcgaaaaatgagtggagggttcggcgattttaatttatttttttttttagtagcgttgttttttgttggcgttttgtttaacggttttgttttttgttaggtgtgtttttttttgggttttagtttcgggcggattcggacgtagggtttgaaggttagttatcgtcgtttttttttttttgcgttttaacggggacgggggatgtcggagattattggtaggaattggggattaggggtttggagtttggacgttaggtgtgagatttttttagttaaggcgcgttcgggtggtggaggggcgtttatgttaataggcgtttggatagggtttcgtttatgggaggttagttcgttgtttttttatttaagtttttcgcgttgaggagaaggtttagggagtttatatagtttagcggagattaattcgtgagtttgatttacgtcgagagggtttaggtatttttgttagcggtatttgaaattgtaggttggtgatgggagttagaagtgcggtaggtggggtgagtttttttatttagtatgttagggtttggggttcgaggtttgaggttgatattggggagtcgcgaagtttgtaggaagcggggtttttcgttgggtttagtagttatttgtttcgggagaggggatcgttgggtttcgaggtgtttcgaaatcgtcgtaaagtaagtttgtttttgggatgatgggtaggaggaatagaggagaggaagggaaagaagagagaggtagaggagaaagaaagaattaggaggtaagaaggaaggggcgtcgtaacgttatcggtttttcgaggttgtagtttagtaaggagtcggaaagtcgggtcgtaagtcgaattcgtattgaggtttttcgcggagttgtttgtagtttttgagggatttcgtttttaggtacgtttgtttttatttaggaagggtttcgggattttttttaatttttttatatttcgtaggaaattttttttttagagataggttgttagggcgatttttgttcgtttatttcgattttcgatttggtttcgtaagggtcgggagtttggttttttatgaagttgttttaggtcgggattagttttagtttcgacggtcgttgcggtttcgtttcggtagtttcgtgagttcgcggaggagtttcgtattcgatcgtgtatagcgatcgagttggcgcggttcgtatgaagcgaagcgtcggttttagtagcgtagtttgagtaggggattcgcgtggtaattagggttgcgcgcgagttcggggcgattgtggcggttcggggagtgtagggtcggagagggaagaggacgcgggttttggtcggggagggagagcggtgtagggttgggtcggttagtcggggtagtaaagtaaaggtgaacgtcgggttgggttaggtcggtgaatatagattaggtttgaggggagcgcggggttcgaagttaggcgtttttttttgtttagtttggtttttggagttttagagagtttcgtcgtatttttttttttttttcgtttttttttttttttagagtcggttgagtttttttttttgttttgcgttttttacggggagagaaggaaaaataggaggggggaggaaggattaggaaggggagagaggagtggaggggtattgtttggagcggttcgcgcgttttcgtttttcgcgttttcgcgacgaaggtttttcgagtttagtcgggtataataagtttgtttttcgacgttagggggttattaataattaattaggagggttattgcggtttttataaaggcgttgagattttgttaaggggaagacggtttcggtcgagtgtgcgagaggttagcgcgcgtttgagttttttgttgtcgtttttttgtaattattcgttttttatttattttgtatttttcgtattcgttttcgtttttattcgcgtttttttatttttcgcgtcgtttttgttatttttatagattttattatttttttttttttttttttttcgttcgttttttttttagtcgtttttttatttttcgtttttttttgcgtttttttttttttcgttttttttttgttttggttttttttttatcgtagcgtttttttttcgttttttgggtttttttttcgttcgtttatttttttcgtcggttcggtcgtttttcggcgtcggggagtttcgggtcgtttatgatgggtttcgtgttttcggttgaggttttggtgtttaagatcgggttgaaggcgtcgggattggcgttggtcgaggttattattttcgatattttgtatagttttttgtacggtcgttggcgtaacgtgttcggggagtagtttttcgaggataagagttattacgttagttttaagatagtttttatcgtcgaggtgttggcgtagttttttttcggcggtgagtttagtcgtcggagttcggcgtaattttttttttcggcgatttttattttcgttttggcgatgcgcgagacgcggttgggatattcggtttcgttgttattcgcgttaatttgggttttttcggcgttcggtgtattttagtttttttatgggttaaattaggacgcgagttattaagtagtttcgtagtttattcggtttaaggatcgatttcggcgatttcgtcgttcggtttcgacgttttcgtcggttttttttttttttttttgcgtttgagttggcgggttttcggtatttatagttttattaggcgtgtaatagtagttgatttaaaaagaaggggttttaaatttatttagttaatttgggtttgatttacgaaagtttttatttaaattaagaattttaaaaggtagtcggggttggggagggggtggagggagggcgggcggggagaaaaagtcgcggggagagcgagggagagaaagagagagcgagaaaagttttttttttttaagatgttttaagtttttattttttatttattaattcgtaaataatatttttttttggttttggtatttttgcgcgtcgtttttttttttttttttacgatttttgttttttttttaatttatcgtgaagattaattttatttttatttacgttatgttaattatttaattttttttttttgtaaggggaatttttcggttttttttaaataagtttttttcgtattgagttataatttattgttatagtatttttttagggttaatgaatttagaattagtaatttttttcgaatggagtcgaatgaatgcgattattttaatagcgtgataaattgttcgtcgcgtcgtaatggatatcgtttaattttttttttttagtcggttcgttcgtcgggtatttttttaggtagtttagaggggaattttgtaagatatggaggtcgtttttgtgcgtttcgtcgtttttagttttgtcgtagatgttcgataggggaattttcggggagttgggggtcgtcgcggttttttttcgtttagagagatgatatcggggtttgtttgagttcgggcgtcgttttttttggtattttagggtttgggagtagagagggattcgggcgcgttcggggttatatagcgagcgtagagtttggttagttgttgtcggtgtttttttggtatttttaatatttgttagttcgaggtttgtttttagcgttgattacggttcggtttttttgttagtgtttagagtttggatatatagtgggttttcggaagtcgattaggcgaaagagttttcggttggtttttatttttttgtaggatttggttttagtttttttgtgtataaaatcgttcgttgtcgttggtttattaatttttaaatttattcggggtagaggatggaagaagttgcgaatgttttgagaattcgcggagagattaaaaatttatttttaaaaatgatttttaacgtattattcgttttttagggtacggagggtttttaggttgtaaatagaggagaggtcgttgagttttcgtatattcgattttttttatattcgggtggtttttttggatttggggtcgatttgggtttggttggtttgggtaggatcgaagtcggggtttcggcggggaaggaagggtcgggtttcggttgtttcgggttttgatcggtttttttggtttcgtcgtcgtagaagtgtagaagttgtttagtttggtgttgtttgcggaggtgattatcgtttagagttttatttttggcgagggtttcggtattttttttaagacgtggattaaggcgggaatcgagatgggtttttttatcggtcgcgtgatcgtttcggagtacgtggatatttgtaagaataataattttatgtgggaggtacgcgcgggttggggtagaggggcgtaagggtcggcgaggggcgttggtcgcgggtaggattcgggcgttcggtcgtcgtcgtttttattcgggttgagagcggcggatatttttggtttggacgttttttgagtcgggattttaagtcgttcgagtttggagtttatttcgtttttaggttttttttaattcgtgtcgaaaattcg

SEQ ID NO: 6518 - DNA, 1434 bp, synthetic construct
  misc_feature 1..1434: note = Description of Artificial Sequence: Synthetic polynucleotide
  source 1..1434: mol_type = other DNA
tcgggtgtgcgtttttttagggtttttattgcgtatcgcgggttacggtagattattttagttttcgttttgttgtgtaggtgttaggagtgtcggttggtttttttttttttaagtaaggttttagggtatcgcggttgttttgggatcgtaggggcgtttttagttttttatcgatgtttcgacgtttttttggcgttggaggttttcgcgagtttggttgtttttcggagtttgttttgtttgttgggttttaggcgacggtttaggttggttgggattttcgaattatcgcggaaaagggttttagtaggtaggacggcgtcgtttttttgtcggtaatttttgttttaaagcggattttttgcggggatcggagagggatgtttcggcgtgaggatgggagaagtttcgggacgggagggtcgcgggtcgtgtttttagttggagttttcgcgtcgtcgtcgggtattttatgatttgggggtggtggtgtgttcgtttttttatgttattttgattttaatttttgggcggattggagtttgtagatttcgttgttagtagttagggggcggcggggagtcgagcgagaggaaaaatttatttattttttgggcggattgcgtcggtttcgttcggtcgagtttcgtttttcggtcgcggttttcgcgcgtagttcgcgtagcgtttagagtcggacggcgtttttcggtggcggcggaggagttcggagggacgtagtcgggtaaggtagggcgtagggcgggcggcgcgaggcgtagggcgcggcgggtagaggttatttggttattttttttggcgttcggggaaggtgcggcgatggtcggggcgcgcggggcggcggcggcggcgggcgggcggcggcgggtcgagggggcgcggggatatagttaggcgtttttgttcgtcgcggtgttcgtcgtttgaaggtcgtttgggcgcgggagtcggtgttagttcggagcgggcgttggaggtagttcgaggcgcgatgtcggtgtcgttgtttaagatcggggtcgtgttgagtattatggttatgattattaattggatgttttagacgttgttttcgttggtgggttttaatattattaagttttcggcggtcggcggcgggacgttggatcgtagtatcggcgtaagtgcgttcgtcggtcgttttggcgcggttttttttttttttttttttttttttttttggttcggagtttcgggttgggcgggcgtcgcgcgggattcgagtcgtttagggaggcggcggggagtagggcgggtaagggtaggcgtcgcgggtcggcgtagcggtggcgattttgtttttcgtttttttagtttgggttattttattttcgttcgcgcgtttttggggcggcgtttttttcgtttgggtttttcgtcgcggggtcg

SEQ ID NO: 6519 - DNA, 5053 bp, synthetic construct
  misc_feature 1..5053: note = Description of Artificial Sequence: Synthetic polynucleotide
  source 1..5053: mol_type = other DNA
tcgcgggttttttgggatttttgcgatttcgtcgacgcgcgttcgttttttttcgagtttcgcgattttttcgtttatcggggaaggagattttagcgtcgttgttttgttttttttgaacgttgtttttgttcgatttggagtcgtcgcgggagcgttttatgttgcggaaatattgtttttagcgttgtcggtcggcgtttttttttagttttttttttttggttcggcggttttggaattaaatttgggggcggggcggggtgagcggtcgttcggttttgcgggggtttttaaggtcgcgggcgggagggaagtaggggcgagcgttgatttgtattacgcgtatgtttaggttcgtttcggacgagagttgttcgcgtacgtggcgcgtcggtttgggcgaggtgttgtaagcgttttttagcgtttttagttgtttggcggtgatggtcgtgcgcggtcgtttggtcgtggtttcggtttttgcgcggcgggcgagcggtgaggcgcggtagttttttcggtttcggtcggatttttagtttttttatttcggtcggcgcggggacgtcggggttttaggtgtttatttttatttcgttttataggtttttcggaaggcgcgggcgttgggagcgattggtaaaaacgggtagtattcgggttggggtggagggggcgtcggcggagggcgggttttgtcgcgggggcgggggcggcgttttttttaaaatcgtatttttacggcgttttcgtttttagttttggtttttttttttaagtattttgattttttcgcgggtttttttttattttaagggtgtgggtatggtttagttttcgcggttaagaatttagggcgataatttcgattaggggcgaaaagtcgtatatttcggatcgaacgaagcggttcgggacgcgggtttgttcgtgatttcgtcgttttcggtttcggttttttgttgtttatatcgttttagtttaggtttttttagtgagcgtttggggagagaattttttcggacgtttttttgggcgtggttttagttttattttttttagattaggaaaggtgggagcgtcgttttttcggttgatttcgttgtttggcggtttcgtagttcgttttgtatacgagtcggttgttttttatgaggtagaattcgtcgttcgtggttagttgtcgtttgtatacgacgtaggtaaagtagtgtaggtggtatacgaagttttgggcgcggcgtattatttgcgtgggcgggatgtttagttggtacgcggcgtatttggtttcgaagcgtttgcgggacgtatagggtcgggtttagcgcggaagcgcgaggtttatttcgtttcgagcgggttggagagaggtaagcggttgtttgggaaggcggtttcggaggaaggttttgttcggttttgtagggtggtcgttagtttggtcgtcggggtagagttgtttatttttattgagaagggaattttaattttagaaagatttcggggagtttagtcgttattgtttgtaggatttatgttggatttgggaaggtgaattcggagggagaggatttatttggggttagttttttatattttatagttggagttatgaaggttattgggttagagtcgttgggtgttagtattaggaattaaaatattattaatttcggaggaattaagtttagtagaattttataaataggggtgtattttttttaatgattgtttttgtgatttaggtaataaattgtttttttttttaaataatatttgttgatgttttagttaggtttagttatttagggagtatttatggagaggttttatttttaatttggttaggttatagggtgttttgtttgggtgataggagtgggttgggattgcgagagacgtaggtttcgagggtttggttttggtgattgtgaggggaggagtttttggggtaggcgtgtttttcgtttttatattgaggtgaggtttcggggtttatttgaaaaagtcgtttttgtagtaaacgtttttttttcggttgaagtagcgttcggttagtggcgtgtggtagtcgttgtatttgagatatttgttgtgttagtggcggtttagagttttgaggatgaagcggtttaggatgtgttggttatagttagcgtatagcgggatttttgtgggtacgaggaagttttgggttatttcgtagattaggaggtagtgaagttatttttttattttaacgcgagttagtttttttttcggtttataggatttagggttgtcgaggggtttttttttttttatatatttttttttttagttagtttaagtggtttcgtaagtttcgggagtgtgtaggtatcgtattttatgttaggagttaaggggaaattgatatcggtttaaaaatgtgtgtgagtaagaaagtagtttaggttattttacgaggttgaatatttaattataaaatgttgttagtgttaagaagggtgtatgtggagtttaaatgaaaattttattttagggggatttgttttttgaagttcggtaggaaatatagggaaacgggtttttattattatttggagttggggtattttatcgggttttttttatgttaagcgttatggttattttttttagggatttttcgtaaatgtggttgttttgtttggtggttttgtttgtaggttttcggggtaaatattaatgttttttttattattgggtagtcgtaaaattatttatgagtggattggataagtcgatttattgtttttgtgttaggcgtgggtgtttttaatatcgttagagttatttaaacgtttggtttttcgttgtttttgttttttatattttatttcggtattgtaggttttttggaggaattatattggggaggtttaagggtgttttgtgggagtttcgagtttgtgagcgggttttttaggtgttaagggttgaggattttttttttatttagaaaaagtttttggaagagaggagtgttcgttgaagggatcgggatttattgatatattgtattcgtttttttggttgtggatttcgtcggttttagtttattttttagtgggtgagagatattaggaaggggttttttcgattttcggcggaaaaaattgggttgcgtttttttacgtagtggcgggaaatcggcgatgaatgcgtttcgtattcggtaaaatcgtagtttcgggtgcggagcgtcgaggattcgttgcgcgttcggggtttttatcgtgggtagcgatcgtaggcgaggattcggttcggagcggggcggttcgataggtcgatatagcgcggatttagtatcgcggatcggatagcgtttcggtcgtagttcgtcgtcggcgttcgcgtcgggtaaaagtcgttttagtttatttcgcgtcgcgttcgcgattttagttttacgttgtatggcgattttagttttggcgggggtttttgtgttagggatggcggggtcggcggagtttggacgttagttcgttcgtttcggttagttttttcgagcgcgggcgcgtagttttttttttttttttttttttttcgttttttagttttcgcggttaattttttttaggaatcgtcgaaaaataaataaataagtagggaatcgcgagtttttatagtttggatgtaatttttttttcgtcggtcggttttttttattttttattggtttcggggtttttttttttattttgcggttttagttggttcgggagtcgaggagaattgtttaggttttttaagaattaaagtgttgggagttagagtggtgttattaggaagttggggggtttggagaagagaggtttttttttatagacgggttttgagcggggataaatcgagcgggtgtttgtgggcgtagacgttgaaatttgatttcggggagatcgacggtcggagtttagttcgattttggtttttgtatttgattttgtttcgttggaacgtggaaagagttcggttggggcggtttttttggggatttttttgtttcgtggttattgtttcgttattgttttttgcgttttttttagtttagggagttggtttcgggttgtagaggttttttaagtttattttggattttcgagagttttttggtcggagtagcgtagtgttataattttatttattttttgataatttaggttaggggttttgtaataaatataggttgaggcgtttaggcgcggacgtttcggggttttcgcgtttattttcgtttagattttttagtttttgttagttttcgcggttaggttcggaaaggtttgaggattttttggttttttcggtgtagttattcggttcgggtatttatttcggcgtaggttcgtttttcgcgttagtagtgttagtagtaggtcgtttttcgtcgattttcgggtcgggtttagtttttcgcgcgtttttatgggtttcgtcgttcggcgtcgttattttttagtttcgaattttttcgggtttagcgacgttatttcgtaatagtttcgaatcggcgtttaagcgatttcgggtgttgttgggcgttgcgttcgcgggtcgttttggggttcggagtttttggtcgagcggagggcggagcggtcggggggcggggtcgcggggcggggcggggtcgggggtcgcggagattagttcgggttattgcggattttgagcgtttttgcgtcgggatttgcggtgtttagaggtcgtttcgcgtgttcggttcgagggcgggtatcggtaagggagggtttaggttagggtttttcgttagcgttcgtttcggtttcgtagttttttgcgtcggagcggtttagaggtagaggtttgagttggagtatacgttaggagggttaaggttttcgggagaggggtcgagaaggtagtagggttttttcgtcgttgaggtttggtttcgggagtagtagatggtcggcgggagtttaattcgaaacgtagaaggggtgagtgtggcgtcgagggttgcgtatcggaatcgtaaggtgtcggatcg

SEQ ID NO: 6520 - DNA, 6343 bp, synthetic construct
  misc_feature 1..6343: note = Description of Artificial Sequence: Synthetic polynucleotide
  source 1..6343: mol_type = other DNA
tcgttttttattgtgcgcgatcggaggggtcgttttgtagtgggcgttgtgacgggggcgtagttattgacgttttttggggtaatatttataaataaggtttaaatgcggttcgtttttttaattgcggatattagagggcgtagttttaggattacgtttttatttttttattttattcggaaaggggtttattcgagtcgatttcgtcgttattagtcgggggaggggaggttttggagttttacgcgggagttttcgtcgcgggaattataattacggttaagtttttttggttcgttcgttttatcgtagggagaggacggggggacgggtaggacgggcgtttggatagttgggtttttttcgtaggtgtttttgatttcggtatggaggaagcgttcgcgttttcggtttaggttcgtagttagggttgtttcgttcgttgcgttttaggtaagtcgggttagcgtgggggagtagcggggtttgggttgcggagggggtcgttttgattcgcgtttttttttagggtaaaagtttcgtaaggtagtgtgagttggagtcgttagtttggggattttttttaagatgattcgtacggatttttcggatttgttggtgtcgatcgtgtattaggatattaaggtggcgatttcgggattcgcgtttaagtgttcgttatgtgagcgattcgtggttcggtttgttgagttcgcgttttttaataagcgttattgtcgtagtttcgattttttggaggcgttggacgggtcggttatggagattttgtcggagttatcgtcgtcggagttcgttgtgtcgcgcgttcggattcgcgaagtcgagttacgtcgtcgcgttcgttttaagagtgcgtttcgcgcgttttcgggtttgacgttcgcgttcgtttcgtcgtcggtgttgtttcgtcgagggcgggaggtttagcgtgcggcgcgggtcgaggtatcgtcgcgtcgggagttcgcgtattcggcgtttcgcgtttttgttaacgagttgtattttattaagttgtagtcgtagcggggcggtttcggtcgcgtcgcgtttttgtgcgtcgtcgcgggtcgttgcgtatcgttcgagttattcgcgggtttcgttttttacgtgcgttgtcgtttggatattaagttagacgacgtagtgttttagtacgttattcggggttcgcggttttgcgggtttatcgaggtcgcgtattgggttcgtttcgtttcgtagttttacggttttacggtgttcgggtttcgttatatggcgttgtcgcgtatttcgacgtttagcgatttatattgtgcggattttcgggcgttttattgcgacgggtttttgtttgggtttcgggattacgtcgagcgtcgtagtttgttttttattatttcgtcgggttttatttagtttttttatatagaggagttttaaggttttcggggtagttttgtagttagtttcggtttaattttcgacgtttattattttaggttttattcgttcgaggagttttcggggtttagtttaaggcgtatgggcggttattacgtaggagaggtgcgtatttttttaatttaggaatcgttttttcgtttttattatggggaggttttacgagtttacggtttgttttacgggtttcgttatgttttcgaggagtttcgggtttattttatcgttcgttttttttatacggaggatttcggaaggtatcgcgagcgtgacgttttggttcggacgtattcgtattcgcgtagtagttcggtttgggcggattggggttcgcgatcgtatcgtattttgtaagtggtgtcgttttttgatttcgattcgttgttcgttttttggtacggcggtatcggtattagttcgtttcggttggttatcgatagtcgttattattcgcgtttttgggataatattttggtttcggggtcgcgtcgagaagattcgttgggtcgcggtcgtagttacgagaatttgttggggcgcgaggtgcgggagtcgcgaggcgtgtttttcgaaggtcggcgttcgttcgtcgtcgtgaatttgtttattttttttagacgttacgtcgtattgtttttgttcgagacgtcgttgacggagaagggtcgcgcgggcgagggtttgggtcgtaattggtacgtgacgttcgagattattattattgataatgatttgcgcgttatcgagcgttcgagcgttagggtttgggagttgttcgggggtcgtacgcggttatttttttacgcggttttcgacggttttatttttggtcgttagcggagtttagagtagttggacgagtttattacggatttggttatcgattcgcgatttatcgtcggttaggttttagagttcgcggtcgattgtttgggtttttaattgcgtcgattgttggattcgcggttcgcgggtttcggggttttcgcgttggcgtcgttacgttcgtttttcgtttcggtcggtagcgtcgaggagttcgcggtttcgggagaggcggtcgacgcgtttttcgaatttagcgtcgacgaggacgatttgatgatttgttttaatgcgcgttgtcggcgtatcgagattatgtttaacgtttgtttttattttaagttttgttatagttgttatatttattattgttcgcgtttgtgtcgtcgcgaggattgggacgtttataaggcgcgttgcgtgtacggtcgcgtgggtagcgtgtgtcgttacgtattgtagttttgtcgcgatagcggttcggtgtatcgcgttttttcgcgtatcgcgcgtgtcggttttttgtcgcgcggtcgcggcgtgttttttttgggttttttaagtttaggttcggtcgataattttttgcgttttggtttggaggggttgttgttattttttatttatttatcgttgcgtgagttggttatatacgcggcgtttttgggtagttacgcgcgcgagttggcggtcgttgggcgtttttacgaatcggtagagtgttttttgtttagcgtgttcgtggtcgtgggattcggtatcgcgttatcggggatatcggttttgttcgcgttcgcgttacgtagttacgggttaatagtgcgtaagttcgttaaggtagcgttggcggtcggtagtttcgcgcggtcgttttcggcgcggagtcgcgagttcgatatggagacgttgattttgacgttatcgtcgggtacggcgggtttggattaggacggcgaggcgggtcggcgcgcgcgcgaggtggtttttatttatatttagcgcgagttgcggttgcgcggcgtttttttgcgttacgagttttcgcgcgtttacgagtagttttgcgagttcgtcgaggttaataggcgttttacgtttattattatttattttacggatcggcgtatcggtcgtttttttatgtgtatgattatggtcgttttcgagtcgcgcgcgttcgattgggtggttagcgttaatttgttggacgatattatgtgaggcgtcgggtttattaggtttagtttaggcgttggttcgaattttgttttgtttatttaggtttcgttcggtttatttagggtcgttttcgagtttcgttagggttttatttcgattttttttaggtttcgtttttaattttttagttttttaagtttcgtttagttcggtttttagtttcgtttaggtttttatttttcggtttttcgttttcgtagtgttttttataggtttttcgtttttttatttttagtaatttttttttttttttcgggtttttttttttttttagttcgttttcgaggatttttagaagaagtcggttttcgttttcggtgtttttcgttgggaggcggggtgggtttgaggatcgtcgagttttgtttttattcggaggggttattattgtatagattttattcgtagagattcggttttcgtcggttcgcggggttttcgttggagttttttcgatttcggttttttttcgtttagaagttcgacgtaattaaagtttagtttgttattttaaatacgtttcgtttcgtttttcgcggttgtgttgttttttcgttggagaatattttggtcgatttttgtgcgttcgtgtgcgcgagcgcgtttcgtcgaggcggtgggtagggcggacggtgcgtagtgcgttttcgttggtcggagttagtatattaattacgttacgcgttttgtcgttttttcgtttttagtcgttgtagtttgggttttgtaggagttgggaaaaatcgtagggaggtttttaggtcgatatgtaagttttttagtcgaaggggtaggggatttgaataggggaagtagagtatttgggtttggttagagttgatatttggttaggagaggaaggattaagggacggggcgtttttaggtgggagtttggagggtaaagcgtggtgcgagtaggtgagggagagagttagttggtaagcgtggaagtttattcgagggggtttgatttgtttcgagaggttttcgtatattcgttttggtcgtacgtcgtattgcgggcgtggaggcgtaagttcggcggttcggtttttatttgttttttaagtgtattttggttcgcgtttagagttttttggagggtggggtatgcgggagaggggtggaggttaaacgtaagggtttttttggagtttttagttttatttcggagttaggggagggggtattaagtgagagaaattgggtattttcgttttcgtttttgttttcgtattcggtacgtttatttcgttttcgcgcgtttgtatcggttaggcgtttcgtttgtttattcgtcgtcgcgtttcgcgttttttattttagggtttttgtattcggttttatttttgagggtcggtcgggaacgtttttggatcggaataatttttagggggtaagagttttcgaattaagtaaaatagaatttgaatgtagcggttgtcgttgtttttttgtatcggtagcggggttggggacggaagttttcggtcggtggagaggagaaagggagaggttttcgggcggtggacggggaagagagggagtttttcgggcggtggagggggtggagagcgaggttttcgggcggtggagagcggggaggggggaggttttcgggcggtgggagggggagagagggaggtttttgggcggtgggggttacggggagggtggttttcggattacgtgcgggataggaggttagggttggtaagttttttaggtttttttcgttgttttagtttcgcgggtcgtttaattgtttcgttttaagggtgttatcggatttcgttggagaggaattttttcgttggttggattttattattatttattttcgattttacgttttttttaagcggggttggcggagtcgtaaggcggtaaggaattggattgcgattggttagtacgtgtttcggtcggcggtataattggttgaggcgttgggttttgggaagtatttttcgacgggattggtcgtcgttttcgtagagttcgtttttcgtagtataagcggttttcgggtcgggtgggaggaggggatttcgggaggaggaatatggcggtggcggatttcgtttttatttttgatgtggatatcgatttcgacggcgtttttaagtatgtgttgattcgagtttattcggtttttcgtttcggggtttcggttgtagagagtaaggagatcgtgcgcggttataagtgggttgagtattatggtgagggcgggatttgcgggtatgttaggggtacgtttggcgaggcgggggcggggttggcgggacggagacggggttgacgaggtaggggcggggttggcggggcgggggcggggttgcgggtcgtagcggattgcgttttgtttcgagttttgtttttgttaggtttgatttaggttgaggttttgggcgggaagggcgtgatacggtttgatattttttttagtagttttttagttttcgcgtttttttcggttttattttttttcgtttatttatttttgttttagttttaaggggtttcgttttttttggggaaggggttgtttagagttgggattttagattttttcggttgggagtttttttcgcggtttttaagggcggttagggtacgttttgaggtcgtttttttattttagcggatatttacgataaagtgtcgggcgatatgtagaagtaaggttgcgattgtgagtgtttgggcggcgggcgtattttttattagagttaggataagaagatttacgtgtacggttattttatggtgagtcgtagtttcgtttcgttttgtcg

SEQ ID NO: 6521 - DNA, 1089 bp, synthetic construct
  misc_feature 1..1089: note = Description of Artificial Sequence: Synthetic polynucleotide
  source 1..1089: mol_type = other DNA
gcgggaaacgtcgttttttttggcgtttgagatttggggttttttttttatttggttttttcgttttcgttttagtttcgtgcgttttaggagggtatcgtcgagcgtcgggttttcgtagggttcgggagatttcgcggatcggaggagggataggattttcgagttttgggggcgggaagggagggtggaaggaggaggggagcggggttggggaaagttggagtttcggtatttttttttcgggttaggtcgttttcggggttttgcgttgcgtttttaagtgttgggaagatttcgcggggaaaggtttgaggacgcggtcggttggtataggtgtggcggttttagagggtcggggagaatttatggtttcgaggttgtggattagaaatgtttttgattagaagttgagaatttttggttagggaggtggggcggcggggaggggtcgttaagtcggtttagagcgcgtttatttgcgttataagggagaagaggtgtttttcgttttttttcgtttatcgtcgttacgatgcgtcgcggatttcggcgatttagttcgggtagaagcgcgcgttttttttttttagtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttcgagtcggagtcggtagaggggcgcgggcgcggacgcggcgtttggcggggttttgggaggttcggacggggttttggcgttgagttcggtcggttcggagcgcggatttagtcgtaggggcggcgatgggtatcgagggattttcgttttcggtcgtttttcgcggacgttagggttgtttgttggtatttgcgcgggtgagtgcggttttttagcg

SEQ ID NO: 6522 - DNA, 1020 bp, synthetic construct
  misc_feature 1..1020: note = Description of Artificial Sequence: Synthetic polynucleotide
  source 1..1020: mol_type = other DNA
gcgggcgtgaggtttcgttttcgtcgttttttgttcgtttttagattcgcggttcgtttggtcgttttatttggtcgatggcgttggtggtgagtataggaaggttattatagttttaatttttgaggtaatggttgaagttcggcggggcgaagtcgttgtacgaggggtcggtattggtggcgatacggttggcggcgttggttgttagggtagcgttggcgacgttgacgtcgttggtattgggaggttgtttttagttagaggtattaggggggaaggtttcgtagtggtaatgtagcgggggcgttagcgtgaagatggggttcgaggttatgtttagagttacgaagagtatcggtaggtagtagaggtcgagttgtagttgttggtcgtcgtttagcgtttttatttgggcgagtagcgttttaaagttgagggggtttgggggtacggttagcgataggttgttgtttagttcgtcgtcgttcgcgtttttttttttttttcgttcgcgttttcgtttattttgtagttgtttcgtgggtatcgtattttcgagggtttcgatttgttgttggggggtagggggtggtaggagaagggtgaagcggaggaaatcgtagagtaagggtagggggtaggtgggagggagggttaggaaggtagttaggggcgagggatgcgtaggaggaaaatgttagacgtttcgcgggggcgggggtgttgggagaggatggcgtcgttatttggggttcgggtatttatttcgttggaggtgggggtgatttttatagtgttgtcgattttgtcgtcgttttcgttattgggttcgggggtttcggtggttattcggggagttagtttgtcgatcgtaggggttttgtcggttcgcgtcgaaaggatgcgttgttttttggtttagttgcgcgtcggttgttcggatatagatagttcgaagagatttcgttttgtagttttgtagtcgcgggcgtttttttggtttttgcgatttttgcg

SEQ ID NO: 6523 - DNA, 6343 bp, synthetic construct; identical to SEQ ID NO: 6520
  misc_feature 1..6343: note = Description of Artificial Sequence: Synthetic polynucleotide
  source 1..6343: mol_type = other DNA

SEQ ID NO: 6524 - DNA, 1109 bp, synthetic construct
  misc_feature 1..1109: note = Description of Artificial Sequence: Synthetic polynucleotide
  source 1..1109: mol_type = other DNA
gcgaagttatagtcgtatagttaggggttttcgtttagacgtagggagcgtagcgcgggtagcgcggttagggcggttacgttgaggttgcgtaggttgttgtcgttgagttttagtatttgtagcgattttagggtttcgaaggcgttttcgtgtacgtttattaggttgttgttagttaggttaagttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgtcgcggcggcgtaggttggggttcgggggcgtatggtcggggggttcgcgtcggtcgcggcgagaaggaagcggttttcggagcgagttttggcgcgggacggcgcggtgaggtattggttgtcgggcgcggggagttagagggcggttcgggcggggagggcgtgcgttcgggcgtgcgggggcgatggagcgcggcgcggacggattggggagtcgggatagtagggatggagaggggaggggcggggagggaggggcgagggatttattaaagggtttattcggataggaaattaattcgttagaaaaattttttgggagaggcgggagcggtaggggtggtcgagtggtcgtcgttaaaacgcggttttattttggtagttgattttcgagatttggtagtaagacgtcgcgcgtatcgggcgggttgtattcgacgtttaagtttagttattaagtttaggagcggtttttttaaggcgtgtttcgggcgtgcgttttgttttttcgcgttcgtttggtgttaaagtacgttttttgtacgttattttatgtcg

SEQ ID NO: 6525 - DNA, 1109 bp, synthetic construct; identical to SEQ ID NO: 6524
  misc_feature 1..1109: note = Description of Artificial Sequence: Synthetic polynucleotide
  source 1..1109: mol_type = other DNA

SEQ ID NO: 6526 - DNA, 1384 bp, synthetic construct
  misc_feature 1..1384: note = Description of Artificial Sequence: Synthetic polynucleotide
  source 1..1384: mol_type = other DNA
gcgggagtattagcggtttacgtcgaggaagataggcgtttttttttggggtgggtagcgtaggtttggtttgcgggtggggggtggagagtgagaggtacgcggggtattagtttagtttttttttggggatttcgtattcgtagtttaaggaatcggtggagtacgaattttatttttgagttggcgtaagcgttttttttttatggagatttatttcggtttttttttgaggttttttttttaagtattttttttttcgagtatttagtatttttttaattttagtacggttcggggtattagttttttagggcgggggttgttttatcgtttaagggaggggatagagggtcggtttcggtttaggcgatttttgtttttcgttaggggcgttattttggttttttttcgattgtcgttcgtcgttttcgttttttcggggggtgtgttttcgaagtacgggggcgcgggaggttaagggtgtttttagttttcgatcgagattttttttcgagtcggcggcgaatggtaggttttatttaaagagtgtttggtggcgcgcggtgttttttttggagtagttttcggcgttcgttcgtcggggtttcggcgatcgttgttttttttttttttttttttttttttttttttttttcgtttttttttttcgtcgtttcgttatcgtcgcggttagggttggaggcgtcgttgttatttttgtgtcggaggaatcggcgttgtcggtgtttgggggtcggggcgcgggcgaagtcgggtcgcggaggatataataggtagagtcgggggtgttcggtcgcgcgtttttcgcgtattatgtagttttttgttatttttttcgtttttaggttaaaattttgagtatgatggaagataataagtagttcgcgtttcgtatcgatggggcggtttagtcggttagttaggaggtgattaatttgcgagtcgaatttacggttattaatcggagattggcggaattgagcggcggcggcggtttcggttcgggttcgggagtcgcggttagcgtttcggcggcgggggattcggcggcgacgaatatggagaatttttagtttggagcgtaaggtaggatcgtttcggcgtttagggcggaggaaggcgagtagagtacgttcggtttcggaggtggtcggggattcggggttttttatattcggggcgaaatcgttttgtattttggtttgtaatttttttcgttcggcggtggttatcgttgtttttcggttgggagttgtaggttgttgttatttacgaaaattcgagcgtagtgtgtacggggttatacggttatatcggtttcggttagtttgagcgaggcgtagtcggcgggtttttttcg

SEQ ID NO: 6527 - DNA, 1384 bp, synthetic construct; identical to SEQ ID NO: 6526
  misc_feature 1..1384: note = Description of Artificial Sequence: Synthetic polynucleotide
  source 1..1384: mol_type = other DNA

SEQ ID NO: 6528 - DNA, 835 bp, synthetic construct
  misc_feature 1..835: note = Description of Artificial Sequence: Synthetic polynucleotide
  source 1..835: mol_type = other DNA
tcgtgaggtcgtgtgtgagtttttgcgtgggtcgtgagtgcggtagggagcgcggtgttcgggggtcgtttgtcggtgtgtttgtgcgtgtttgtgcgttagtttttgtttttgcgagtgcgtatttttaggatcgagtttgtttatatgagtttgtgtttgtgtgtgtgcgttttcggttttgcgtgtgtttgtgagcgtttgtcggggcgcgtgtgtgttcggaatttcgcggtggtgtgcgggtgtgttcgtgtgtttgtgtacgtgtaggcgagcgtttttatttgtgtgtgtgtatttgagtttgggttatgtgtgatttagggattagtttatgagtttgtttgtgtttttgagtcgatatttgtgtgtgatttagggacgagtttatgagtcgatatttgtgtgtgtttgggtgtttgtgtcgtggtgtgtttttgtaagcgtttgtgtttgtaggtgttggagtgtgtagttgtgggaatgagtgcgtgtgagtgtgcggaaggggtatcgcgcgagggagcgtcggtgcggaaggttaagcgagttcgcgttttttacggacggtgtcgttatttttttttttcgtttcgcgttatgtgtttttgtgtgttcgcgtcgtcggggtcgtttttgggtttcgggagggggttgagcgagcggttttttttttttagggatttcgggttcgtcgttagttttgggtatattcgtttttttttttagcggtttcgttcgttgatttacgggtattcgatgggtattcgggaggtaatggtcggagaggatgggtagttagcgggagggattgagtggcgtcggttttacg

SEQ ID NO: 6529 - DNA, 2248 bp, synthetic construct
  misc_feature 1..2248: note = Description of Artificial Sequence: Synthetic polynucleotide
  source 1..2248: mol_type = other DNA
tcggttttcgggcggtcgtttaggaggagatttattcgttgggtttttgatcgttttttaggaaaattttaagtacggaaattaagttcgatatcggtttcggtattttttttacgtcgttggtagtttaaggttcgttttgaagaagagttgtagaggaggaaggtggttttggttcggcggagttcggttcgtttggtgttaggcgttggtgttggcgtcgagtgaatttaggcggtttaggtgttcggtttggtggcgggcgtagggtttgcggtgatggaggtttcgttttagttcggttaggtttagttttgtcggtcgtcggttcgggatatgcgcggcgtttaggtttgtagggtgttttgggcggttataataaagttaaagatcggagtaagagttttcggcgagaagagacgcggagaagtcggagtttcggaaagtcgcgcgtagtttcgttagtcgtcgttagttgcggaggaattcgggttaattttaaaaatcgttggcgtttttgggtcgtttgttcgggtcgtattgggcggtttttatcgttttttttttttatttgtattgttttaggcgggagagaggttttggtttcgagggattagttgtagcgggtagcggggttttgtttttttaattttcgttttatggtacggggttgaatcggtattatcgaggttaagggcgattattaggagagaagatcggttgttttcgttatgcgaatttgtgttttgcgatttcgttgcggttgttcgagttatgttagaggtggggacgaagggttcgcggggagtgaggtgggtagaggagagaagttggcgttttttttagggtttttattttgcggagaagttcgatcgtagaattcggtcggttgcggtttatgttggtagttatcgcgaaatgcgttttcgattcgggatcgtattggaaattttcgttatattgtgttaggtttgattttttaggagcgcgttaagggtttttcgtttattgcggttcggcggttttttttttaataagtaaggttcgtgatttcgattttggaattttgtttttatagggaggagtttttggtggttatcgatcggtttagtagttcggagagaggttaggaaaattttttcggaacgcgttgggaggtttttttattttcgttttttttcgggcgtacggagattttcggttttagggagcgtttatcgattcggatgacgtggggtatttcgcgcgagttcgggatttagaaggcgtatacgaggagttcggtttagtatttttaaattagatttcggaggcgtcgttagggagcggttatcgttgggcgtcgtcgagcgtgttcggggcgcggtcgtggcgggttttttggggcggtagttttaggcgcgggcgcgtagtagtttcgaaggcgtcgtttggtttagtcgttcggttttcgagcgtcgttgtaagtggggggcgtttcgcggcgtcgcgtatattttattggggggtcgtttcgtcggcgttcgtttcgtttggttgtcgtttacgggttgttcgcgagcgaggtttttgggtttcgttcggatttcgttcggattcggtttcggtttcgattcgcgtcggttcggttttcgcgcgggtttttatttgtttcggttgtcgggttttggcgggcgggttgtacgcgttttcggtcgttttttttttagtcgtcgtcgatgttatcgttcgggttcgtataaagtttcggagtggagttgtacgcgcgtatatttttttttttagtttttttttttgcgttttgtttttcgtttttcgcgtcgttcgtcgttcgcgtttttttcgcgtattttttcgtgtatatatattttatatttatatttgtcgaggcgtatattcgcgcgtttatatttgcgcggggggcggggaaggggattttggttttattgtagggggacgttcggagaacgaggatttttttcgttttttagacgtttttattcgtttcgtcggttttagttttttttattgcgagggtacggagttcgggagttaggcgtggagcgcgagagttggtatcgcgagttgggagacggcggtagtttagcggtcggattagttggaggagacgcgttcgtcgggagtagcgagatcgggagttcgtcgtttgcggagtttggtttcgcggtttttacgcggcgggcgttggttggacggcggtggtagcgggagattgattcgggaatcg

SEQ ID NO: 6530 - DNA, 3541 bp, synthetic construct
  misc_feature 1..3541: note = Description of Artificial Sequence: Synthetic polynucleotide
  source 1..3541: mol_type = other DNA
tcgcggggagtaggggtcgcgttatgcggcggtcggtttgtagtagggtagaagttttttttcgtttgggtgtgtgggagcgtagattttttcggcgtggtcgggaattaagtcggggttcggatgaaacgaaacgaaaaatgaatattcgaattttttttgttagttttttttttttttttttgtttttttttggggggagggtagggtagggaaatataaggggaaaaataaattaggttagattaaagttttggttattttttgtttttatatatagacgcggttttcgcgatttttttttcggggtttcgataaatatagtatattgcgatttaaattaagggcgcgggcggagttagaaggattttaggagtcgagaggttttacgaataaataaaaatcgtaaaaaattaagttcggagaaaggggaaagcggggtggggcgtatttttataggagagaagaggcgtgtagcgaataaagtgatagttttttattttggattcgtaggtttaggagtttacgcggggagaggggatggagaatttttttcgtttcgttttttttttcggggaatttttaatttcgtattgcgttatttgtcgttttggggaggtcgttgtcgggattcggtttcgaatagttcgggggggtaggggcgggggtcgtcgaggggatgggggtagagagtaggcggcgggtaggatgttcggggtgagttggcgagtttcggattttcgtttttttttttcggggttcgggcgacgtagtttatcgggttgttttcgtcgtttatcggagagggtcgttcgggtgtttggttttgttcgaaagtttttgggtttttttttttttttgtaaaatttaaagtaatcgaataaaaagagtttaggtcgcgcgggcgggttgcgcgttcgcgttttgtagcgcgtcggcgggggttcggttcgcggggttattgtattgagtcgggtagtgtgtggtggtggtggtggtgtagcgtcgtcggcgggggcggtgggggcgcggagggtggcgatgcgtcgttttcgttaggttttagttttttaggcgcgtatatatcgtttatgggcgggtggttcgcgtcggtcgtaggggttatgcgtttttttttttgtcgtcggttgtagaattagacgcgtattatttttttttttagttgtaggttgtttgttaagtcggtgatttcgtgcgtcgagggtttggggtatttgagaaagtggttttcgagcgcgtttttgatttttatttcgatggacgtgcgttttttgcgtttgcggttttgcgtcgcgattttgtttaggttggtggggttgtcgttggacgagtcggttttttttagttatttgttgagtagcggtttgagtttgtatatgtttttgaagtttagttgtagggtttcgaagcggtagatggtggtttgcgagaatacgttatcgtagagcgtgtttagcgttagttttacgtcggtttgcgtaaagtttagtttgatgcgtcgttgtttgaattgtttggcgaattgttttaggtcgttcgagttgggcgtattttcgttcgagtgttcgtttatcgatgagtcgtcgtcgttcgcgttcgggtgtaggtgcgtcgtcgtcgcgtgtaggtcgttcgcgtgtgtatgttcgtgtgcgtgttcgtgggcgtttagatgcggcggcggcgacggttttagttgcgtttcgtggttattttcgtgtagcgcgtggtgtaggttcggtttcgcgtcgttatcgttcgtcgttagtatttcggttaggtcgtcgtcgtcgtttttcgggtaggtcgtttgcgcgtatagttcgagcggttggggttggtggttttcgttggtttcgggcgagggcgatatggtcgggtttaagtggtgcgttgtgttgttttgcgtttatgtcgcgttcgcgtgggtcgttttttggtgtattaggcgcgcgtggaaattttcgtcgtcgtcgtcgtcgtcggttcggtcggtgtcgtcgtcgtttgttttgtcgtgttttaggtgcgggtcgtcggtttaatcgtcgtcgtcgttttttttcgtgggtagttattgggggtgcgttaggtttacggggtggttcgcgttcgcgtttagttattcgtggtgtattagtttttgtatttcgcggtacgcggtttttgtatgtaatcgtttcgcggtcgtcgtcgtcgtcgtcgtcgtcgtggcgttcgggtgtataagcggttcggtgttttcggtttcgttatcggggtttcgcggtaggtattgcgcggtggtggttatgtcgtttcgcgttttgcgtcgcgtcgtcgtcgtcgtttcgtttcgtttgcgggtttcgtcgtttcgtttcgtcggtttaaagtttcgattcgttcggcgtttcggagttttatttcgttcgtcgtttattggttgttcgcggagttgtttttcgttttttttgttcggttttcgtttcgcgcgttcgttcgttattttgttcggttgtttagagttttttattgggcgtcgttttcggggtttcgcgcgtcggtcgtgttgattggtcgttggggttttatttacggtttttttatcgttcgcgtatatatttacgtttcgggggcgcggtcgttacgtggggagtggcgcgggggtggttttgggatcgtattttttttcgttttggttgtgtgggtttcgtttttttttagcgttggagatttcgagttcggtcggttttatattttacgcgagttgaattttcgttcgtatttcgttcgggtagtagggattgtcggtttcgggaggcgttcgggtttcgagaagcggtttagtttcgcgtttttttttttttagtatcgttgtcggcggattaggattttcgcgggttttggcggttgcgagcgcgaggcggcgcggattcgcggttcggtttcggcgcgattgtttatcgcgttcgtttcgtttttcgcggttgttagcgtgtattgggcgtttttcggcgcgtttgttcggttcgtttcggtttttttttttttttttttagttttagcgttataatttcgtcgattttttttgttttgagagcgcgttcggtgcgggcggagtcggacggattttggttttacgtttcgcgcgggtatattttttttcgggtattgaggtttaggtgagtatcgcgcgggtagttggggttgggacggcgggcggtagcggttttatagttttacgcgagtttttggtattcggtcgcgtttcggggttttagaaggagaagatttcgaggtggagattgtggtttcggggaaaacgttgttggtaagggcgttagttgggggtggacgttgggtttaggggtatttgatttgcgtcgttgtagttttttcgtttttttttttagtttgaacggtttatcggttgtggtcgtggtgggattacgtttcgggagaggagaaggatgggtttagggaaggggttcgggttttttagaaattcggcgtgtaggtcgggagttgtttagtttcg

SEQ ID NO: 6531 - DNA, 1513 bp, synthetic construct
  misc_feature 1..1513: note = Description of Artificial Sequence: Synthetic polynucleotide
  source 1..1513: mol_type = other DNA
gcggggcgggtcggggcgtcgttgcgggacggtatttaagggcgcgcgttgcgtgttgttttcgcggtttttcgggcgttatcggttcggttaggtttcgggagttgttcgttttaggtcgcgggggcgtttcgggttcgtaggattcgaaaatttttttttcgggtcggggcgggtgagtaggcgggcgttgggttgcgttcgacgtttttttaggtcgtttaggagagtttcgagggttgggagaagtcgtcggggcggttgggttggacgagcgagtttaggggttaatcgtttttattcgtcggtcgcgttgtagagcggtgtttttagggttggggtttgcggcgatttcgttgggaggaagggagagcgagaattgagacgtttgttttaagttgtttggagttaaaggttttcgagagcgtggtcgtggggttgggtcgttggagtggtcgtttcggtttagatattcgtattttcggcggtgcggcggtttttacgcgcgtatttatttagcgcgttcgggggtttgaggtcgtcgttacggcgtttcgtttcgggtagtagtaattagtacgtaggtatttttggaataggcgggattgttttttcgacgcgcggtttgcgtttaggcggcggaggggtttagtttttttttagttttcggttttagggcgtagggttacgagttttcgtttttattttcggtttttggtattcggcgtcggtttcgtcgtttttttttatacgtatttttggtagggtttcgcggggcgttttaaagtttgggggtagtttttaggtgtttttgggaagggaaagaaaggttataaagtaaaagaaggagtaaagagaaggcgagggaggagtaggggttcgggttttgtggattcgtttgggttgggagtggggatattgagagggttgcgaaggtttcgggggtcgcgcgtggttcgtaggtttatttttggttcgcggttgttttttttttttttttttgggtttttggttttttttagtgttgttttttttttttttttttaggtttttttttttttcgcgtagggtttcgttttggggattaagagaaaggagggaggggaaaggggaggggaagggaaggggcggaggagaaagagggacgatttttttaaaggcgggtgttgagttttagtttaggattttcgggtttaattgtttgtggtattttttatattttttattttcgtttcgttttggttttgttttagttttcggcgtttttttttttcggatttcgttgtatgtttcgtttgcggtggttcgatcggtttttttcgggagttttttttttttcgttacgttttcgttttttcggtcgttttcgcgtttttcggttttttttttattagttttatatttgttttttttatgggagggagcgcgcgtttttcgtttagcggggtttttagtagagtttttttaattttcggcgttttttttatatagggttcgttgggtcgtttttgcg

SEQ ID NO: 6532 - DNA, 3541 bp, synthetic construct; identical to SEQ ID NO: 6530
  misc_feature 1..3541: note = Description of Artificial Sequence: Synthetic polynucleotide
  source 1..3541: mol_type = other DNA

SEQ ID NO: 6533 - DNA, 558 bp, synthetic construct
  misc_feature 1..558: note = Description of Artificial Sequence: Synthetic polynucleotide
  source 1..558: mol_type = other DNA
tcgagagcgtaggattattaagagaggtcgggttatttttttcgtcgttcgttgatttttaggggttgggtcggcgtatagtaagggggttggaggtggggtcgtttttttttacgcggttgggtttttaggcggtgttttgggtcgagtcgtttggagattttagattagtatgtgggtgggaaagggcgtttcgttttgggttttttcgtttttgcgcgtagagtagagacgcgtagattcgtttttatttcgtttggtttttttggagtagtttcggcggcggtagcgatgggttgggaggggtcggtacgttggtttgcgcgggtttttagtcgtttttcgttattcggaattttttttttttaagcgttgatcgtcgatttatagtttttttttaattcggggcgagcggggtttttattatatatttttttttttcgttcggttttatttttttttcgtttttttttaggttttacggtttgtaagtatttttgtaaataatttttagtttatttatatcgtttcgttcgtatttttcgagagttaggtacg

SEQ ID NO: 6534 - DNA, 7244 bp, synthetic construct
  misc_feature 1..7244: note = Description of Artificial Sequence: Synthetic polynucleotide
  source 1..7244: mol_type = other DNA
acgtttagttagggcgtagagagagcgttgggcgaagaggggtcgatggttcgcgggaatagggttggggtttttgtttggggatcggtcggttgttaggtttttcgttttattgttttttcggagcgtcgttgattataggttcgtataggtcgtcgtcgtaggtcggttttttgtgtatcgtcgtagtagcggcggtcgagcggttacgtatgagatcgttaaaggcgtagtttatgggtgggcggaagtcgagcgtgggtattaagtcggtagtggagtagggcgttatgaaggttagatcgcggttgtgcgtcgtcgtcgcggagtaggttaggcgtagggggttgaggtcgagcggcgcgtttagcgggtaggcgttcgcgtcggtatcgaagtgattggcgttgggttgtagcggcgagaaggtcgagcggttgtttagcgagtttagcgttttaggcgttatggcgtcggttagtaagggtttgtggtgcggaggtgcggcgggtttcgtttgtagcggcgtaggtagtttaggtttttcggcggcggcggcggcggcggcggcggcgtcgacgcggttgggttacgcgtcgtttgtagttgttgtagtatttacggcggttttatttgggggcgtcgtagggtttaggtcggtcgttaggtttttacggtggtggtttagtatttgttcgatggtttgtattacgtcgtcgtcgtagttttgtaatattagttttaggacgtttcgtcggtggtttgggaatacgcgtgttaagatatttagcggcgttcgttgtcgtggattcgagttttcgtttagttttggcgtcggcgcggttttatttttttttttgttagtttttgaatcggatttagagtttagagggttagcggagttcgggttgtttttttcgtcgtcgtcgttagggttagcgttgtttgggtagttgttatttgtttttttggaggttcgagttaggggcgaattagaaaaggattcgttatcgtcgtttttcgagtttgagtcgggtcgtatttttggggacgacgtttcgggtttcgagtttgcgtcgtcgggtgataagggttttatcggcggcggtagcgggttgttcgggcggtttgtttgtagtagcgttttaggaaataggttaaatttttgtaatttggtttttgggaggggagaaaacgtgtcgtgaggagcggttagttagaagatagtagttatagtatttcggttttttggattttagtttttttttttttagttttatagtttttatttattaggttttagtgtttttttttttttttgttttagtatttttttcgttttgagtttttatagttttgattttagggttttttttttttttgtattttttagaattttaattatttgtgttttgtaaattcgatgtttagtgttgttttttttacgtttgtgttttaatatttttatttttaattgtttttttagttttgttttgtcgtggagaagtggttaggtttagggtttaaataagagataatataatttttgtttaattacgttgtatagaagagtttattgtatagaaaatgtttgttttggtagtgtagtttgtaaggaaaggcgttttggttatttaggaggttttaagtttttttataggtagaagtatagtttttgtttttaatttattttttttaaaattgagatttgagaagttttttttttttaagtttagagcggatttttttttttttttaacggttttggtttaattttttttttttttataaaaagttacgggggtttagaaaaagagggtggtgttaggtaggtagtaggaagcgaagaggaaaagatataggaaagtagatttgagaaattagggagggtgcggaagaaattagaaggagggagggcgtagtaagcggttgtttagagggcgttaggaacgcgagaaggggaaaagaaattagggcgttttagaatttagggcgttttaaaatttagggtgttagttaaagggggggggattttttaagggagttgggaaggagtagagggaaagggtttgtggagaagcgtagagcgaacgaagatgcgtaggtttttatttggggagaagacgaagtaaagaagtagggatttgtttgcgtttgggtagaggcgagtaaaaaaattaaagcgtgtatatttcggttcgatgtaggagaaaggggtaaagtgtaaatgttttagaagcgggagaaaggagagtttttgtatttacgttttatattcgaggttgggcgagcggtgaattttagtagtcgcggcgattggatacgggggttttattttttttgaatcgagataagtttttgggtttcgtgttttagagttacgattttgttgtttttatttgcggtttggtcgcgtttttatttgagttttttgcgttagttgtttcgttttcggttttcgcgggcgttttcgttttaggtttttcgtcgtcggcggcgtatattgaatcgaagatttcgtaggcgggtttcggggggatgatgtcgttggcggcggttagcgttagtttttcggtagtgtcgtagagtagttgtagttcgcgcgtttcgttttttttttgcgtttgttgtttgcgtagcgttatttgcgtcgttatgatacgttggcgtttcgcgatgagcgtgtatttggcgtataggtagtttttttagcgatagtagcgtttgtggtttttgagggtcgatattacgttatggttgcgatagcgcgcgtatttgggggttcgcgggtatttttcggttgttcgtagtaatagtggcggttttcgtagtaagtcgtttgttacgtttatcggtagcgatgtagcggtcgtcgcggttgtcgttatcgacgttatcgacgttataggcggtttcgtcgttgttgtcgtcgtcgtcgtcgtcgtgtcgggtacgttgggtagtttcgagcgtagttttatgataggatttgacgggaaagaaggtgggagaggggagagatttggtgaggagtatatcgcgcgttaggttaaagcgtcgttttgaggaatttaagttggagagggaaatttgggtcgcggaggttgggttagaggggttagaattgttgggaggaggtgtagtcggaatttttttgtgagttttagtatttttattttagtttggttatggttgtttttagatttgatatatacgttaggggtaagattttgtttgaattagtgatttcgttggaaaaaataaagagatatgtaaagtgtgaaagttattgatttagatggttgtaatgagaatttggaaaagttaagatgatattttaaagtttagtttaattggggtgagacgggtgagagaaatgttcgtttgacgggattgggattagagcgatagttttggtttagaagttaggttgatgttaagggtaaaataggaaaattcggagtaaaacggttagtttggtggaagggtgaagaggagagagatgtgaaggcgtagatgtgaaggtcggttgggtcggagttttgtttttttttgtttgtttatttttaatgtagtttggggtagaagttttggagagaaaaattaataatagaaagaatagttttaggaagtagagtgaggacgaggaaataatttgggtaaagttaggtttagtggttttgggattcgtaaaaatgtgagcgttaaaagttttacggtgagggtttttagagagtgagagataaaatgtatgtggaatttagtttaggattgggaagtattaaagagaaaaattcggttaaagaaattttttgtataggtaaatttagtttaaagatgagttttatgggtaaggaaaatagtgaaaagtagttgatttgggtgttcgggatttaggggtcgcgtttgggagaggggaatgtgtaagaaaaaattttataggtaaatgttgggggaggggattgggtaaaatttgtggtgtagttttttagtttcgtagtttggagtagtagtcggggcggaagacgtattttgcgaaaagttaggtatttcgggagggggatttttttcgaagattattttatattgtttttttttttttttcgggtttagggatagagtcgttagatacgtttttttcgttttggggttttaggggatttttttcgagcgtaggtttttgcgttttgattttagagttggggttttaggatacggatggtttagtaggtcgtattaagttaggggagtcgttttcgtaattggttataaacggatattagagttttttttacgtcgtagttttataaggtttaagtaggtttagtttttcgtttttgtcgcggttttttttgtttttcgcgtttttcgtttttgttagagttcgcgatagagtttttgtgttttcgttcgagagttttagattttttttttatgagcgttgtttttttttttagatttttcgggcgtttttaaggtttacggggtttaggtttttttaataggggtcgtagattaggtttttatttattgttttttttgcggtttttaattatttgttttgggtttcgggatttttttttttcgttggcgttgtacgcgtttttcggttttattggcgacgttggagtttttggtcgtttttttttgttttcggttttttatttgattacgttatttttttttagttattatgttcgaattttcggattttttagaacgtagcgtagtttaattttttttttagaaattcgggtcggaggttcgtttgcgggtcgcgtggttggaattcgcgatttgattttcgtcgtgtcgggttttttcgcggtgcgcgtcggacgttgcgcgtagtcggggtttagttgttcggcgttgttagatttttaatgagtcgttcgttcgttttattgttggtttttagggttttattagatagaattggataataatgtggcgtttgttattggttaggggaggtagacggcgttttgattggtcgggttcgcgttcggggagtttcgtattttgtagtgttcgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcgtgtgaattgtttttaattatcgtgttcggtgcgtttttttgcgtagatttgtgtaatttttcggtttttggggcgtcggttcggttgtatcgtttttattggtttggggcgtttggtaaagtcgagttttttaagtggttttggagttttgaggcgggatggggggtaggtgataatttaattattgcggtcggggtaggggcgggataagggtgcgggggtggggaagggagggtgtttaaggtataaatgttaggacgattttttttgttttttttttgttatgtttcggcgcgtttttaaattcgacgagtttggggtagttgggggttgttttggttttttttttttgtttttttaaagtttagttattttattttaaaagttttgatacgatagttattttggagggtaagtgtggtttatgaagattttcgtgtttaaagagaagtttagcgaagagaaatgagattgtattttttgtcggtgttcgttacgtttttcgcgttttgagtttttttttttttcgttttttttttcgcgttttttagttttttttgagtttttttttttttattttttagtatttcgatttttttttcgtggtggtgggattttttttgtcgttattgtaaatgaataaatagttttttttttttttttttttttttttaaacgaaagtaaaaagtggtttttgtgttttcgtagatttttttaaatttaggacgcgtatcggtttgttcgattttttcggtaagagataaagttattgttgggaggttttttcggatagtttttagttttaattttcgttttattttcgttttgttttgatgttacggttttgaggaatagttcgttttgtagaagaggtaataggttttagattttgttttttttttgaaaggttgttgttttttaaatatttggaattaatgtcgcggttttcgggcgagtcgttttcggtttttgtagttttgattttatttttgtgtttttttttttttaatttttaaagttttgtttttttttttaattttgtttttttttttaatttttaatgttttgttattttcgtttttgttttttattttttttttttttttttagaataaagaaaattcgtttaaataatgaggaaaatgagcgtttttgtcgttttttttttatttttgatcgtgcgtttttgcgttgttttttcgaatttttaggtcggcgggaatttgggcgcgtagattcggttcgggtcgtcgcggttttaggacgtagtttatttcgtttggtacgattattgggtcgcgttttgttagtttattagtttttgagtttaggaatgggggtgggggaaggacggtgcgattaacgggtttttattcgaagatcgtagaatttggcgtttcggaagagttttggaagatgtttatcgggaggttgaggttggagggaggagtgggtgggggtgattcgttggaggatcgggcggagagtttttagaaagtttattaggtttcggcgcgagggcgtttcgatacggataaggtttatgatagcgataaaaagttggttattcgtttttagaaaatgttatttgttggagtttgtgaatgggtttaggagagagaagggtgttagttttcgcgagggtttttcgcgtgaagtgaggataagggagtgttttagggataatatgttttttaggagcgtaggatttagattttattttttaatatttggaggtttcgaggttaagtatgtttagtttcggttgtatttgggtaggtgagttatggggtcgggggaagagcgtcgataatcgtcggatttcgcgtaggggtcgttaggcgtttgtttttagagtttttttggataaagttttcgggaaattttattaaatcgaaaacgaaataaattatataaatttgtttagtttttgagggggcggtggtttaggtatttttttcgtttgaggttaggttatcgtgagatttttttatttcggatcggggatttcgtagaagttaagggtgtagttacgaggattcgggaattcgaggcggtttagtagatgcg

SEQ ID NO: 6535 - DNA, 824 bp, synthetic construct
  misc_feature 1..824: note = Description of Artificial Sequence: Synthetic polynucleotide
  source 1..824: mol_type = other DNA
acgcggattgagcgaggaaatgtttaagattataggattgaatttttcggaagtttcgacgttgtttagttagttagagtttagtcgtcgacgcggatgaagttgttttttcgggataggaagggttaaatggttgcgcgttaattcggtttcgattggggtgttagggagtaagagtcgtttgtttcgggggatttcgtttggggggtttttaggggtcgttttggcgtttcggttataatttgggcggttttgtgcggcggttttcgtttgcgtttttgcgcgttatttaaaattttgcgtatattgtagtcgtcgttttttcgtttttcgcggtgagacgcgcgtcgttaagtgtcgtaggtagttttttatagtcgtcgcggtagtcgttgtttggtttttggttttagattttttttttattgtttttagtttttatttaggaggttttttcgcggtcgcgagagttcggcgttcgatttatagtaggtagtgcgggtatagtgttgtagattattatttcgttaggttcgggtagcgtttattagacggataggcgttcgcggtcgtttttatttcggcgcgtttatttcgagttttttacgtcgcggcgggcgggcgtaatatatttttttatttttagtcgtcgaggattatatttttcgtttagttttttcgatttatttttcggttgtagtagagggcgagcgggtttcgtttttgttttttggggttggtaggttcgtgtggggttagggcgcgcgggagacgtcgcggagttgggtatttcggagaggggatgtttatttttagcggtttcg

SEQ ID NO: 6536 - DNA, 824 bp, synthetic construct; identical to SEQ ID NO: 6535
  misc_feature 1..824: note = Description of Artificial Sequence: Synthetic polynucleotide
  source 1..824: mol_type = other DNA

SEQ ID NO: 6537 - DNA, 1415 bp, synthetic construct
  misc_feature 1..1415: note = Description of Artificial Sequence: Synthetic polynucleotide
  source 1..1415: mol_type = other DNA
tcgcgttgttagaagtcgacgttagcgagggaggtgtgaagagttggttagaatgattaattttttttttatatttattttttttattatcggtggttcgttgttgttgttttgcgaggaagaggagtcgtgggcgggtcggcgtatttcggtgttatttttgtattcgggtttggttatcgggggtacgttggttaacggtatggttatttatttcgtgtcgttttttcgaaagttgtagattattagtaacgtttttatcgtgaacggttgcgtcgtcgattttagcgtttgcgttttttggatgtcgtaggaggcggtgttcgggtttttgtttatcggttttgcggagtttttcgtagattgggacggcgttgggggtagttatcgtttgttacggggtgggttgttgggtttcggatttacggtgtttttttttttttattgtttcgtggttttgaatcgttatttgtttattattcgggcgttcgttatttattaggcgttgtattagaggcgttatacggcgggtatgttggcgttgttttgggcgttcgttttgggtttcgtgttgttgttttcgttttgggtatcgcggttcggcgtcgcgttatcgcgagtttattattcggcgttgttggtcgtcgcggcgttgttggcgtagatagttttgttgttgtattgttatttgggtatcgtgcgtcgcgtgcgtgttagcgttaagcgggttagcgtgtttaatttttatttgttgtattagttgttcggttgcgtcgtcgtcgtcgtcgttttttcgggcgtttagtacgcgtcgggtttcggtggcgtcgcgtattcggcgtaggtttagtttttgtcgttcgcgttgtattcgcggcgggtatagcggcgttttagcggtttgtcggtgttgttgttttgttgcgtttttttgttggttacgtagttattggtgtgggtgagtttggttagcggtttttcgttgtcggtgttttggggagtgtaggcggttagttggtttttgtgttgcgttttgttcgcgtttaattcgttgttttatacgtggaggaacgaggagtttcgtcgtttcgtgcgtttagttttgtcgggcgtcggcgacgcggcggtcgttgtcgttgtcgttatagtcgtgttcgtagtgttttaggcgtaattgggtattcgcgtcgcgggttagtattggtaatttagtcggggttcgagggaagcggagattttcggttttcgacgtttttgggtatcgtcgttttttttttttttagggtattttttgtttgaacgaagattttcgtcgcgaagttcgatagatcgggggaaaatggggttttcgattttagcgggttatttgaattaaggcgtttttttaagtggggcgttcgaagttattttggacg

SEQ ID NO: 6538 - DNA, 1415 bp, synthetic construct; identical to SEQ ID NO: 6537
  misc_feature 1..1415: note = Description of Artificial Sequence: Synthetic polynucleotide
  source 1..1415: mol_type = other DNA

SEQ ID NO: 6539 - DNA, 3039 bp, synthetic construct
  misc_feature 1..3039: note = Description of Artificial Sequence: Synthetic polynucleotide
  source 1..3039: mol_type = other DNA
tcgcgggattagttttggtttttatatttcgttgtagttttgtttcgcgtcgtattgtttttttcggttattgtggggttattaagcgatttgtagaattcgttgaggtttaggtttttgtagttttcgtcgaagatttaaagttagagtggatataaacgtcgtgggtaggatttcggtgaggtttcggtgttttttttgggggtttttagcgttggtttagaagttttagttcgggtttaagaatttgggatttttttcgattttggcgatcggtcgggttattcggtttagggttttagcggtagcgggtaaaattttagtaggagttttttgtcgagggcgtgtttcgacgttagagttaaattcgggatagattagttaagcgcggacggcgcgagagtggttggtagcgttagtacgtagtttgggtttagagtaaggttgggcgtttttagtaaagggcggtttggggttgcgcgggcggcggattgtaggcgggagaagagcgaggtgcgttaggttttggggcgcgtaattgtttagtttcgtgaaagatcgcgtcgtagatggggcgtagttgcgcgtttattcgtgtggattggaaacgtttcgagtcggttattttaaaaatcgggaaataaggcgggtttttttttcgttcgttattttttattaagtaggttgtgcggttttgggggttgattgtttttaagtagttaggttttatcgcgcgtcgcgttgcgtcgaggttcgttttgtcgtagggacgttggtagttcgttgaatatcggtaagagcgttagaggttagcggtcgttaggatttttattaggttttgttcgtattcgtttgtttttttttcgtttggtttgtttttcgtttaattgaaatcgttaatttttttatttttttgtttttattttgatatattttacgttttaaatatgtttcgtttttttttgtttagtttgttttttttttttttgtttttttttttttttttagttattcgtttcgttcgattttgtttttgttttttttattcgttcgttttttatttatttattttagtttattttagttcgtcgattgttatttattttttcgttttcgtcgcgtttttcgttgttttgtttaatttttttttttttttttttggttgtcgttcgttttttttggttttttttttcggtatttcgttgttaaggttatttttgtcgtcggatttcggggtgttgggtttttttcggtcgttcgtttcgtattagcgttttttgtagttcgcgcggtatcggtgtggttcgggggttcgagttgtcggtgtcggatgcggcgcgtttagtagggacgcgggtttgggggggtggtttttgttcgacgcggagcgttgagttaggtcgggtatttgtttttggcggtgtttatcgtattgcgcggtttttgtcgtttggttgggattagaggagttaggttaattgttttttattaagttttaattgtggtttttattaggaaagttttttttaaagggtatagatacgaagtttcgcggattcgtttatttttttcgttgatttatatatattttttcgtttttttttatatatttttatcgtttcggttgggcgaaagtcggagatgttcggttatttcgtggaggttcgcgaggcgttagtcgggcggcggtagggggttgaggcggattttggaggatttagttttgggtttaggttgcgggatatggtagcgtagataaggtgggtgtagtgcggaagtcgagacgttttataggttatagggtgcggcggacggtcgtagagttgtcgattagtttgttaggtttttgtttttaggcgtattttcggatgtcggcgcggtttagtcggttttagtatagggtatcggttcgtgagttcgcggcgttagggggttaggttgtttagggttgtttttgattgtttagcggtgatgatttagcgcggggaagttaagattgttagaagggcggttattatagtgtataacggtagggaggttagtttagtatgagaaataagaatatagttatttcgttttgaggatagttttggtattgtacgattagtcgcggttagattgtgttagtttgtcgtataggtagtattttttttgtgaaggttaggttcggggaggagagacgggttaagattaggtcgtagtttttagtcgatttcgatttgattattttaggttgaggtttagttttagggtttttaaagggcgttagatataaaagtcgcgttttttcgttaggttttagtgtggttttatagttttcggtcgggtttgggttttagggtaggtggtagttttagtttaatttcggtagagtatgtttttttttttttaggtttaattgttttcgggtttcgattggatttcgggtcgtcgttattgtattttttttcgatttttcgttttttattttcgtcgtcgaggaacggtggtttattttttcgttttatattggtttttgtttggttcgggttagcgttaattcggttttcgtggaagtcgtggcgaaaggcgagaggggtaaaaagttgagaaataggcgagcgggagagataagtaggaaggttcgggtgggttcgggtaaggaagaagaagagagggtcgggttgcgcgttacgtttcgcgtcgcgcgttatttttcgcggggttttcgtagaagtggtcgtcgttgagggtcgggtcgggttcgaggttttgtaggtatttggcgggcggtttggtcggttttgggaggtagggttttaggggttcgtaggtcggaaagcgggttagtcgcgggtcgcggggcggcgcggggtgtaggtgaggcgtagcggcgggggttttttgcgggttcggaggttcgtttttcgaggttatataggggtcgggtgtaggttttacgcggaaaggcgcgtagtgttcggggtttatgtcggtttagggcgtataggttttcggggtttcggggttcgcgttgttcgcgtcgtttgtgagcgttcg

SEQ ID NO: 6540 - DNA, 1277 bp, synthetic construct
  misc_feature 1..1277: note = Description of Artificial Sequence: Synthetic polynucleotide
  source 1..1277: mol_type = other DNA
tcgttttacgtttatttttttcgtttacgtcggttattagagtttcgttcgttgttcgagagtttcgtattgacgtcggttcgcgcgtgagttaagtttgcgttacggcgtttcgtcgttagggtggtttttcggaaagcgagggaatagtgcgcgtagcgtttcgtttagtttcgttttgtttcgtagagtcggcgttgttagggcgtagggagggcggtattcggttttagttttcgtaatttcgcgcgtttttttcgtcgtgggatttgggttttcgcgtcgtttttttgagtttcgagcgcgcggcgggcgggagttaggttgggattggtggtgaggtagggagtgaggagcgagcggagtcgcgtgcgtcggcgcgtagtttcgggtcgttttagttttagtcgggggtttgtggttcgggggaggagttgtgcgttcgcgattcgtcggggatcgtagttgttcggtcggagtgtacgggtcgagtttgcgcgattatttacgcgtgataggtgagtcgttggtcgcgtttcgtttggttttatcgggtcggttattgtaattttttttgttttggtttcgttttagttagggagggttgaggattaaggtgtgaggcggcgttgttttcgtattcgttcgattttgcgttcgtttcgggtttttttcgtcgttttagtcgtcgttgtttggcgacggagtttcggggttcgttttttttcgcgtatcggggtttttagcggcgtacgtacgggttggatatcgggttttagtttttggtgtttagaagggtttaagaatttcggaggaaattgggtttagttgcggaggtaagcgttcgcggagaatcggagggggtttgttcggtttattcgcggtttgaaattgcgcgtttagggcgtagttttattgggagttttttacgtagttggagattttagttttagtcgttcggttttaggtttgtgattttgatagtaatattggtaagcgaagtagaattgttacgttcgagatgaatatttaatttttagttttggggttggttttcgttggattcggagttagtagagagttttttttttttcgtgggaagcgtatttggggaacggaatggttgagataggggacgtgcgtgtggtgtttatttggagggggcgtcgttttggcgggtcgagaggtttttgttgtatttatgtttgtgtgcgtcgtgttttgaagcgatgttggatgttcgtagtattatgggtgggtcgttttttaggggcgcg

SEQ ID NO: 6541 - DNA, 2394 bp, synthetic construct
  misc_feature 1..2394: note = Description of Artificial Sequence: Synthetic polynucleotide
  source 1..2394: mol_type = other DNA
gcggttcggtttgggttgtttcggtgtagcgcgtttcgtatttggtttcgtcggtttattttcggagaaattttttttgttttgtcgtggtttatagggttgatttttcggtattcgaaacgttagtagttttgggagtttagcggagagtcggagttattttggggttagtgacgtttttcgttgataagaattttaaagttgttttagttttttttttttttttttttttcgcgtttaattttgatattattatttttttattttttaggtatttttttaaagtcgtgtcgggattgtaattcgtttttcgatttagttggggtcgggttttatttagttagttaaggggcgagttagcgatgcgaatatcggtttggggggtacgattttcgtttacgtttttcgtaggcgcgtaggggatttaattttatatattttattttcgaattacgaggaaaaatattttattttttaaaaaaataatttgttttttatataaatcgttatttaaaaatatataaataaggtttaagtataaaatttaattttggggttggcggtggagggaaggtgagggagggggttttggtatacgtttttcgtgtgtgtttgcgcgacggttgatgagggcgcgttagggattttggcgtttaaggagatggggttgtagggaggcggacggagagcgttttaggcgttcggtttcggttttgttttaatcgtagagcgcgttttaaagtcgagggtagttttaggtgtcgttttgcggttttattagttttaggagattagggcgggggatgttaagtgttggtaggcggggaagaggttaagcgtcgagtcgggatcgaaggtagggtagttcggtagagggtaggcggcggttggaggggcgtcgtattttttttgggtcgcggcggtttttatttcgttatcgtcgtcgtcgtcgtacggttgttcgtcgcgaataagtatcggtattattacgcgacgtagtaggtcgggcgcggcgtgtagttcggcggatgttgttaggttaggcgatttcgtcgtttttggagcgcgagcgcgttttagtttgtagcgatgattttggaattagattttgatttgcgtgggcgtgaggcgaagtaggttcgttagttgttcgcgttcgggcgtagataggtatcgttgttgtcggaagcgtcgttttaattttagcgtttgcgttttggagaatagtattcgtcgttttttttttttttcggcgttcgagttcggagacgcgggtttagcggacggtcgttgcgacgagtttggcgggttggtttttaggttgttttcgttcgaggttagggatagtaaaggagatacgggtgggtgagacgtcggattttacgagggtttgttgtttttttggcgcgggcgtggaggtattggttagagggtacgtttattagttcgagattttcgggatgaggttattttttgagtttatatttggatatttattttttcgaatgcggtgattttatttatattatagcggttattagcgggtttgagatcgtgtttcgaaaaaatttatttcggggtttttttaatatgttcgtatcggtagttgcgttggtcgattagtttattataagttgggttattagcgtcggttttttttaggtcgattgtattgtagtgtgtcgaggtttgcggagttttgagtgggaacggggtgggggtaaattcgttaatattggttattttagacggaggtttggagatcgtggtcgtgtttttaggtatggagagggggcggggggtggggtgggggcggtaggtggcggcgcgttttaaattttaattatttcgatttttagaaatcgttagatatagaaattttaaatttcggagtattagtgttaggtagggatttgtttttaggatgtgtcgatcgggatgaatgcgttaggggttcgaggatagggttttcgtttttaagattgaggaaatttagattttgggttgggatttcggtttttcggtttttcgtgggttgggtttttgattttgttgttttacgttttttattttttatttcgtatcgtaatttattacgtatttataagggtagtggtcgcgtttcgaatttagttaggcggcgtaggggtcgggttggggggcgcgtggttttggttttcgtttcggtaggtgttgcgcgttttgttcgggtaaatttagaaggttgcgtacggtgaagtttaggcgtttagaggtggttatggtcgaggaggggaaggaggcgggggtagggtaggttgggaacggaggggcggtcgggacgtcgtttttacggatgggcgtgggaggcgttcgttatgcgttggtagtcgggatattagcgtatttatagcg

SEQ ID NO: 6542 - DNA, 1627 bp, synthetic construct
  misc_feature 1..1627: note = Description of Artificial Sequence: Synthetic polynucleotide
  source 1..1627: mol_type = other DNA
tcgtggggttacggttacgttgttttgcgttttgggtattacgttttttagttataaggtgcgttggagtaaggtggagtttggggagtttcgggaaacgttgatttttattattaacggattgtacgttcgggggtatgggtttttgggagggcgcgttaggatgcggagggggtatcgattagacgtttttttggttatcgcgggcgtgcgtttggaggacgagggtcggtatcgttgcgagtttattaacggtatcgaggacgagagcgtggcgttgattttgagtttggagggtgaggttttttcgttttcgttttatttttgtgtagtagcgggttcgtttcgtttgggttttttagggtttttttttagtatttttttcgtatttttggggattttagtttttttttttaggtcgcgtcgtttttttttttttttcgtttttattcgttggttttttttaggattttcgttattttttaggtgtggtgttttcgtattaatttagtcggggtcggtattagtttaattattacgaggcgaagtaggcgtgcgaggagtaggacggacgtttggttatttatttttagttttattagggtgagcggtcgaatttagtattttttaagtttcgcggagttgttttaggggttcgagagagggcgttaggcgagtttagtttggtttttgtttatgacgttttttattttcgattttcgtcgtttttcgttagtttggatcgagggtttggattggtgtaacgcgggttggttgttcgagggtttcgtgcgttattttgtgtttatcgtacgcgtttcgtgcggcggtcgaggtcggttcgggattcgtagttacggatttcgcgatcggatgcgcgatcgttacgacgttttttgttttattttcgcgttggcgggtgaggcgcgggacgaaggtagggttttggggaggggtttgaaaaatgtgggggacgaggagtggattttagtttgagattagggtagggttttcgggtttttttaaggtatcgtttttttattagttcgttcgttcgtttaggttttagtttatttttttaaattttttttgtatttttgtttcgattttttaattttttttatttaagttcgatttagtatttttgcggtttcgtattttaatttcgttttttgggtgttagtcgttttttttcgtttattttgttttcggtcggtgattcgttgtggtttttaggttaagtgtttttcgtgttcgggcggttgacgttgtttgaagtttacgcggcgtgtcggcgacgcggcgtcgtggtggttaaggttgggtatttttacgtcgtttggaagttttcggggttagattagtgcgacggcggttggttggttgacggtagtgtgcgttttttaattattacgtcgaggtcgcgttgcggggggttttcggatttcggagtgcgtagtttcggtttttttaggttttaataggtagtttatgggatttattgttacgtcgagaattaggcgtttatcgtgttttttttagcgcgcgcgaagaagtttgggagtcgtggcgggggtttttcgttattttttttcggagagttttttttttttttagattcggagcg

SEQ ID NO: 6543 - DNA, 271 bp, synthetic construct
  misc_feature 1..271: note = Description of Artificial Sequence: Synthetic polynucleotide
  source 1..271: mol_type = other DNA
tcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacgggcggggagttggtagcgaaggatgcgttcggcgtttttcggcggtcgttcggagttcgaggtcggcgcgggaggagcgttgatttcgcgggtcg

SEQ ID NO: 6544 - DNA, 884 bp, synthetic construct
  misc_feature 1..884: note = Description of Artificial Sequence: Synthetic polynucleotide
  source 1..884: mol_type = other DNA
acgtcggttgtgaaatttattgaagtgagcggcggcgttaggatttttgggatttcgatttttttgtagttcgtatagttaagggcgagggcgtttttcggtagaagtagtaaatcgtcggtaagtttagcgaggagggttgtcggggtttgggtttgggaattggttggtatttagcggaaagggacgtgagttgagcggcgggggagaagagtgcgtaggttagagggcggcgcgtagcggcgtttcgcgaggtttttacgtcgggcgatatggggtgtttgttgtttttgttgttttgggcgtttttttaggtttggggaagcgttgaaggtgggtggaacgagggcgtttgagtgtattcgcgggagggcggagagagggagttgggtagggacggggagggtaacgtttgatggggattggtgagattcgggacgtattggcgcgatttaggtagaaaattcgttgttttttggtttcggggagaggtagcgcggtatagagttcgttggtattagtcgttttttgaagtttatttttttttgttttttttttttttttttttatgttggttgttttttcggttatttgttatacgtttttaatttttatttttttttagtttcgtaaaggttttttttttttcgttgtttttagatttcgtttttcgttaatagtagttggacgcgtatcgacggtttggcgtggttgggggagttgtagacgtatagttggagtaacgattcggatatcgttcgttttttgaagttttggttttagggtacgtttagcgattagtagtgggagacgttgtagtatatatttcgggtttatcgaagtagttttattagggacgtgaaggaattcgttaaaatgttacg

SEQ ID NO: 6545 - DNA, 1007 bp, synthetic construct
  misc_feature 1..1007: note = Description of Artificial Sequence: Synthetic polynucleotide
  source 1..1007: mol_type = other DNA
gcgacggtgttcgtgcgtttttttattagtgtatgtgcgaggagggttggaggtatgagcgaaagagggaaggtaatttcggtttttaaaaaatttaggggatttttttttttagtataagcgtttatacgtgcgttcgcgcggatatatatatatatatttatatttatatataaataaatttttagtatttgtttcggaaagttttttttcgtaggttggttcgaaggcgcggtttcgttagcggagagtttttggatttatcgtggtattatttttaattaattttgcggcgcggcgcggggagcgtagggtgggttttaatttcgggttcgtttgacgttatttgggaacgcgcggcggcgcggggcggcgcggattcgggacgatttcgtcgcgatttggtttcgttttcgttcgcgcggggttttgtttcgcgggaattaaaggaaggagaaatgttagtatatttttaattggaaatcgagttttttttttagagcggtttgtttatttaggattgggtattagaatttaggggaggttttaattgaagtgacggttttggagattatggggaatatatggttttatcgtcgggttttttatttgtatttttttataaaattgtcgttcgtgtgtgtttttgcgtttggttttttgtatttttaaggggtttttgaagatagggtcgaatgcgcgcgggggttttaggtattttgcgttttacggcgggtttcgtagttcggttcgagtcggttttggaagtttcgttttggattagattggtatcgacgtcgtttttagtttgagcgttgagagggaaaacgagagttagaaaggaaagaaatcggattggtgattgtttggtaggggtgtaatttaaattgttgtgagtagacggtaggagggagttgttaaggtaacgggtgatttttattcgtcgttttttcgttaaggttggggagagggaagttttcgcgtgttgggttagggttaagttcgcg

SEQ ID NO: 6546 - DNA, 2191 bp, synthetic construct
  misc_feature 1..2191: note = Description of Artificial Sequence: Synthetic polynucleotide
  source 1..2191: mol_type = other DNA
tcggacgcgatcgttcgtagtttgcggtttttggcggttgaggagtcgcggcgatttttggtttttatcgtagtagttaagttcggcgcgtattaatcggcgttgttgaaagttggagagtttttagttcgtcgatagaattcggcggtgggcgttaggggaattttttttagtgtcgtaattaggaaagttttaaaaagtaaggattttagatagataagagatttatttttttttttagtataagaaatatttcgcgtcgcgttagtcgaacgttgttcgtataaggttattcgttttttttggtcgggacgtattcggtgttttttagttttttattagaattggtttagggggcgcggaaatagagaggtaattgtgttcggtttgtggttttagacggaaacgttttcgggttttttggttcgggggataagggttcgaaattttaatagtcgcgagggtaaggatagaattattaattttcgttcggatgttcgggatttgtttttttaagttcgtttcggtttttttaaaggacgcgcggtatagtttatgcgttttcggtattttattttatttttttatggttttttttaaatttttttcggggagttttataaagtatagacggcgttttgaaattcgttaggtattcgttagttatttttattttcgtttttcgaattttttttgtcgcgtttttttcgtttcgtattttttttttcgcgtttttgggaagttagaagtaaattacgagaaaatgttttcgtaaggagtttttttatattcgttttgttattgaaataaaagcgtagggaggagggaggtgggagaggaggcgggaggaaggtttagaaagacgatggggatagtagtaggaaggagttggggaggggggttaaggtggtaagtagagttgggggtttagagttcgttttcgtgtcgcgcggcgagtcgtttatatgtttaggtcgttgtaggtgttgaagaattttatttgattgtacgtttgaatttagtttattatttaggtttcgtggcgggggatggggggtatgattacgcgggcggaggttttgaagtagggggttttgtagcgtaggacgatgggcgaggttttttcgatgcgcgtggggtattggtcgatggtggcgtatatatcgtatattacgatgttttcgcgtcggattcgcgttttgtaggtgatgttttggatatagtttattttgtagttcggtgtcggtacggcgcggcgtggggtagcgcgggggttcgcgcgggtagtcgggggcgttcgttacgtcggtatggcgacgcgtcgttcgttttcggttagatttagttcgtatttaggagcggggagtcgtcgggtatttttggggaagttttttttttttgtagtcgcgcggggttttcgttgtttcgacgttcgtttacgttcgttttttcgtttcggtagggcgcgcggagggtgtatttttaggaggcggcgggtgttttcgtcggttttagcgttcgggcggagggtagggaggggagcggcgttgcgaggaatggtgtttatttcgggtcggagtttttcgtttttcgtcggagaggaggaggcggtagcggcggcggtatggagtcgggggagggcggcggtggtagcgttcggtttgtttgttttcgcggcggtagtagtagtagtcgtcgtcgtcgtcgtcgttgtatgaatttttgtattacggttgtttttcgcgtgtagcgtatttagcggcgggcgagcgggcggtttaagaggtaggcggaggtagtagcggcggcggcggcgatcggagttttcgtcggtttcgtttcgtagtcggattatatcgatatttttcggttcggttgtttcggttcggggggcgttaggaggttgtggttcggggtggagagttttaacggttggagtagtataggacgtgtttcgcggaggaaattggttgtacgttatgagttttgtttttattcggttgtcgttcgggtggggggggggtaatgtgtaagggtgggggtgtttaaagggtcgttagcgtcggggtggggtttcgtacgtggggttgaggcggggcggggttttggtaggtggtgttttggggtgggggtgggggattagggcgggtttaagcgttatcgggtgggtgaggtcgagtagggcgcggcg

SEQ ID NO: 6547 - DNA, 859 bp, synthetic construct
  misc_feature 1..859: note = Description of Artificial Sequence: Synthetic polynucleotide
  source 1..859: mol_type = other DNA
acgtagaggtcgtggtatttggtcgtagttgggttgtagtgcgtgcgcgtttggtttggtggttcgatgggaagttcggggcggggtagtcgcggggcgggggcggggcgtcgcggagataggttacgtttttgttcgttcgcgtaggcgcgttgcgggtcgttagttgttagagttaagcggcgggttggcggcgggtttcgacgtttgcgttaggatttggttggttgagttcggcgtagtagtagtagttagggtagcgcggtttttattttttgttaggtcgtagaggcgagtagggattagttggtcgtcggtttttcgggtaagatggggaatcgggagatggaggagttgatttcgttggtgaatcgtttgtaggacgcgttttcggcgttgggatagagttgtttgttggagttgtcgtagatcgtcgtggtgggcggttagagcgtcggtaagagttcggtgttcgagaatttcgtgggtaggtaagcgcgtagggcgcggagtaaggatgcggtagtggggcgatttcgttgcgggtcgttggaacgtggacgggtagcgggagttagagggtggatggattaggcgttgcggtggaatggggggtagagtggaatggggggtagagtggcggtgttcgtggggcgggcggggttttttagttttgggtatttttcgttttttgttatttttcgtttggtggtttttttgtttgttttttatcgtgcgatataaagttattttttttttgttttttagtcggggagtcgggggaggggttcgtttcgggttcgatttttattttttcggtgcgcgttagtttcgggtagtttttttgcgtagcgcgtcg

SEQ ID NO: 6548 - DNA, 791 bp, synthetic construct
  misc_feature 1..791: note = Description of Artificial Sequence: Synthetic polynucleotide
  source 1..791: mol_type = other DNA
tcggggtattcgtgtgcgcgcgaggattttttttgtagagaatgaaattatcgttttttttcgttcgtggtttatttcggggtttttattttacgtaagtgttgtggaatttcggggtgatgagtttcgggggaagttagtattttttgttttttagtgtcggcgttcggtagagtttcgggatttttagtttttgtcgtcgttgaggacgcggcgcgggttgttggtcgcgtcgtcgagggagggttcggatagttttgtagcgcgttttagcggagttttgggggtcgcgtcgtttttttaaatatgatttagaatcgttcgttagttttggttttagcgtttggcgcgagcgaatcgggtttggttgtttcggtttcgtttgaattttgcgggtcgcgggttagggcgcgtcgggattcgttgcgttaggattttgtagattcggtcgcggtcgggtcgagtgtttttcgtcggggttttacgtttacggtttacgtttgtaatattagggttgtacggcgggttcgtagttgggtttgcgtttgggattcggggttttttgcgtttttcgtgtcgtattttttgttttaattttaagcggacgggttttggggttttatcggttaggtcggagttttagttttataatttttttttttttatcgtattgttttttttgcgttgtggcgggagttggggattggggtcggagaaaggagacgcgtcggtttttaagttttttgagttatttcggtttcgggcgcgttttttagggttgtagtcgcgcg

SEQ ID NO: 6549 - DNA, 586 bp, synthetic construct
  misc_feature 1..586: note = Description of Artificial Sequence: Synthetic polynucleotide
  source 1..586: mol_type = other DNA
gcgaagaggagggagtttcgaaaggagggaaacgagtcggtaaggggcgataggagcgagtcgggaagggagagtagcggagggttgtagagttgcgggcgttcggatcgtgttatatatttttcgcggggtacggagggtattgcggggggagatatataaagatatgcgaagaggggttgaacgaggttcgcgtataaagacgtcggggcgtacggtagttggggttgtatttatcgttttcgcgtcgcgtcgtgtcggggtcgggttagcgagtagttcggggttgagcgcgtggcggcggcggcggcggcggcggcggcgggtaggcgcgggattcgggtcgttcgcgtttttcgggtgattcgggttcggtagtaggcgcgcgcgggggcggcggcgtttaagtttaatttggttttcgtttcgttttttgtttagttcgtcggtgttttttttttttcgcgatttcgtttttttttacgttttttttttcgttttttttcgcgtttagtttcgttttttttattttgtaaaataaagtcggggaaaatgtttgttcgtgtagttcggagcgcgtagttcg

SEQ ID NO: 6550 - DNA, 1678 bp, synthetic construct
  misc_feature 1..1678: note = Description of Artificial Sequence: Synthetic polynucleotide
  source 1..1678: mol_type = other DNA
tcgataggcgaaattgtaagaatcgggaggggcggttgcggcgtttaggcgcgaggtatatattatattttttcgtagttttttattttttttagacgtacgtgtttaaagagtttttgttttaatcggtttcgttttattttcgttcggtttttagttttgtttgtattgttggttttaagtttttttcgagaggcgggcgtgtatagttgtagtggcggcggtagcggttattaagcgttcggcggcgtttcgttatttatttttttttagttttcggcgttgtagttttcgttcgtcggggagggcgcgtttagcggaataggagtcgagggtggggcgtcgagaggagggaatttcgggtcgtatcgttatagttttcgtagtggtaaaggcggcggcggcggcggcggtagcggtagtagtaggtggagcgagttatagcgtttggtttgaaatttattgttgtagttattcgggttggagttggttcgttgggtggagttagtgttcgtttcggttcgattttcggttttcgggatatttgggttgcggaggtcggttggtcggagttacggttggggacgggcgcgtttcggagcgtacggttgcgttggaagtcgcgtttggggcgtaggattaacgggatttattttttttcggttatttaaagattttttttttcgggaaagagcgttgttcggttttgggatttgggaggagttcggaggtcgttcgggtatttcgttggatattattcgtttgcgtttcggtggcgcgggagggttcggagcggagcgttcgtttttttttagcggtttagtggagaaaagtagagagttttttttggggcgaatgggattttttttttcggtttttcgtggagtcgtcgtatcgtttgtcgtgttggtttcgaggggtttatagtttggtattaatttgtaggtgttcgttgttgatttggtttttttttcgatttgcggacggttttttttagcgattttcgatatacgtttttttgttttcgtcggagggtcgggtttggggtcgtcggagtttgcgggaatttagcgtttattcgttgattttcgagtcgtttcgttagttgtgcgtttttttgggtattagtttggagaggagcgtgtagacgcggttttttggagggagtgcggttttttagggaggtatcgggtttttaggggttttttggcgtgtgtggtgggattggggttcgtcggttatggtttttattttcgttgcgttttgttatatgttgtttttggtgttgtgcgttgcgtttatttttttcgttatttggtacgtgagtaatacgttttggttttttttttttcgttttaatttcgttaaattttttcgattttattttattttttttattttgcgggcgtgggcgaatcggaaggttggattttttgtcgttttattgtttcggggtaggaggtagttcgttgtatttcgtcgggcgcgttttcggtgttttggttggaggcgaggggtcgttggtgtttaggtaggatattttttgtagggttcgattgggcgtttcgggtttcgggcgtcggggagtggcggttataattataattaatttttttttttttcgtttcgtttttttttgtcggcgggaggcgaaggagaagcgtcgtcgtcggtttcg

SEQ ID NO: 6551 - DNA, 1600 bp, synthetic construct
  misc_feature 1..1600: note = Description of Artificial Sequence: Synthetic polynucleotide
  source 1..1600: mol_type = other DNA
tcgacgatattgttattggaaaagtgttggttacggttttcgttttattttttttatttacgggttcggagtttttaggagtagttagatcgattatcgtttttgtagttttatttgttttcggagagatatttataagttagtttacggagagtttggattcgttcgttttagtatttacgtttttttcgcgttcggttttagcgtcgttttcgatatttattcgcgggtagttttttatcgtcggtattttcgaagcgcgggggcgggcggtttcgtagcgttgcgttttagttcgcgtcggtttcgttttttttcggtttttgtgcgttcggggcgcggggcggtggcggggcggtttttgggggtttcgggggttcgcgttcgtcgttcgaggaggcggtcgaggaggagcgcgaggcggtcgaggtgttgtagaaggggttttcgtcgttgttcgggtcggattcgtcgaatacgtcgttcgagatgtgtaggttttcgtagcgcgcgcgggtagtttcgagtagcgtcggcgttttttttcgcgcgttttcgtcgttttcggttatggtttcggtcgtcgttcgcgcgttcgtttttatagtgttttttagtcgtatacgtcgggttttgggttcgcgtcgcggttcgtcgttttttattagcgtagttcgtagtatagcgttcgtcgtttcgtgttcggtcggttcgtcgttttggtcgtttcgggtttagcgttcggggaagcgttttcggagttcgggcgtcgtaggttgcgggtcgcggcgggaggcgagtcgcgcgcggggttggtaggggcgatttagagcgggcgggacgtagaggttgcggtcgagattaggcgtcgtcgtcgttatcgtcgttattatcgttattatcgtcgtcgttgtgttttttcggcgttcgtcgtttttttgttcgttttttttacggttttcggcgttcggttgtcgattttttcgggcgcgagtcgttagaggcgggttttgtcgttttttatttttcgttcgtcggttaatggggagttcggttcggatagtcgcgggggagttgggcgggttcggcgcggggaacgtttttattttttttcgcggggcggggcggggcgcgcggtcggggttggcggttagggggagggtcgtcggcggtagtgtcggtttttttttatagggacgcgtagttcgggatcgttacgcgtagcgcgggagggggagggcgggatcggggaataggaggggagggggattcgggtgtttttagcggttcgggttcgcggacggagtgcgggtcgatttcgtttattgttttttttcgtagttcgcgtgtagttttagggagttgttcgtttcggtggttttgaattaggcgtcgtcgaaacgttttaggtaggcggcgggttcgaggttattatattcgcggcggcggttgttgtcgaggttttttgggggttattgttagttgcgtcgtatgtttttataaatataggggttgtttagtttttgggaatttcgttttaattaggagttcgtttcgtcggtttattgttggtcgttggttagatgttaatttcgtttcg

SEQ ID NO: 6552 - DNA, 2394 bp, synthetic construct; identical to SEQ ID NO: 6541
  misc_feature 1..2394: note = Description of Artificial Sequence: Synthetic polynucleotide
  source 1..2394: mol_type = other DNA

SEQ ID NO: 6553 - DNA, 1160 bp, synthetic construct
  misc_feature 1..1160: note = Description of Artificial Sequence: Synthetic polynucleotide
  source 1..1160: mol_type = other DNA
gcgcgttcggtgttttaaggtttttaggcggagcgcgggcgcgaggtgcgggtttcggggcggagcgtacgttcgggaggcgggaagtgggtagtagcgttttcgtttggtttttgtgcgtttcgattcgacgttttttcgttcgattaggtgtttcgagagcgtatagttgggagggttttttcggtcgcggcgagatttacgtttgcggtgtgttagggcggcggcgacggtgacgggcgtggggcgcggcgttgtttcggttgtcgggtcgttgcggcgagcgcgcgggtcggtttggagttatcgggttgaatcgtcgcgtttgtatcgtgtcgtacgtcgcggaggcgttcgggtatagatcgcgcgggcgcgtataaagcggttcggggcggtcggcgcggcgtagattttcggtgggtagcgtattttagtttttttaggttagcggttgtagggagtttcggttcgcggttttttcgttttaagtttgggagttgtcggttttattttgtttttgtttatggggattcgagagttttttagcggcgtatttaggggtaagagtattgtcgtgtgagtagcgtttcgggcgtgggtgagcgagtcggcgggcgggaggtcggagcgtcggggtagttttttgtagttgggatattgggtagtttgaggttcggggaagggcggcgcgcgcggtggagttgttcgggaagttttagttattttttttttcgttattcgttttaattcgtattgtttcgagacgtttaggatagggtattggggatagttgttcggggaagtgggtgagtggcggcgggaagggaggagcgcgggttttgtcgcggcgttcgttttcggagggtttcggtcgcgtttttgttttcgttttgggatttgttttttacgaatttttttttttttgtttatgttttttttgtttatttatttgttcgtggcgtttgcgatcgtagtggtatgaggaggttatcggacgttagttttcggagattgttcgatattagtttttagtttcggtagtttaagtatttggtggtggacgaggcgattaaggaggatttgaaatggtcgcgtttcgtggaggattttattagcgggtcggtggggtttacgtttatcgaggagcggattttgcg

SEQ ID NO: 6554 - DNA, 588 bp, synthetic construct
  misc_feature 1..588: note = Description of Artificial Sequence: Synthetic polynucleotide
  source 1..588: mol_type = other DNA
gcggggttgggcgtttcggggaggagggcggagtaggtgagttgcggggtgggagtagggagtgtatttgtacgtgacgttggagtttgtagtaatttttaagtaggaggttgtgcgcgcgtgtgtgtggagtggttgcgcggtcggggaggatgtgcgttgtagggcggtcgtcgtagtgagtaacgcggtaatcggagttcggcgggtagtcggggaggtcgggattgagaggggcgagtcgttggtgtttttcggcggtagagggtcgcgtcggttacgggttcgggagagacgcgttttagtcggttttaggatgtaggcgatcggcggtagcgtttttgtaggcggtcggtttattatgaagaagtattcggttcgggtggtttcgtttagcgtttgtaatagttcggttttgatttttattaaagtggaaggtaatgcgcggtcgtttcgtttcgggggtttttgtattttagtcggggaatgttgttattttgaggggggttgtttggttgcggggcgtcggggttgggggtattgtttttttaggacgcggtttcgtagtgtagagcgtcgtcgtttgcg

SEQ ID NO: 6555 - DNA, 878 bp, synthetic construct
  misc_feature 1..878: note = Description of Artificial Sequence: Synthetic polynucleotide
  source 1..878: mol_type = other DNA
gcgattcgcgattgtagtcgttttttaaggttagtttttcgttcgtagtttgtttcgggcggtagtcgtgttagtttttcgttaggattcgtttagggggacgtgggtatcgggtaggacgcgcgttttgggcgttggggacgttcgggatattcggggtttcgttttgcgttttagtttcgggtcgcggtatttcggttttcgtttcgcgtttttggagggaggtatcgagggacgcgtagcgaaggggttttgttaattgttaaagtaggaagtgagttcgtggaagaagcgaaggaggagaagaagaagggaggggaaggcggaggagggtaggggcgcgtagagttacggtttgttttaggcgcgtcggaatcgtaggattttttattttcgtggttttacggttttttcgcgtttcggaggtttgttagtttcgttcggacgttcgtttgtttttaattcgtcgttatggttttatcggacgattttttgcgcgtaggtaaagggatatagcgtcgcgttcgtttttggagcgagtatcgcggggcgggagttcgggaggcgttcgtagtagtcgtagggttatcgaggtcgggtttcggcgattttcgagggaggttcgggaattattttcgatttaggcgttagattcggagtcgtacggggtttttagtttagtttcgcgagcggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcgtttttcg

SEQ ID NO: 6556 - DNA, 561 bp, synthetic construct
  misc_feature 1..561: note = Description of Artificial Sequence: Synthetic polynucleotide
  source 1..561: mol_type = other DNA
gcgcgggtttacgttggtcgttagcggcgttaattttatttattcgttaatttgttagtttttggattgagtaaaatagtttttaaagacgcgggtaaacgtcgttttaaagtttattattatgtaacgttaggttgttcggagttacgttggtggtatttttttttcgtgtttattttgtataggtatttttagaatttcgtgtaaatgaattttatcgggagacgtaggtgggtaggtcgggtcggtagggattaagagtttgaaagggaatttgttttttttttttcgtagttcggttattaaggtaagaaattgtaggtagagaagttttcgaattcgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacgttgttgtagaagttcgcgtttattcg

SEQ ID NO: 6557 - DNA, 1235 bp, synthetic construct
  misc_feature 1..1235: note = Description of Artificial Sequence: Synthetic polynucleotide
  source 1..1235: mol_type = other DNA
gcgatcgtagggtttcgtttattttttttttcgggatagtttggatgggagtagttggcgcgagggttcgttttttcgtttttgggtaatttttttggtattgggagacgagatggttttcggagggtggaaggtagtgttagttcggtcggttattggggattgcggggttcggagacgcgcggggttttcggggagtttttcgtcgttttcgttttatttcgttcgggttttttaaatatgtcgtagcgtggttgtttattgttttttttgggtaagaggaggttttagatatttttacgggatttgaattttcgagcgttttgtacggagtagttatttcgttagtattttaaagtgaagttgtttataacggataagttcggagattttatgagaggtcggggtggagaagtcgggggtgaaggggggtaggggtcggcgcgttacgcggtttttattttttcgtttggattttcgtttttttttttttttggatttgtatttgagttgattgtttagttttttagattttttgtcgttttttaggatcgaggttatggtcgagatttaggcgcggagtttagagtcgttttttttttgtatttgtatttgtttttttttcggtagtcgtcgtcgtcgttgttgcgaagtttgaggttgtaaattcgggagcggtttattttttaggattgagtaggaaagcgcgtttcgtttttttgtttttcgaattgttttttatgatttgtttttattgggttgggggtttcggttgggcgtttggagcgagttgttttttggttagggagggcggggaagggcgcgcggcgttttgagtgtttcgagtttttcgcgggttttgttttttgttttgggtttttagcgtagggaggttatttttgcgtttttgttagttgtttggtattagttattttgaagttaattacgtagggagtttgtttatttgttgtagtagcgtttaattagatttaattataattgttttttggttttgatattagtagtagtattagtcgtatcgtcgtttggtcgtttgtaaatttagttttcgtttggacggtgaagtttttaggatcggcggttggagggaggttgttttcggggaataaggacgcggcgcgggtgcgtttgggagagatcgggggagtttttaggagggattttgttcgggaggacgaggttttttgtcgtagtttcgcggatagtttagttcg

SEQ ID NO: 6558 - DNA, 5964 bp, synthetic construct
  misc_feature 1..5964: note = Description of Artificial Sequence: Synthetic polynucleotide
  source 1..5964: mol_type = other DNA
gcggtaatcgagttagatttaagaggggtcggtttcgtttaaattggttttttattaatggtttcggattagtcgcggttgtgttgcgggagtttttaggacgcggttggggttggtgcgcggggtttcggaattttaaattcggttcggttcggtaaggtttagggagataaggtagagaaggttggggtgagcgagaagtcgggcggtcgatcgttagggttacgagtttcgttttgtttttttggaattttatttaattttaaaggtttaaagattttgaaaatttcgaaagcgaaattgcgagttggtttttagaagtttgagaacggttttttaggttttttagcgtcgtttcgggattttcggatattataaacgttattaattacgagtatcggtgttcgtggttattgtttcgaatggtttttattcgcgttttcgggaattttttcggtttttcgcgtatttaggtttttagttttagttattggtgcgtttcgagtttttaggtgttagagcggtggtcggtcgggtttttgtttagtttcggttttttttttttttttattagaaggaaaaatttgggtttttcgagaattttgtggaatgttttttgtaattaattgtatattcgtttttacggtacggtttcgtgtaaaatcgcgggtttcggggttttggagtaaattgcgtttgttagcggcgacgttaggaggataaggggaggggttcgcggttgaaattgtagtttcgtagtatagagttattttaggttgttttttatttcgcggggtttatgggaaagtcggtttcgggagggcgcgtttaaacgtaggttggaggagttacggacgcgttttggtcggcgtgtcgttatcgtttagtttcgttgtttaggtgggaggggttatttgtcgcggggtttttaagttagtgtcgtttgttttcggtttttatttattgatagtacggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcgtttgttggttttttttttggtttttttgtttgatttcgattttgttttcgaattttatttttagatttttttcgttttggaacgtcgatttttttttcgtatttcgtcgtttatttatatttttcggcgattgttcggtttttatgttcgttaagataagaagatgttttttttcgatgcgtcgagagggtttttaagtcgagtaagggataattttttttttaaacgttgtttttattttttattttttttagagcgcgaaatttaaaagtaaggaaggtaatttttcgtttcgattttacgtgtttgttttttagagtcgcgcgttttcgtttttttgttttattttattattattattattattttggttttttttaagtttcggtttcggttttttattttttattttagagcggcgtggaggaaagtaggagtttattattaagtgtagcgcgttttttgtatatacgaaattcggttggcgtttgtagttcgattgtatttaatattcgggatagttagtttttttaataagtattttttcgttttatttattcggggatttattcgcgtaggatttagtatatataaggcgagagttagttcgttttttagaaagataaaataaattattttttttgtttttatgtattttatattacgtgttcgtagtttgttacgttaaattatggtagggtttggttttaagacgtatatatatattcggggtggttttttttgatatatatatttaaaaaaattgcgtatacgtaggtttgtatattaatttataggtatatacgatagttgcgtttcggtgttttggttcgggttaggggtatttttttattttttttttttttagtaatggatttgatatatagattttaattacggaaaaaaaaaatcggatagtttattttttttttttttttttatttaattcgttaaagcgttttttggggtagttaaagagagtcgaaattaaggggtggaaattttagttgggtttttttttattttaaaatttttatttttagtttttaaaagttattttagttcgttatattgaaattggtacggtttttaaagatttttttttcgtagttgtggcgtttttaagaaaatacgagtacggattaggttttggatgagtgttcggttatcgagaattagttattttttattttttaggattttttagttttttttagtttttttttatcgtttttggttaaaattaataaatatatttcgtagtttttatagttgtattttggcggatttttgtaaaatatatatatatatatatatatttacgtacgtatattaaaaaataaattttagaattagtttaagttagtaattttgaaagggggtcgaataagaggagataatcggaaagtttttaagtgataggatattattttaaagagaaaataatgaataaaaagattattttcgttggagtacgttttaaaattattattgttaattttattttagttgtttaggtaaatgtttttaagggagcgatttcgaatgtttgtacgatttttatttttatgtcggttttcgatttttcgtttttattattttttttttttatttaaattaaaagaaaggggagattttagcgcggaggagacgcgggagcgcggggtaggtagtagcggcggttgcgtcgttaaaatgagtgtagaaacgaggaaggtgggcggcgggaggggataggttgcgttcggggaaggaggatattttgtaatttcggacggattttcgtacggttcggttttttcgagttcggagacgtaggcgaaggggattcgggaagtaaaaatgataatttggagcgtatagaggagtttgaagtttcgtttaagtgtagtcgttttttttttttgtttttttttttcgtttttttgtattttttttagtttttttttattcgttatttttaattttagtttttttaggtttttttttttttttttttttttttttttttttttaggttggaaaaagtttttgattagcgtatttaatttgcgggtcgaagggttgtttttcggttagtttgggcgtcggggatagtagtcggcgcggcgttttatttggtgaagttcgttttgttttcggcgtggatttaggtttcggtcgtcgttcgggagggtatcggtttcgttcgtttgttcgttcgttcgtttttgttcgttcgtttttcgttcgtcgtttttttcgcgcgttcgtttcggtttttcggtttttattatagtttattttaatatggtattttttttgtgcgtatgttcggcgtttttttttttttttttttttttttttttttaagattttgtgtgtgtgtgtatgtgtgtgcgtgcgcgtgtagcgaatttttttaacgattttttttagcgtttgtaaaattttttaagttaattagtttgcgggacgtgatcggttttttttttagttagtttcgcgttattttttgcgtttaagtaggcgggtatttttaggattttgggattttttacgtttacgcggttttttttttatcgcgttttttttttttttttttgtgagttttttttatatatgatttgtagaaagtttttatcgcgggcgttttcgtatattttttcgtaaggataattgggtaaattttcgtttttttggttgcggttcgtgagttgggtttttaatggtttagtcgatcgtgtgtataaatttgcgttttattcgtcggggatcgttgggagcggagataaatttaatttttagggtaattttggtttcgttcgttttattttattttgtgtttaaatagagttttttttgaagttgcgaatatttttaggttttttgggtagggttggaggggtcgaggagagttattcgagggaaaggtgtttcgaggggtaggaaattaagttggggttgttcgggcgagttgttaggtagtcgtgttcgttacggcgttttatggggtatttagttagtggcgggttttatagggcgggaaaagaatcgtcgtttatattttagtaaaacgtggttttcgacggttcgttggagagtttcggcggtcgtgagtttcgggtagggttggacgtttgcggagttttcgggtattttgtttcgggcgtttggggaggaacgcggagtttttagggttttaggtgtaacggttgcgtagagtttaaacgaaatgtttttagtgcggaaaagtcggtgacgttttggtagtaagattaagagttttcgaagaacgttgcgtttttaattagggggtttcgtagagatgtttgtgtgggtttgtattgtatatttttgcgaaatagcgaatggatacgtttgtttagggtttttatggttgttaaagggggtaaaattatttagttttttaaatttgtgttttatgaattttttttatagtatttttttttagggggttaagaggttttttaggttttcgtgggttcgtagttttattcgttttttttcgttttgtatttttaaggagaggtgttcgttttgaagggttaggggttagttatggagtgaggggatcggggttgattacgcgcggtatagatagaggtttttaggcgggtttttttttggacggtggggtcggagttgatttagaagaaatacggagggacgtgtcgagaagtcgttttttttcgtcgcgattttggagagcgtttttttatttaaaggatttgtcgagttgagagatttagggcgggcgttcgtagtcgtgaggttttttgcgtcgttagtatgggaagattttgtttttttatattttggagaacgttgggcgacgattaaagcgtttttcgtcggtttgttattttatgtgatataggagttacgtgagatttagaagagtttagcgattcgtcgcgcggcgtattttaaattttagtttgagtttgcgatttttttagttttttagtttttagttgttggggatattaagtcggagttttgggttttttgttttgtgggtcgttgaaagtagagattttttaaattaatcgaatcgggcgtattaattttttcgtttgtatttcgttgtttttcggttgagtttcgaggcggttttaggtagaatttgttggattgattgcggcgtttagaaatttggagtgtgggttttagatattttttacggtttggtttcgggttttaatatttaagtcgttttttttggtttttttattatatagcggggtttgtggaaagggaggggtcgagagattcgtcggcgtattattgttttcgaggggtttttattttgtgtattgttgaagcgtagggcgcgtcgcggtaggaatggtttcgagtgcggattttttgttttgagttttttatttttggttcgcgttgcgtttatttagtggttttggtttcgtagggcgatagcggttgtttttttttatttgcgttttagatcgcgcggtttcgtttagttttcgggagtcgataggcgtttgttttggtgttagcgtagggtttttcgggggtttggggtaggggtaggggtgcgggggggaaggggagaacgtaatttttttttgtaggagtcgtggagacgtgagttgtaattagttatcgcg

SEQ ID NO: 6559 - DNA, 5964 bp, synthetic construct; identical to SEQ ID NO: 6558
  misc_feature 1..5964: note = Description of Artificial Sequence: Synthetic polynucleotide
  source 1..5964: mol_type = other DNA

SEQ ID NO: 6560 - DNA, 5964 bp, synthetic construct; identical to SEQ ID NO: 6558
  misc_feature 1..5964: note = Description of Artificial Sequence: Synthetic polynucleotide
  source 1..5964: mol_type = other DNA

SEQ ID NO: 6561 - DNA, 703 bp, synthetic construct
  misc_feature 1..703: note = Description of Artificial Sequence: Synthetic polynucleotide
  source 1..703: mol_type = other DNA
acgcgaaataaacgattttaggtttttagtaaagaagtagcggcgcgtttttttttttcggtttagcgtgaaaatacggaaggcgaagggttgtcgttagtcgtttttttgttatcgcgatcgggaaataaagatatattattttttattttttgcgtttttaagggattcgaggaatttttggttgtaagcggttggtatttcggaacgggcgttttattcgttcgggcgaaggtttttggtttattaggcggttttggcgttcgtagttggcgagttttcgtttcgttttcgtcgtcgttttcgtcgtgggttttcggcgttagtttatagttcgttcgcgtttttcgcgtcgagtttggttcggcgttagtgagtttcgtcgtcggttcgtttttcgttcgcgttcggttcgtcgtatggtgcgtttagcgcgtttcgagttagttttcggcgcgttgttaggtcgggtgttaggcggttatcgcgcgttatcgtcgtcgttatcgttcgtcgttcgattttggataataatgcgcgttttcgtttttttagaaagttagggacgtttttagtcgtcgttagagttggttcggttttttagttttttttcgtggtattcgtaggcgagataaagttcgttttcggtgaggttgcgcgcgtttaaagcgtgcgggatgtttagtacggaggtttttaagcg

SEQ ID NO: 6562 - DNA, 1315 bp, synthetic construct
  misc_feature 1..1315: note = Description of Artificial Sequence: Synthetic polynucleotide
  source 1..1315: mol_type = other DNA
tcgcgttttttttaaatatacgtatatttttatatttattcgcgtcgttttagtttgtttatttttaacgagtttaagtcggtgtagtcgcgttttatgttcggttcgtagttttcgagttttagttcgttcgcgttgggcgtcgttgtatttgttagtggcgcgcggtatcgcggtcgtcgggtttcggagcgtttttagcgttgcgggggtgtcgtgggtggtttttttgtttttttttattagaattttgtatagtcggggagaaaatttaagttgttatatttcgtcgggagttgttggttgaaaggttgggagtcgcgttttttgtttggtagggagatttcgtatttttcggtttttaggttaggtttttagttttagagttggaagagttttagggcgggaaggaagagatagtaaggattagaatggggagtatgagattttgatgcggaattcgacggtaggtttcgttttatagttgtttcgtttatagcgatgcgcgttagagttttcgtagttttgatcggtttttttgttttttagtcgtcgtttatcggtcggagggtcgtttttttgcgatttttttttttattttatttttaggtcgtcgtcgttcgtgggttgtttttcgtcgcggttaaaagttttcgcgttcgaggggaagcgatgggcggtttgggggttcgggggcgttaggcggggcgcgcggcgcggggcgcggtcggcgggtgggtgggttatttggcgcggtcgggcgcgtttgtcgggtattagagtaggtgtagtagtagtagtagtagtaggttggcgagtagggcgagtagtgcgtttttcggtcgtattttgagttataggcgtcgtcgttatcgttgttgtcggggcgaagtatagttcgggcggtttcgattcgcggttttcgtcgtcgtcgttatcgtcgtcgtggtcgtagtttcgcgtatttatagcgtttataggcggtagcgaggggcgttcgtagtttattcggtagagttttcgcggcgggcggagaagaagtcgcgttcgggttcgtttcgggttttcggtttcggttcgcggagcgtcgcgatcggttggtagatgacgattcgtcgagttcgtcgtttgttttttcggaggcgttcggagttgttgcgggtttcggtcgtcgttgttattgttgttgtcgtcgtcgtcgtgcggggttatttgaaggttggggcgcggaagtttaatttcgtgttgattgggttttaagttttttgcgttttcgtttcgtttcgagtgttcgcgaatttttcggacgtttacg

SEQ ID NO: 6563 - DNA, 1316 bp, synthetic construct
  misc_feature 1..1316: note = Description of Artificial Sequence: Synthetic polynucleotide
  source 1..1316: mol_type = other DNA
gcggtcgtcggtttttagttttgggattattttggtttcgatacggagtgataggggatttttacgcgttttcgtatttagggcgtttttttagttgcggcggaggtatagagaggttttggcggcgttgtggtttcggtcggtatcgggtttcgcgtagtcgggttttttattttgagtggagttgttttttaagtatttagtttttgttaattattgtgtttaatattaagttttcggggcgttttgttttgcgttatcgcgcgttcgttcgttcgttcgtttaatttatttgttgaagattaggtagtttaggtggttgattttgtggtcggagcggtggcggttgtagtttttttataggtttttgaaggtcgtgatggttaggatgaagagtatcggcgttagtgttaggtcgggttggaaggcgtttatcgtcggtacgaagttgagtagcgcgatgaagataaagtatacgttggtcgggcggtggaattgttcgaataggtttttgggtaggaaggatagtagcgtgtatttggtagttttgagtcggttgtcggttaggtgttgggtatattcgcgtcgtcgtcgtcgttcgtttttggtcgcgttagtcgtagggttttcggcgttcgggggcggtagtaggttggagcgtatcgtgcgcgttttgttttttcggcgttttcgtcgtttcggaggttcgggtttttcggttttcgtcggttttcgttttatggtcgcgtgtcgtcgcgttcggttttttcgtcgtttacgttcgttcgcgtcggttttttaggttattattattcgcggttcgggcgcggcggtgcgagtttttcgtttgcgggacgtacggagatcgcggttagcgcgtcgtttggtcggtttagcgcgtttagttcgcgtttagtttcgtttattttcgtttagtttcgtcgttcggtcgtagtttttagggcgtaagttgggcgggtgtcgtatagagtttttttgttttcgtcgttcgttttcggttcgggtcgttttcgtcgcggtggttacggtttcgttttcgtttcgcgttcggattgggttacgtcggatagcgggaaataaaaaaagttcgagttggaaattttagagaggtttagtttcgttttttagaagtattagttcggttttaaaacgttgtaaacgcgcgttgtttgtagtaggagagaggaaatcgcgaagcgcgagaaaaggcgttttcgtttttaagtagttcgcgcgtttttttaggggttagatttgttttattttggacggcgaaacgatttcgggagatttcg

SEQ ID NO: 6564 - DNA, 1110 bp, synthetic construct
  misc_feature 1..1110: note = Description of Artificial Sequence: Synthetic polynucleotide
  source 1..1110: mol_type = other DNA
gcgtcgggtttggtttttgtggtttcgtaaattttttagtttgtgtgttacggcgacgcgtagcggttgagtcggagtttacgcggcgcgcgtttttcgcgaggaatttttcggtttgtaggttgtttgttattttcgtttttcgacgcgtttttttttggttcgcgttttcggagttttttttttttttggcgaggatttttttcggcgttcgcggtttcgattttcgtcgcgttgcgttcgttttttcggtttcggttgtttcgttgagggttttttttttttaggtatcgtagtcgcgttttcgcgtttcgtttttcgagcggttcgtttcgttcgatgtttcggtttcgtttcgcgtattgagcgtttggtagtagggcgtcgagtttcggggcgttgcggggcgttgcgtcgagaacggtcgggtttgagttttgggcggtttttagagtcgattagagcgcggggaggcgggggcgaggaggaggggattcgtcgtcgggggttggttgtttcgtttcgagtcgatttttcgttaatggtttaaagggatatgtttaagtcgttttttatagcggcggcggcggtggcgtaggagatttagatggaattgttagagaacgtggttttcgcgggggcgttcggagtcgtcgtataggtagcgagagcgcggcgtttttttttttttttgtgagtcgtcgggtagggtatcgatttcgggttttttcggcgtttttattgtagggatttttagtttcgtatttttttttttcgtcgtttgtttattttttgttttttttttggcgtcggggattttgtttttttgcgtttttttttggttttgtttcggtttttatttttttttgttttcgaaaagttagtggggaagggcgggggagatttgttagtttttttagatttttttcgggttgttttagttggtttttttcgttttttttcgggagaggtatatggagagatatgaattaggggagtggattggatttgttgaagatcgtgagttcgggtgggcgggagggggttcgtttttcgtagcgttttttacgatgtcgatttttttggttacgtttcgagtcggggtgggcg

SEQ ID NO: 6565 - DNA, 1655 bp, synthetic construct
  misc_feature 1..1655: note = Description of Artificial Sequence: Synthetic polynucleotide
  source 1..1655: mol_type = other DNA
tcgttttcgttttcgttgatattttgtaaagtcgcggcggtagcggcggggattacgttgcggtgtattatttttcgttattttttcgcgttgggttggggtcgagggggtttcgtagagtcggtaatcgaatcggttttggtttgttttttttattttttagttattattagaattagttttcgcgaaggggcgagttgtggttaattttttcgtgtttagggagatttcgttagggtcggggcggggcgcgatcgtttttcgtagtcgggcgcgaaggcggttcgggagttaggtgggtgtggggcgtagttggcggagttgtttagggcgtgcgagtaggttgcgaggatggcgtttcggcggcgcggaggtatcgtttcgcgttttttcgatagtttttcggtttgtttttttttttcgcgttttggggtagtcggttgtttggggcgtacggggttggagtggttttttttttttttttcgttaggttttttcggtttaatttgttggtcgcgattttttagttagtttcgaggaaagtgtagttattggataggtttgtgcgggttgtcggttttagggaggaaggtgggagaagtttggaggagcgaaggggagggcggagggaggagggaggagggtgcggcggtagatttggtaaattgcgagttgttttttttttttaaagtgtggagaaggagcgcgggggagcgtggcgacggtagcgtttttttcgttattaaatttttggggtttcgcgggggtttggggttatttttttttgagttcggaggaattttttttcgataggttttagcgtgatttttttttattttattttttttttttttttttttttttttttttttttttttttaaatatattttttttttggtttcggattttagattgttgtagttttaatttttttagggtttagttttttggagttgtttattttttcggttgcgagaaaggacgcgcgttttgcgtcgggcgaagaaaagaagtaaaatttgtcgggagggtttcgttattaatttttttttcgtaaatttaaattttttgtcggggttatttttagatagaggaaagtttttgtagagtcgattagttttagtggatttggggtaggtagcggcgttggttgtggaattagatttgttttgaatttagtggagcgtatcgttggggttcggaagttatcgttcgcgggtatcgggttggcgttgttcgagtggaatcgatagtttgcgagtttcggttgtaagtggtttttttttttcgcggttgttgtttagtgtcgggtgagggttgcgagtgtggtaagttgtaaagagagttttagaggttcgaagagcgttgcgtttttattcgcgttcgttttttttttttttcggttttttattgtgaaatcgtagcgatatttataaaggttttcgggttttatcgagatcgattcgtagcgtttggttcggtcgtgtttattgtatcgggagttttcgagtatcggcgaaggattggcgggtggggtagggaggtggcggcggcggtatggcgaggttttcgaaggtcgatttggtcgttgtaggagttatgttattttgttatttttttacggattagttttagttcgtcgatgggaaattcg

SEQ ID NO: 6566 - DNA, 1655 bp, synthetic construct; identical to SEQ ID NO: 6565
  misc_feature 1..1655: note = Description of Artificial Sequence: Synthetic polynucleotide
  source 1..1655: mol_type = other DNA

SEQ ID NO: 6567 - DNA, 304 bp, synthetic construct
  misc_feature 1..304: note = Description of Artificial Sequence: Synthetic polynucleotide
  source 1..304: mol_type = other DNA
gcgggcgttggaaggggggcggggtaaatgcggtcggcgtagaggtggggagtaggtgggaaaggtggaggcgggttcgtttttggagatttatttttgtttttattgtttttcgtttgttagttttatagataggtttgaacgcgtagagagttttttggagtgttttgattttgttttcgagagggtttttaattttcgtatttttttagtggttgttttggtaggtgcgcgttttgcggggagttgcgtttcgggggttatcgtcgagcgggagttgttttttggaattttgtttatcgcg

SEQ ID NO: 6568 - DNA, 1666 bp, synthetic construct
  misc_feature 1..1666: note = Description of Artificial Sequence: Synthetic polynucleotide
  source 1..1666: mol_type = other DNA
gcgtattttttttcgatcgttagtagtataagtggcgatatttttatggagcggtcgcgtcgtagtttgtcgtatttagcgcggacggtttggtcgcgcgttttttcgttcggacgatcgggcgcgtttgatattaatagttcgcggtttaggtacgagcgggcgtcgtatttgatttaatttaatttataatcggtcgcgtttgtaggtgtcgttttttgaaatcgttatttaggcggtcgttgtttatttttcgttgcgtcgcgggttttgtagaagcgtaagaatggggttgattatttcggtgtttatatgtcgtttttatacgtttttattttcgttcggcgtaagattttttttggttaaaagaggcgtttaattagttttggggtcgcggagagttagcgtggtcgataaagttcggttttttaggtaattcgggttttttgcggattcgggagggggcgcgcggggtcggagtatcggttttgggttgcgcgtttttttcggcgatattgtcgtttttttggttttcggttcggtttttcgtaggttaaaggtttatttgtcgggtttgggtggttcgggttagcgtcgtttgcggttttcgagtgcggttggttttaaggtcggcgtttttttttcggtttttagtgtttagagttaggttagcgggaaagaaggtagtatggttcgtaaaagataggtggtagtggtagttttgtatgatatttgttttttttttttgttttttattttggggaaatattggaaatatttttttttttatgcgtattcgcgttttagtatcgagtgttttaagttttgcgcgtagcgtcgggtttggaaggcggcgaatggttgtttagtcgtcgtttttattagtgatattcggtcgttagttttcgtttaggatgtgtatatttgttggtagtattggttcgggtggtagttatcgggttatttattttataggtataatcgtatttaatttaatttggaattcggagggttgtgcgcgtcgagttgggatcgcgttttagcgagtcgggtttttggttgcgttagggtttaggtcgagttatttcgtcgttcgcgtcgtcgcgaggcgggatatcgtgtgatatttttgtcgtgggttgggcgtcggtcgcggggcggagagcgggtgttttatttcgttttattatttgattttcgttagcgtttgaggacggcgtatttaattcgttttattcgttgcgttttgtgaattagcggcgggtagggcgggggaggtcgggttgggggagggtagggtggttttaatttttcgttttcgtttcgtcggtttcgcggagtataagtgttgggatttttacgggtaggcgtgttttgcggttggaggttcgagcgtttagggtttaggagacgtggcggatatagaggggtttgtaggtacggtgattttcgtgtttttgttttgaaagggtttgaaaggagcggtttatggtgtattattagttaagggtttaggtattagcgttttgtgtcgggaattcgggcggtcgttcgtgttgtaggtgtttgttatataaacgtttcgggagggggagggtaggtcgtcggattgggggtcggggaggggttttcggtttggtttgtttttgttattcgcgcggtttcg

SEQ ID NO: 6569 - DNA, 5030 bp, synthetic construct
  misc_feature 1..5030: note = Description of Artificial Sequence: Synthetic polynucleotide
  source 1..5030: mol_type = other DNA
gcgttacgtggagagttatacgaattttaagcgttttcgttttttagtttttcgcgggaaaacggattagggtgttaatgggttttgattatttgtattagcgttatttgcgagtcgagggttaagagtattttttcggttttggtggggtacgggttgttacggtgtttgtaaagttattgtttgaggggtcgcgttatgttttgtagggtttgtcgtttgtgttttattttttcgttattttgtcgggcgttgggatatggggagaggaggcggttttggtgagcgacgcgtttgttcgttcggacgttttacgtttcggttaagttcgggtttcgtatttaaattgcgtatttttgttttgcgtttttgttttgcgcgcgtttagagtgtttgggagaggtaggaagtgggagttatatagtttttggatggggagattatttcgataggtttattttgaatagggggatattttgaatttaatattttaaggttagaggtttagaagacgaaggttaagtgatttgaagaatattgttattttagtcgcgtatttgggtagcggggttaattgttattttttttttattcgttggcgtcgtattttcgagtggttttggtttggtaggtttggtagggtatgcggttggttttcgaaatttttttcggggattttttgtttgtttttagaggtttttcgtcgtttgtggttaggggaaaggtcgtcgattggatatagggaataaagtaaaggagtattgtcgtttcggttttttttaagttattttttttgattttttaggaaaagggggaaattttttaaaggagttggtggtttgtggaggaaagttgtagaatttaaaaatatcgtcgggtcgtttttcgattaagggagggttaaaagtacggtaagttttgttttattatgtaaggtaaaaagattttaggaaaagtatatttaaagggggaggaggtagaggtagttaggagtttggagcgtggtttggggcgttgcgtttttttacgggttcgggaggtgtcgcgcgcggtcgttagcgagtttagtcgtttttcgaggtttgcgcgtttgcgtcggagttttttgggtttttgtttttttaaatattttgaaatgtaattttattcgaaacgattggtagtaatattttgacgaaatcgaatttttgttttattaagtagcgacgtcgtagaataagtagttgatgtaatcgtttaggtggaggcggttaggacggtcgttttttttcggcggggcgttcggggagtcgtcggatcgggttaggtagagtttgttttttatttatcggtagtttgagtagttggtttattcgtaagttatcgttttttttagtatattttttatttcgttaaatttaaattcggtttcgtaggttcggggttttttttttcgggttcgtcgcgggtttagtcgagtcgcgtttacgttcgggattttttggcgggaggcgattttttcgattttttgggttaggcgagtcgcggggttttggcgaggggttcgagtgatcgaagagaagttcgcggagtttgagtttggatttttcgattgttcggtttcgtttgtttttttgtatcgagtttagtttttttttttcgtttttagtcgcgtatcggtatttatagttcggagaggggtaaataatttttaatttcgaggtttaggtagcggagggtcgaggggtagtttttggcgtttttagtttttattaagttttttggagttgtttcgacgaattgattttttatgttttaagataggagttttttaatatgagaatgcgcgagttttggaggggtagatttgtatttttagggaatttcgggttttttttcgtttattcgttcgcgttgttacgggatttcgttatagtttattatttttattttttcgggtcgtaggcgggtagggtttttaggggagtgcgtatattcggtttttcggtgttttaggtcgaggttgtttttgaggggcgggtcgtcgggaatgtttatttcggggcgggcgtgaggattgtttaggatatcgttgtagggtcggttatttcgttttcgtttcgaggcgttttcgtttttaaatagtatcgtatcgttgagtttgttgaagacgatggtgtttatggtgtcggttggtagggacgcgcggcgcggtcgtagagtttcggggttgggtcgtcgggagtttcgtagcggggttcggtttttaggagaggaaggtgtatttcgttatttattggttgagagtgtttagatttttgtaggtttagggttttgaatttggtcgggtcgtcgggttgcggagtcgaggggaggagcggcgtcgtcgtaattggtagggattttgcggttttttttagttggttatacgttttcgtttttgtaggtttttcggataggtatttgtttttttttttgtttgggcgatcgatttttttaatttttttattttttagaattataatcgggaattatttattcgtagaggtaaaggaaacgaatttttaaacgagtttttgggttttagtttgaatttgggagaggtatatttcggattgcggagcgcgatcggcgtgaggtcgcgcgtggttttttaattatagtagaagattaaagtttttaggaattttaattcggggcgttaggaggggttggatggaagggaagatttggggtaatgtgttaatcgtatttataagattttttagtttatgagttttaggttatatcgggatttgggggattttcgtgttttttagatcgtggatggtttggttgaaattttcgtattttttgttcgttaaggtttttcggggtgaggttgggtttaaggataggaaaaagttaagtggcgttaggacgaaagtattatttttttttttttttttttagaatttttttattattttttaacgcgtttcgggaagtgtatggttttaaggtttaaggcgttaggatttaggtttttagagtttttaattagtgttattttttttcgtagcgcgggtgttagtcgcgagttcgtagtttttcgatattcgtttttttttggggttttcggggatttttttagaggttgtaaaggtgttagaagtttaaggtaggaggtagtttggtcggcgtatttttcgggttattgttgttattgtcggggagagttagtagtttatttttggggtcgcggaggttttgagtttttgtttgtcgcgtatcggcgttaggagtaagttcgcgcggtcgcggagtcgtagagttatagttttaaggcgcgcggcggatttcgttcgttttattttttcgtttcgcgtttcgggatagttttcgtttttttcgagcggttttagtttcgttgttagcgttttttttgttcgtttagtcgcggtatgggttgttattttattaatatacgcgcgcgcgtatatatatatatatatatatatatatatatatatattttttgtttcgttaagcgtttatattcgttaacgttttcgtttcgtttttcggttatcgtagtagaggttacgcgtgatatttaggattacgcgtgattatcgcgattaaacgacggttacggtttgtgttcgtagggaagtgaagttagatttttgttggatgtcgtgtgttttttaggattgcgttttttcgcgtagataggtacgtgtttggggtgtgtatatagtttcggtgataagtgttaaagagaattttcgtgtttgtagtttttgttttatagttaagattcgcgttggtgtttttttttaaaattatgtttttagggatgtgtgtttatgttgttttatttgtataagatattttttttcggttcggtttttttcgagttattttagcgcgtttttttagatgcgacgacgtgttttttttagcgaagttattacgaggttagttatttcggatattttttcggtagttttaagtttacgtagagatcgtagatatagatattcggcgcgttgtaggtttgtaggtagtaggtttagaggtaagcgatggtaaaggttcgagcgttgttttgtcgtaaggggttcgggggcgtgtgaattatatttgttgatttttttaggattttcgcgcgcggttattcgcgtttttttttaaattatttatttcgatttattttagattgtggtcggggaggttattttttgtagaagtgttttttttttttaacgtcggcgaataattttaaagtaaaggaggcgcggttaggtgggtttttaagtttcgcgtagatttttgggttagttttggtcgttattcgagcgtttttttattagattttggagggaagttgggggaagggcgggagagtatcggcgtttagggcgtaggggttagagcgagtttggcgtttcgtcgtagtcggttgagattcggcgacgcgggggttgtatttgtggttgcggggtcgacggtcggttgtagggcggttggttttttcgtttcgagattaggcgtatttttattttcgtcgtatgttttttacgcgggttttagcgcgtttattatcgttatcgtcgtcgtttcggttttatttatttagttcggcgcgcgtcgttcgggaataggaatagcgaggtttttttatgttttttgattgtcggttttagtcggcgaatattttgcgggcgcggtatttacgttttcgggcgggtggagaggaagcgttcgcgttcgttcggtcgcgggggttgttgttaatttttagtagaggagtcgttgtcggggagtttcgggttcgtcgagtttttcggagtcgggcgcggtttttagattcgtcggttttgtagtcgtggagtagacggggttttttttttcgtattttaggagagaaattggagaagttgtcgggagcgttcggtttcggttttagaagttgagaggttgcggtgtaaatttcgtgttttagttggttcgattgtcggaaattttattgcgcgtggttaggcgggagaggttattgtgacgcg

SEQ ID NO: 6570 - DNA, 2868 bp, synthetic construct
  misc_feature 1..2868: note = Description of Artificial Sequence: Synthetic polynucleotide
  source 1..2868: mol_type = other DNA
acggttttacgcgaggaagagggcggggagcgcggatcgggtgtgggaggtcgaggtgatagtaggtgagggtcgggtgcggatggggaagtgagataagtatcgtgtgggtattatttatttcgttttattaaggaggttgttggtaagcggaatttttagttttttttttaatttagttgaagtttaattttattgaagttattttttatttcggttcgtttggggggaaattaggcgtttttggaagggaagggaagggagttcgggttgcgcgggttaggtagttttttttcggtcgtcgcgtgttttcgtcgtttttaaatttgtttttttttttattaagggaatttttcggggagtttagatcgcgatttttttttttggtttcggggtgcggggggcggatacgcgaggcgtgggattgatggtagttttgtttttaggaagtaggtaggcggggatttttgggcgttcggaggggtagtttcgagggtatagggtatagggagaattagttagatttttttttgtttcgggtagtcgcggcgggtgtggttagcgcggaggtaggacgtcgtcgagtttttaattttatttttttaatttcgatagttcgtcgtttttttgatcgcgtttttacggtttttcggtattcgtttttttttttttattatatttgaggaaaatttttttttcgttttttaatttaaatttagtagtgtttacggttgtcgtaaatcgttcggtttttagtaataaggtttcggtcgtagagcgagagtttttaggtgtaaggaaggtgatgtcgtaaagtcgggagtgtcgtaaattaggtgcggtggggaggggggaggggtggaggcggaggggtgggggggaagggggagggagggggaggaggtgattcgagtatttagatataagcgagaggattatggcggatggttttaggtgtaagcgtagaaagtaggcgaattcgcggcgtaataacggtgagtggcggaggggatcggggagcggcggagttagggggagttgggtagtcggggcgttttcgggggtgaggggggcgagtcgggttgggggtagtcggggtagggacggtaaagtggagtgggaaagtagaaagtagtgttttttgttttttttcgttgtcgtcgttgtcggagtcgcgtcgcggtcgttcgttttttttgaatcgttatgttttttatttggttttttttcgtttagcggttttcgtcgtttttgtcgtttttttggatcgttagtcggcgtcgacgtcgtcgtattttcggcgtagggcgggcggtcgggacgtattggttatttttttggtttcgggtggagcggttgttgttttttttcgtatttttttttatttttgtgtttttcggcgtttttttttttttttttttttggtttttttagcgcgatttttttttagcgtttaggttttcgggagtcgcggaataaatttgtgttcggcgttgatcgtgtaaagtggttttcgcgcgtcgcggtttcggtcggcgtcgtcgttgtcgttcgggtttcgcgattcgggtcgggttgtgggcgcgcggtaggcgggttgcggcggcggcgggacggggcggtcgcgggttgcgtggggtttgtgcgcgcgtgtgcgcgggcgtcggttgtgcgcgtcgcgggcggatagggttcggtcggcggcggtaaagttgggattcgcgggtcgggcgcgttcgcgtaacggggattagaggcgcgggggcgcgggtttttaagcgttttttttttttggcgtttttcgttgttcggtttagagtttcggtttggggatttcgcggcgagtttcgcgagtggggtttacgtttggcggggcgcggcggggcggcgcggggaataaggtaggaaaggtatttatttaacgtcgtcgggagtcgcgcggatgggggcgagttgggcggcgggtgtgtttgcggagttgttatttgggtttagagatcgggaagtattatagatagatttttttttcggggtagacgaggtttttgcgtcgggatgggtcggtgtgcgtgcgtttcgcgtttttttttttcggtttttggggaagttgttatttgggtcggacgtacggagcgttgaagtcggataatggggtttggatggcgttttgggtttcgggtggaaggagggtgggggagggggcggacggatcgacggacgcgcggggttgttatttgtatcgtagttgtagtgtttattgatttgtgttgttgtgttaagggaaatatatatttttttgtttggcgtgagagttaaaaaaaaagagagatagttcgagggatcgagatttgaatatgtggtggtggttgtatagtcgttttttttagtttggagagacgttgtaagttgattgtatttttggttatttcggggcgatgttatgttttttttttttttcgtgtagtagcgaaatgtttgttgattgttattgtttggatagtttttgtggcgagaggggcgagatttgttcgttcgggggcggcgggagcgtagggagagtagttttcgtttgcgtcgtttcggtatttgtttgtataataatgggcggtaacggttttgtcgtcggtcgtagtttaggttatataaggaattatacgtatatttcggatcgaggggttcgttttggtttttgcgttatttttaaaacgatttttaagagaggggtaataaatgcgtttataatgggatcgttgtagcgtcgagaaaacgaggaaatacgtgtttaggagaaaattttttcgtgtttttttagttttatttttcgcgtttgggtttttttttttttttttttttgggatgcgaaacgcg

SEQ ID NO: 6571 - DNA, 2678 bp, synthetic construct
  misc_feature 1..2678: note = Description of Artificial Sequence: Synthetic polynucleotide
  source 1..2678: mol_type = other DNA
gcggttggacgcgcgtttaggttcgcgtcgttgcggatcgcggagttgtgtagaagcgcggtttggcgggtggtataagttcgatagttgcgtcgcgtagttcgttcgcgtttggttaagagtttcgcgagggtgtggggagaggatcggtttcgtagggagcggaggttgcgcggttgtatcggattttatagttttaagtcgcggtatgaggcgaattttgtaaagcgcgttttcgttatgtatcgttcgatttttagtattgtgcgtagtaggatttcggagtttattcgtttgtggaaatcgagttcgtagcgggaaggtagtgggtggagggtgggtaggtaggggtttggggttcgcggttttttattttcgcgttttttcgcgttagtttcgaacgtttttttggggcgtttttgtttagttgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcgggagtcgaagtttagagtttcgttagggttttttcgtcgagcgtatttatcgtcgttgaggtagagcgcggttagtacgaggattagtacgattacgattttggcgtttatggtgcgggcgggcgggcgggcgggcggacgagcgcgggtcgggggtcggacgtcgagcgggtaatgcggttgacggagagtgaaagtgcggcggtgggaggcgcgcgtcgggcgttttagaggggagagttaggcggggcggggcggggcgcgcggtgaggggcgggttcggagtcgagtgttggtcgtggtcggggtttttgacgcgcgattttttcggcggtattttttatttatttttttcgtttttttttcgttttttttgtgttttcgaggcgtagtgcgtttcggtttttgatttttttaggtttcgttgggtttcgtatcgttggttcggtttgtagtgaggttcgtagtttgagcgacgtcggttggagggtcgtttattgtttttgtgatagggttttattggagagattgaggattttaggcgtaaagtggggcgcgcgtggaaagttgcgggacggggtttttcgatggcgggaattgaatgagaattaatgaaaagtaaataagttagtttcgggcggagggtttgttggcggtggcggtttaaggtagtcgagggggttttgttttttgtgcgtgggggtttaagttcgttatttgttcggtttgcggcgtagtcgtcggtagagttcgatttgcgggaatgagattcgtttttgtagttagcgtggttcggattttaagtttacggcgttattagtcgagttttagttttttcgtttgtataaataaagtagaaggcgtcggcggtttttagtaaaagcgaatgtagtttttgtattttcgattttttaatggtgaaatgagttaattataggtttatttcgcggagtgggacgggagatttaatgagattcgttttacgtcgcgaaattttttgtatcgtgtttgataagtagatagtatttaataaatggtagttgtaagtaagttttttaaatttaagtatttattgttttatttaagaaaagtttcgtgcgatttaaagagttgagaatttttttatttcgattttcgatttttaggatagtattattggcgtttgttttttgggtttagaaaattttttttacggagtcgtttttcggcggtgtttagtttttcggatattttcgagatattttagatggttttagttcggtggcgaagggagggtgtaggtcggtatttaggagacgtgggggtgaggagagcgtttttttgggtttcgttttgtgatcgtaggttgttttagttatttttttgtgttttttttagtatagcgtttagcgaagtggggttagtcgtcgcgtttatttaggggtttgttttggggatacgtttttgtttttggggagttttggtcgtcggggagtgggcggttagcggttgtattaggcgggagcggttaataggaggttgcgagggtttcggaatttcgttggtgggagtaggtgttttttgtgtattttttttttaaaattattttggtcgttagatggttgtgggtcggtattttatttatttatttatttatttatttatttatttatttatttatttatttattttgggtattgggtttggagtcgggaattttattgatttggttttgtttttaaagaattgaaggtagtgaggtttagtgaagaaggtagtcgtcgggcgtttttaggtttttgttgggttgggtcggggagtttggtcgtttatcggtcgtagcgttggggtttcggcgttttttggtggcggcgttttttttttcgtttttagagttttggttagttttatttttgcgtagttgatgaaattcgggagggcgaaggggttcgcgggaaatttatattcgggtggaggggcgttttggagttcggagattcgattttgcgggagtcgcgcgtagtttcgtttgtttttaaatttggttaaagtaaacgttatcgtttttcg

SEQ ID NO: 6572 - DNA, 2756 bp, synthetic construct
  misc_feature 1..2756: note = Description of Artificial Sequence: Synthetic polynucleotide
  source 1..2756: mol_type = other DNA
gcgggagggcggtagcggttaggttaatattcgcgatttcgattggggcgcggtaatttttgtttttagtttttataagttttcggtcgcgattcgcggtcgagaaattttgcggaggggtcggtgggttagagttaggttaggtagttgttgagtttttttttttttttttggcgggagtgtgtgtgtaaggggttagggggcggagtcggagaaagggttgggggtgttcgtgtttagcgttttttcggacgcggttttataatttagttgcgagaatagatggacgtagcggcggtttatttcgggggttttttgttcgttgtgcgtcgaggtttaggttgaagcggagatcgtaagtttttggttttcgttttttttaaggggtttcgaggaatcggttgtcgcgtttttttttttaagaggagaagagcgggcgttgatttcgcgagttttagaatcgcgggcggggggtaggtagggggcggggggtagagggttagttatcggcgcggaacgtttattttaggggttggtttaagatttttatatcgagagttttttttgggtttttagttttggagtatttggagagcggatttttgttcggttacgtttcgttttcggttttcgtttcgtcgacgtcgtattagtatgagcgacgtaagtggttcgggtattattcgggggttgggattcgtcgcgttatagtttcgagtggaagggaaaaaaaaagaggaggcggcggaggaggtaagagtcgacgcgaggggaggggagcgtagcggcggggttaacgggcgggtaagcgggcgggcggtaatagtatgtttttcggttagcgcgggcggttttttagcgcggcgggggttgttttgggcgcgtttcgggcgaagtgcgtttagttttcggtttcggtttttcggcgcgttcgatttttcggtcgtttttgagtttagtagtcgcgggtttcgggatcggttaagagtagttgtaacgtttcgtcggacggagtttttttttttttcgggacgttgggttatgagtttcgcggttatttgaggtataggggagtttgttcggttaggatagttttttcgaagtttcgtgttttcgtttttgtattgcgggacgttagcgttcggttttggcggaggcgttttcggaagagtatcggggtgggggtatggaattcgcggaatttgcgggttaggttcgggcggcggttattaagttgtcggaggttgtgggcgcggcgttgtaggagtttcggcggtagaggcgtttggtgtttgttatcgtgtgcgtggcgttgttattggataatatgttgtatatggttatcgtgtttatagtgttcgattatatcgtttatatgcgcgggggcggcgagggttttattcggattttcgaggtgtgggagtttattttgtcgttgtttatttcggttaatgttagcgtttatacggttaatatttcggcgttttcgatagttgcgtggttagcgggtttagtttttcggtttcgttattttacggagagcgaagacgtgaagatcggggtgttgtttgtttttaaggttattttgtagttgttagtgaattttttgagcgggttttttatcgatcgtatgagttacgacgtgtcgttgttgatcggtttgggcgttatgttcgtttttatagttttgttcgttttcgtcgaggattacgttacgttgttcgcggcgcgtagtttgtagggtttgggtttagttttcgtcgatacgtttggtatagttatgatcgtcgataagtattcggaggagtcggagcgtagtcgtgtattgggcgtggcgttggtttttattagtttcggaagtttagtggtttcgtttttcgggggtattttttatgagttcgtcggtaagcgcgtgttttttttggtgttagttgtcgtgtcgttttttgacgcgttgttgttgttggtagtggttaaatttttttcggcggttgtacgggttcgggttaatttgttagtgggtatttttatttatcgttttatgttagatttttatattgtcgtggtggtcggcgcgtttattatttgtaatatttttttcgtttttttcgaatttattattgttacgtggatgaagtatacgatggcggttttcgagtgggagatgggtatggtttggttgtcggttttcgtgttttatgtgttgggcgtttattttatcgtgcgtttggcggcgcgttatttatatttgtagtggttgtacggcgcgtttgggttggttgtgatcggcgttagttcgtgtatcgtgttcgtttgtcgttttttcgcgtcgttagtggttttattatgcggtttttgttttggtatagttttagtcgatatagtattgttgtttacgttcgtttttttggtggacgtgcgttatgttttagtttatggtagcgtttacgttatcgtcgatattttttattcggtggtttacgcgttcgggtttatagtggtaggttatattgtgtattcgttgggttttgagtagtttagttttggtatgggattggttaatttgttttatgttttcgttttgttgttgtttcgtaacgtgggttttttgacgcgttttcgtttcgagcgcgatgtgttgtttgatgagttatcgtaaggtttgtacgatgcggtgcgtttgcgtgagcgttttgtgtttggttaggacggcgagtttcgtagttcgtttggtttttttgatgcgtgcgaggacg

SEQ ID NO: 6573 - DNA, 990 bp, synthetic construct; identical to SEQ ID NO: 6343
  misc_feature 1..990: note = Description of Artificial Sequence: Synthetic polynucleotide
  source 1..990: mol_type = other DNA

SEQ ID NO: 6574 - DNA, 829 bp, synthetic construct
  misc_feature 1..829: note = Description of Artificial Sequence: Synthetic polynucleotide
  source 1..829: mol_type = other DNA
gcggtgcgacgaggttaggttcgcgttcgttaagttttagggtcgttgtcgtcgacggttatggaggacgagtagttcgatagtttggagggttgggcgtcgtttcgggagggttttttcgtcgatttttagaggtatcggttgcgttttttggtggtttggaacggcgcggagggtaagtttgttgtgatttgttacgatcgtatcgcgtagtagtcgtagcggcgcgagggggttcggttggggttggagtataagttcgaggtcgtcgtgttttcgtttagttgggtcggtcggttttcggtcgcggggtttcgcggcgcgcgtcggtagttagcggcgttgtggtcgtttttggaatattgttttttacggttgtcgtcggagttggacgtgggcggcggcggggtttgaggtttggggttcgggcggtgggcgttgttttggtcggcgcgcgtgggtttcggcgaggcggcgttgtaggagttttgcgggtagttggagcgttatttgggcgcggcggtttacggttgtggcggcgttatcgtgcgcgacgtttttttcgcggttaagggtcgcgcggtcgattgcgagagttcgcgcgagtttcgggagcgggttttgcgcgtttgatgggtcgaggcggacgcgcggttgcgttaggtaagcgaggtcgggtcgtcggcgtttgatcgcgtttgggtggtttgggattttgtgggaggttttttcggcgtcgagagttttggttgacggttgatggggaggagtcggcgggcggagaaggttacgggttttttagtatttttatttgcgcgggatcgttgcg

SEQ ID NO: 6575 - DNA, 4119 bp, synthetic construct
  misc_feature 1..4119: note = Description of Artificial Sequence: Synthetic polynucleotide
  source 1..4119: mol_type = other DNA
tcgtgatggtgttaaatcgagaggagagttcgagaagggggtgggtgatttttcggttgttttttattttcggcgttttgtgtttttttttttttttttttttcgttgcgttttagtcgagggttgttggagcgaatgggggatgtagaggaaggagttcgtaggttttcgtgtttttttaatttttttcgtttttttcgatagtcgcgcgttttcgttttagtttaaggttagtggttcggtttcgaggaaggcgcgggggtcgcgagagacgattttttatagtatcgttaaggaaatcggcgtcgtcggtgttttcgcgggtttttttcggtagttcgggggttgtttttcgtcgttgcgcgtttttttttattatttattcgttgttttcgtcggtcggagttttcgttttattaatttttttaatttcgcgggcggcgggtaggtgggggcgcgtttttaggtcgtaagaagggagcgtttcgagattttttcggggtcggttttgtttaggagggagttatcgacgtttttttttggcgttttttcgtcgttcggttttttaggcgcgtagtttttttcgagagtttcgaattttatcgttattttgtttttgtttcgggagaggggaggtcgaagtgttgtcggttagagggtttacgtaagtttcgaaattcggggggacgttttttttatttttatttttgcgttcgttcggggttgggcgcgtcggggcgtacgtacgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcgtatatttattgtattttatttattattttcgggtcgcgtaggttcgggtttgcgaagatacgcggtttattttcggttatttcgtttatttggttaaaggggttttttagttcggtattgggaaagatggttatcgacgtggcggcgaggttttttatcgggtagatgttgttagatagttggtgtataaaattattgagagttattgggattttgtttacggttttggcggttattatttgtttttcgtataatttggagatttaattttttcgttatttggagtgttagaaaagtcgttttggagaggggttggattgagtttgggatggtatttttttttgttttttatatttaaaaataattattatatatattaagaaaaaaaaattaatagaaataaaagtagtaaataagttgttgttttttaagaaataagaaaaatgtttatttgttattgatttttttttgtttgtgtttcggttgttgggaagttaggagttgttggtgtagtgttattataatagttagtgagttttttcgtcgagttattaattaattgtttttcgtttagttagacggaaagtgttgttttaagtatttatgggtaggtttttaatattcgtgacgtcgttgtttatatatggattgaggaatagggttgggttaggcggtttttgtcgttatatggttgatttgtatatacgggttcggtcgcgcggatttcgtcgggttcgcgatttttagttcgtaggcggcggggatcgttggggtttcgggcgcgcggttttagttgtagtttgggttcggggcgtagggatcgcgggggagagggcgcgttatggatttagttatagttatagtaggagagcgagttgttttaggttgcggtttagtttttcggggcggggaggaatttcggttttttgggattttttaaaaaaggcgaagattcggtgtcggcggtttcgtttttttagtttttgtttgggagttatttcggaaaattaaatttcggaaagaaatcgagcggagtcgagatattatagttaaatttttatttatttttttggtagtttaaaatcgtaagtaaaaggaggtagcgaagaaaaaaaaagttatatgtatttacggaagttgattgtttttttttgaattatttggtggaaagaagtggttggtgataagagtgaatgcgtattgtttttttggaaagtttgttttatttatataggagcgaaaacggaataggtttgggttgtttgtttgtttaagtattttgggtattttgggattgggagggtaaattttaggaggagtagaattattgtggggagtttcgagagaaatttttagtcggagatatttttttttttttgttcgcgcgtttttcgtttttttttagttgttgcgcggagcgggcgtttttttcggcgcgtttgggcggtcggttgcgtgggggcgtttagatggaagtttggatatttattttgtttttttagatatatatatatatatatttatattcgttttattttcgttatatattttcgttttcgttgttttttttatatattcgtttatatattttatattatatatttttttgttgattgcgttcgcgcgtcgtcgttgttagtagtgtttcggcggtagagcgggtttcgggttcgttggataggaggttttatgaagatattggtttaatttttattatcggtttttgtagttatagaatttttttgatttttatagtttaggatttaggatcgcgttttgttcgtattcgagttagaatatacgtattagaataaatattttttttttttttttaaaaaatatttcggtgagtttagcgcggtttttagtgacggtcgaaagtatttttaattatttttaagacgttatttttattttttaatttattcgttttattttgcgagatttcggtagaaatttttttgtttcgtttttaaagtaatttttaaaaatttttttaaagtttaaatagtagtaggttttggtttgttgggcgtaaagtttttattttttagtgcgttttagttcgtaatggatagtcgggtttgttcggggttttataggaggttggtttcgggtgtttaagtttagcgtatcgtcgtttgtatgatttatttatggtcgtttgtgtaggttgcgaattgttttagagttttttttcgttttaaagtcgcggaggttagggataacgcgtagggttagtttcgtaggtttgttttgttttttttttatttcgggttcggagcggttttagtttagtgtgggtcggggcgggcgggagttacggcgttacgtcgtggaggaagcgcggcgttgtaggcgggtttttagtcgtttatttgtttcgatcgttgtagtcgtgcgttagttttcgtcgggtttagcgtatcgcggttagggttttgaggttgtcgggagcggtttttttttttgtttttttattgaagcgttgtttttttttttttttttaaaatagtcggtatttagcggtcggttatttttttgatttaagttatttagagtatatttgggaaagtttttcgttcgcgttgtgcgtttttttttaattggggatgaaaaggatatggaaagaaatcgtagtaaggttagtattttagtagatattttattttagtaaaaatgtgtaaagttttattttttaagaaagaaagaaagaaaagaaaagtaagaaaagatagttgcgtttttattacgtgcgttagtttatttcgtttgcgttttggcgggtttcgcggttttcgcgttgattatgggtaagacgacgtttcggaagggagttcgattcgtatttcgggttttgagttcgaaagaacgggggaaagtcgaattatgtaaatgcggatttttgcgatggggttcgggttacggttttcgtcggttttttaggtgaggtatttatcggtagtaagcgcgggcgaggcgattgttcgcgtttcgtttttttttgcgtacgtgggcggatcggtaggcgggcgagttgttcgggtcgtttcgcgattggcgttgttgttaaattcgtcggcggtcgtcgcgcgttatttcgagggggagtttttggacgttcgagtgttcggttagtagggcgcggagggtaggatcggggttgggggcggggcggggtgtttgagcgagggaaaatcgcgaggttttcggttgttatttttttcg

SEQ ID NO: 6576 - DNA, 1575 bp, synthetic construct
  misc_feature 1..1575: note = Description of Artificial Sequence: Synthetic polynucleotide
  source 1..1575: mol_type = other DNA
acgcgtttatggaaggtggtgttcgttttatcgttttcgtggaaggttaaacgagttttcggtgtgaattcggagaaagagagggaagtgtagcgttagttttattttatattttttttttgtttataaataattttaagtgttattttaaagaggacggggagcgcggtagaggggttttcgggtcggcgggttggggtcgtcggatttgtttattacgttttttattttgggcgagtttgtataaataaataaatttaagtcgtcggtttcgcgggaggtggaggaggagtgacgaggaggaggaggaggagggaggggggagggagagattagtttgggaagtagtacggattgtttattcgattcgtgtcgtcgtagggagtgtgttaagttatagaggcgtcggaatcggtttttgcgtttttcgttagtcgttacgatttatttttgtttatggggtttttcgtgtgcgttttttcgttcggggattgaaattgattggttcgggagatacgaggcgtttagaaggattgatagcgcggtattaattgttttgtagatatttgaagggaaagattgggcggagagaaggagagtcggttagatttttttaatttttttggatttggaacgtttttcgaaataattttttttttatttaggtgtattttaattatcgttggttgtgttttttcggtatttttttttttattgttaattttttcgttttttttgtcgggagtagcggaaagggacgttttttagcgatataagttttttttttttgtttcgtagtttggatagagttttttggtagcggttgtcgtttttatttattttatttatttatttattggtttttaagacgcgagaggatggtagcggagcgtatttataaagcggtagttatcggtgttcgcggttttggggagttgggcgcgttcgggacggtggttttggtggcggcgcgggcggagcgcggcgtacggttgtcgagtttagggtcgtgcgggttgttgacgttggttttttgttcgttggtatttagtttgttcgtttattttcggacggtcgagttgtaggttcgggtgttgcgtttggaagcggagcgcggggagtagtaaatggagacggttattttgggacgagttaattaattgttggacgaggtttgtgttttttgttgttggtttttattttttttcgcggcgttttttcgcgtagtttttagattgtttagtcggtgttcgcgggcgttcgttttttgcgagttttaggttcgcgcgagttgtttgcgggaggggtcggggatacggatagacgttgttttattagggattcggaggatttggtgggtaagagtatgatttagcgattttcgtttcgggtaagcgttttcggtttttagcgttgggagcgttttgggtacgtcgggtaggtggaggaaggttgggcgcgcggaggttcgcggaggcgggtaagttttatttttttttttcgggattcggttagggtggtgtgatagtcgtttcgcgttcgcgtagcggtaagcgcgtttagaggtttaggtcg

SEQ ID NO: 6577 - DNA, 2401 bp, synthetic construct; identical to SEQ ID NO: 6353
  misc_feature 1..2401: note = Description of Artificial Sequence: Synthetic polynucleotide
  source 1..2401: mol_type = other DNA

SEQ ID NO: 6578 - DNA, 1579 bp, synthetic construct
  misc_feature 1..1579: note = Description of Artificial Sequence: Synthetic polynucleotide
  source 1..1579: mol_type = other DNA
tcgaagtcggggagcgggagcgtacgtgcgcgtgtttattttgttttgggtttttcgttcggggaatttcgggggtgttagggtatttagggttagggaagtaagatgtcgggtcgtttattttttttatttcgtagttcgtttcgaaaattttttaaatcgagatttaatttggatgtttagtttcgtttttttttttttttttttttttttttttcggtcgaggttttttttagtttagtttttttttttatttttttttcgtcgtggatttttattagtatgtttatttgggaggattcgttggggggcgggagatattcgaagttatttatcgttagcgttttttcggcggttttttcgggcgatagcgtttcgggagttttattcgtataagtgttgtttttaattaattgtttgggcgggggaaggaaaggggtttcgtcgtcgttttcgttcggaggttggagtgttgttcgtcgggtcgtgcgttcgttcggtagcggcgtgtattagtattatttttgcgtgtaagtttgaaatgtgagttgttttcgatttatattcgttcgcgttttttcgtagcgaagtggttgggttgacggtttgcgcgcgcgagtgagtgcgggcggcgggttggggggcggggtgcggacggcgaggttcgcggggcggggagggcgcgcgcgagtcggggttttttggagacgttaaggtaggtttgttcgttttttatttttttttcgcgtttttttttttttttttttttttttttttgtcgcggttggtttggtttttttcggagtttttagttttacgcgggtatacgtagggtgggtggttacgttcgtagggttcgcgagcgcggcgtagagcgcgggtcgtgggaagttttttcggcgcgtttcgtgcgttttcgtttttcgcgcgttttcggtttattttcgtttttggagagttgtcgtttgcgttcgggcgcgcggttggttgttttttcggcggcggcggcggcggttttattagcggagttttcgtttatgattggtttcgttcgggaagttggagacgggcgatgaataattgatgtgtgcggtgcggtagtcggacggcggcggcggtggcgggtagtagcgagcgggagcgcgggagtcggagcgttttcggagcgggtagcgcggagcgagcgggcgtcggattcgttcgggttttcgcgtcgtcgtcgtcgtcggggcgcggagcggggatgtaggcggcgttcgttgtttgcgcgtagtttttgttcggcgttggttgaattttattcggagtcgttcgtcgcggtcgtcgtcggtcgggttttaagttttcgagggcgttagggcgggatcgcgatcggtgtaatttttaggtaagtgcggggtcggaggggtcggcgtttgggcgtttacgggtcgggttttgggtttttttcgggcgcgggggtgagtgtgcgtgtttgtgtgtgatagaggagggtcggtgtattgtgggtagcgtcgtgtgttgtatggtgttagttttaggtttggtcgcgagagtggtatcggcgtgtatcgggtcg

SEQ ID NO: 6579 - DNA, 919 bp, synthetic construct
  misc_feature 1..919: note = Description of Artificial Sequence: Synthetic polynucleotide
  source 1..919: mol_type = other DNA
tcggggcgtttagtgtggtttttttattcgggagtttggaagggtttttcgtagttcgtaggagacgtagcgtttttcgtttagggggagtaggaggatagttggtcgttttcgggagttttaggcgcgaagcggttttttttcgttttaggtgagttttgttcgacgtttaaggtttaacggttagaatcgtttttgttcgtcggatttagcgaagttaggggaataaattttaaaaatagttcgggttttttcggtgcgtttatttttatatacgcgtttgttcgttatttaggagcggcgtttcgttgttaggtaacgagagttcgcgttttaggagttagtgtaggcgtcgtaaagcggaaggggcgcgcggataggtgagtagagggtacgcggtgggtagcgaagggggaacgcgtagtagagaggagagggcgtgtaggagtaggagtaggcggtagagtagagggggcgcggtagagtagagggggcgcggtagagtggagggggcgtgtaggagtaggagttcgtcgtagagtagagggggcgcggtagagaggagggggcgtgtaggcgcggggcgttcggtagagagaaggggtcgtgcggaagggggcgcgcgttaggggagggggttagagaggagggggcgtttaggagtcgggtttgcggtagagatgaggcggtgtgtaggagggagagcgcgtacgagggggtaacgggtagagaggagagggaatgaaagaaggggagcgtggtagagagaagcgggcgcgttttagggggcggggtttagggaggagggggagcgtaggatcggggcgggaggtagagaggagcgggtacgcgggacgggcgtgtgttcgtgaggggtcgaggaaaggcgtatgtggaggcgcgcggggtgggtgagtcg

SEQ ID NO: 6580 - DNA, 944 bp, synthetic construct
  misc_feature 1..944: note = Description of Artificial Sequence: Synthetic polynucleotide
  source 1..944: mol_type = other DNA
tcgtcggagcgcgcggggacggcggcggcggcgttatttggaggcgcggtggcgggtaggtgttcgaattgtacggcgatgtagaggtcgttgtttagggggaatttgtggtagtgtagtattttaggttaggggaagtcgtaggtttttatgagcggcgcgtagtcggcgcgtacggtttcgtatagcgagcggtacgggtagatgggtcggtcgagatagacgggcgtaaagagcgagtataggaagatttgcgtattcgagtggtagcgtttggttagtagcggtagttagttgttcgtttgttgttttatttcggttaggttttcgtgttttagtaggttgggtagtcgtatgcgtttgtagtttatcgtgtggtagagcggtaggtcggtagggatgttaaggtattgcggcggtttggagtaggagcggtcgtgtagcggttcggtttgttagttatagtagtcgtatttttcgtagcgcgtcggcgtttagtgtagcgtttttagtagtagcgttagcgcggtcgttcgtacgttttttttcgtcgtcgtcgttcgtatggttgcgttttttttaggtgcgcgtcgcgtagtttttcgacgttcggtgttcggcggtttaggtgtttcggcgtgcgttttcggttttgattttatttagtcgtcgtcgtcgtcgtcgtggaggtcgtttaggtgggtggtagtttgcgttgcgggcgtttcgattgattttggcgttttttatttcggggttttagttcgggtttcgtcgtgcgttttagttaattttcggtcgtttggttttagttttaaggcggggaggtagtgggggcggtttttagtttttttcgtattttgttcgagcgtttcgtttagcgttaggttttgcgtttttttttcggttcggtttttttgtcgtagttttggtttcgtttagcg

SEQ ID NO: 6581 - DNA, 1096 bp, synthetic construct
  misc_feature 1..1096: note = Description of Artificial Sequence: Synthetic polynucleotide
  source 1..1096: mol_type = other DNA
tcggttacgcgttgggttcggggaagaggcgcggtcgcggtcgaggcggggatagggaggcggtagttttttttgcgtagcgacggcgcgggcgggcggaggtcggggcgttttagtttttcgttttcgtttttttcggtcgtgacgttagagtcggacggggtaaattgagcggcggcggcggggcgttggggcggagattgcgattcggagtcgttcggattgacggagtttattgcggtgcgggcgttggcgcgggtacggaggattcgggtaggtatcgtaagcgatttcgaggtaatacggtttcggttttttgttcgtagggcgcggtgtcggaggggagcgggttcgggggaggtagggaggtagggaggtttttagagttacgcgggcggggttgcggggatttcggggtagtcggggcgtagggcgtagggcgtaaggtgtacggggtcgagcgtgtagtttgggaggtggtatagttgggggcggcggggattagggtagcgttttgggggttttaggttgggtttttagattgggttttcgacggcgttcgcgggcgttttttttagggagcgcgggttttcgtggggacgcgttcgaggtaggtgagtcgaggttggggcgttcgggggtgttttcggatgtcggtgcgcgcggttttttgattcgttttttcgcggtttgggggacgggagaatggggggtttacggtcgttttgggtttttatcgcgtatcgcgttcgtagcggagtttcggagttatggttttgagcgagttggcgttggttcgttggttgtaggagagtcgtcgttcgcggaagtttattttgtttatcgtgtttttggcgttgttgttggataatatgttgtttattgtcgtgggtacgtgcggatagggtatttttgtttcggtattttagttttagcgtttttttttcggtattttatttatttttgcgcggtttcggagtttcgttaaggttcgggaaagttggagaattcgttttgtaaaaaagatattttttttaggttgtcgcgtcggggttaggaggagtcgcgttgtgtggtttcgtttttttgatgttcg

SEQ ID NO: 6582 - DNA, 4048 bp, synthetic construct
  misc_feature 1..4048: note = Description of Artificial Sequence: Synthetic polynucleotide
  source 1..4048: mol_type = other DNA
acgttagagatcgtggggcgagagagggagagagttggaagtttattgtttcggcggggtcggtagttttcggttttaattcgtaaacgaacgagtcgggttaagaatcgcgaacgtatcgattttgggatttcgaggttaagcgtggttgatggggtgggaggatttcgtattttttattttaggattttttttggtttaggaaatcgttgggagttttgttaagtgtggggattggtataatcgaacggcgtttttagttcgggaattagtttttgttcgtttattttcgcggtgtttttggggcgattttagttttttcgacgcggggtcgcgtaaggtagtagcggcggagcgttaggttagaggaatttgtttgtttttttgttttattagtttgggcgaggtaggttcgggatttagggggtcgtagcggaggcggcgtcggttagggattttgtagggatcggggtgtttcggagggagtggtgttggtggaggaggaggcggtggttgagggggagtaggtggggaaagaggaggaggaagaagaggaggaggaggaagaagaggaggaggaggagaagaagaaattggaggaagaggaggaggcgaaggaggaggagaagtcgtagcgggcgtcgtaggagcgagtgagttgggagcgaggggcgaaggcgcggagaagttcggtcgttcggtgggcggtagaaggtttagtcgaggcggcggcgtcgatttcgttttattttcggttcggatttaggttttcgggtttttaggcgtttatttttttttgacgtattttaaagagtttttttttttttattttagggcgagtaatagcgattaattattaagttatttattaggtttcggaggaagttgtttatgtgattttcgtattaattaggtttatgaattaataaatcgtttgtataatttgtgaagaagcgaatatttttatggattgtttttggatttagggcgttttgttcgttttttgtagaggagaaaaaatttttttttttttttgtttttttcgagaatttttttttttttttttttttgtttttaatttcgatttttttacgttatttcgttaaaaaaaaaaaaaaaaaaaaaaaagaaaaaaaaagaaaaaaaaagaaaaaaaattattttaatttacgtttgtaaatttttttggaaggatttttttttttttttttaggttgggcgcgtttggtgtaagattttcgggattttcggttttgtttttttttttttttttttttttttttttttttttttttttttttttttttttttttttttttttttttttatttttatttttattttaaataaacgagtttttaattttcgttcgttttcgtcgcgggtagcgggcggcggaggtagcgtgcggcggtcgttaggagttgggagtttagggcgttcgtttttcggcgtagtatgttttagtcggcgtttaagcgttgttttattatcgagtcgttggtggttaaggatagttttttgttcgtttcgcgtttcgaggattttattcgtttcgcggtatttagttacgttaattttagttttataaattcgttttttaacggtttttattcggtcgtcgtcgtcgtcgtcggtaggggcgtttattttaattcggatttggtgttcgtcgaggcggtttcgtattcgtttaatttcgtcgtgttagtgtattcggtgtcgtcgtcgtacgttttggtcgtttattttttatttttttcgtattcgttatattttttattcgtttcgtagtagcgggattcgtttattttttatttttggtttatttatcgttatcgatatttgggttatcgtttttaaggtacgtgttacgtcgcggaattgtagcgcgtcgttttcgtcgtattttttattgttttcggtttgtttcgggtgggcgtttggtaaggtttgggcggaggttttttcggttcgcgggttagcgcgttttgttgggaaattaggcggcgcggggtcgggcgtggtgtcgatttttagttttcgaagttacgattggtttggagtgatggtttgcgggtcgtttgattttttgggaaggggtgcgaacggagaagttgttttttagtgcgttcgaattagagtaggttgggttgtgcgtgttcggcgtcgcggagtttagagttcgcgggatttttaggtttttggtattttcggtaatgtttttaatcgttttggtttcgaggggcgcggataggattcggtcgttaggtttgttttcgattgcgttcgattttgtttattatttattttgcgtttttttagtttagattcgcggttttttagttttttatttttttttggaggcgagaggattttcgcgtttcgggagaaaagtatgggatttgtttttttttttttgtttttcggaggtttggggaggggcgggaattcgtgcgggaggaaagttttagggtttggcgttttcgtcgcgatttgtttaattggggcgtcgagtagttatagcgggaaggtaggttcggtttggtttttgtttttttttttttttttaaaaaaaaaaaaaaagaatttggttaggaaattgttttagagggaaatatttgttcgtgtgtttttattttttgcgatattttttatttgtttgtttttttttgggtacggggtgggaggaggagagttaaaattttagaaaaaggagtaattagtttacggattggagttagtaaaagatttattttcggcggtagtcgattaatatttcgcggtttgtttatttattaatttattgcgtttttgtcggagtttagaatcgggtagatgttatttttttttttatattttaaaaaattaaattaaaggaaaaaaaatttaaaaagttttttatttttaatttcgaattggatttgtttgtattttgtttggattgtcggtttgtttttttttgtttgggttttcggtgaatcgattttttatgttaatgagtgaatttaaaattttgaggttttgtttgaaaagtttagggttgtttttttttattcgttattagttatgtttatggtttttttattagattcggagtcgttgggatttttttgcgttatagattgttttggcggtgtttgtaagtcggtaatttttcgggtttcgattttttcgttcgcgttttttttttagttttcgggagtcgggagtttcggagtttagttcgcgagaggtagtagcggttgtagttaagtatattcgtcggttagatttttgtttcgatcgggttttaacgattcgtttcgtttttatattttttcggaggggtaataaaataaataatttaaaaataaatttttatgaaaattttggagagtagttcgtcgtttttttatcgtgggttaaagtttttcgagaggttagaaagaagagaaagtagttttttcgggttgtgggcgttaattttttggttaggttttgcggtttttttttttgtttttagcgttcggcgaggaggtggcgaggttcgcggcgttagggcggttgcggagtcggtcgaggttaggagtttggggattggtttttttgcgatagcggttggttgggtgtcgtatcggtggagattcggcgtttcgggtcgggtagttgagtaggcgtttttttcgtgagtttttgggaggattatcggttttcgtaggtcgagcggcgcggttatgcgaaggttttgagtacggtgtcgggttagttcggttcgggagaagtgcgcggtttcggttagagtagttttttttaatgggatttttgttgtgtttttcgtagggaacgatattagtttcgagagtttttttttgtataacgcgttggttcgaaagtttaagcggattcgaatcgtttttttttcgttttagtttttaaggttggaatacgtttttgagaagaattattacgtggtgggcgtcgaaaggaagtagttggtatatagttttagttttacggaaatttaggtgattgcggttcgggcgcgaggaatttatttaggcgtgcg

SEQ ID NO: 6583 - DNA, 3292 bp, synthetic construct
  misc_feature 1..3292: note = Description of Artificial Sequence: Synthetic polynucleotide
  source 1..3292: mol_type = other DNA
tcgttgtcgtcgagacgcgtagcggatgtcgttgtttgtcgcggcggaggaagttacgtcgttgcgttttcggtttattttgtttttattaaagcgttagttagatagttttaaacgttagttggtcggagagattttttgggagaaagtgttgtcgtcggggttatagattcggagttgattcgcgagttttgggtatcggcggttagagtagaggggtgttttttcgagagtagtcgtcggtgtcgagaagttgttgttttagtagttttatcgagtgacgcgcgggttttggtcgggttagcgcgtatacgtatataggtatatttatttttggtttcgggggaaggtttatttttcggttttttagggttaaaggttaaggttacgcggatttttgagttcgaagacgtagtgcgaggatttatatttggatttttttattatcggttggatggtgggtggggaatttaaatttttttttttttggtttcgttttttttagtaggttttaggaaaaatatcgaggtcgtcggattttaaagggtaggaaaatgatgagtttttcgagggtcgaggttacgttttgttttttgggtcggcgttgcgtggttttttagttgcgtgggggcggcgggtttttgtttagttttagggggcgggggagcggtagttgcgagcgtagataatttcgaggtgattcgggagggtttggttcgttttttttttttttcgtaggtttggcggcgggaagcgggtttttgcgtcgtaggggggagaggtaggcgcggttttcgggttcgcggtcgttagtgcgtttcggttaagggcgtcgtttgtttcgcgtttttcgttcgttttttgcgttcgtaggagcgtttcgagtgtttttttagcgggagttaatatttttttgtgttaataggtttgtttttatttgttgtttaattggattatataaagttaataacgggcgggtttttatagttcgaagttaaagcgttaaaattcgagggaaggcgaggagggggcggtggcggaggcggttgcggggtcggggttcggttgagttttcgtttgtttaattttatttgttattgtacgcgtttaatcgtcgtatatttttcgtatttaatttggatgatattttgattttattattagtattcggcgtcggattgacgtagtttcgagtcggggattgtttttgttgtttttttcgcgggagtcgtagtcgtagtcgagtcgtttcgatttttcggtgtcgcggtagggtcgtttttcgttttttcgtattttttttttatgcgagttcgttcgtttgggtttttatttcgttttttcgtcgttggatttgcgttcggggcggttttcgattttgcgtttcgtagttgagtttcgtttatggtttgattttcggtttttcgtttgttcgtttcgtcgttcgtttgtttcgttttttttttttcggggattcggaggagaggggattatgtcggaattcgggtcggacgttgtcggtatcgttagcgtatagttttaatcgtcgtcgttttttttattcgtttttaaggagttttcgttttttattaagaatttgtttaacggagattattatcggtcgttttttaagttttagtcgtttttacggacgtttttcgcgttagtttcggttgtcgtcgtcgtcgtcgttgtcgttgtcgtggcggttaagggggttttggagggcgtcgcgggtttcgcgttttcgtaggtgggcgatttggttttttttcgttttgagatttcggcgtagaggtttgttttgttcgcgtattatttggagcgttttttagtttggtggtatttttatattttgattttcgtcggcggttatttttcgcgatttgaaggtatcgatttttttttgaattttcgttgtttttttgcgcgttcgtttcgttttcgtttcgcgttgttttttttcgtagttttgggattttagtattcgtaaattttttgttcggttagtttttttcggtttttagtttgttttcgcgttgggttgcgttgttcgttaatttaattttatttggtgagaaaagaagtggaattggagtttcgggtacggtgtttttcgggaaaagtggtttcgggcgtgaatagggaggtttcggacggtcggggtttgggatacggtttggaaggagggggtgattttaatgcgtttaagtcgaaagggaatcgttttgtcggtttttggcgaggaagttgagggaatggaaggaggtggtcgcgttattattatttgtttgtttgttttcgggaggagggggattttaggattcggcgttttttttttggtttagtcgagaaggaggtagttcgcgggaatggtgaggttttatggtttgggatttggaggtcggcgcgggttgagtttgtcgtttttaggcgtcgggtttcgtttaaggttgtgtcggtgtgtatgtgtgtgcgttcgtttgtttgtttttttagtttcggagaaggttttgttgagagatttttttttcgttttcggtatagatcgcgatttttcggagttattgtttaaggtcgatttcgattataaggagttggattttaagagttcggacgagattattttggaggagagcgatttcgaggaaagtaaaaaggaaggcgaagcggcgttaggcgcggtcggggcgagcgtaggggcggcggcggttatttcgggcgtagaagattggaagaagggcgttgaaagtttagagaagaagtcggcgtgtcgtaagaagaagacgcgtatagttttttcgcgtagttaggttttttagttcgagtttattttcgatatgaagcgttatttgagtagttcggagcgagtcggtttggtcgcgtttttgtattttatcgagacgtaggttaagatttggttttagaatcgtcgtaataagtggaagcggtagttggcggcggagttggaggcggttaatttgagttatgtcgcggcgtagcgtatcgtgcgggtgtttattttttattacgagaattcggcggtcgagggcgcggcggttgtagtcgcgggggtttcggtgttagttagttagtcgttgtttattttttcgtatttcgtttattattcgtattcggtggtttttttcgtgtcgttgttacggtcggtttgaggttttagaggggtgggggagggagcgttcggtttttttgttcggatttcggaggagattgggtcgggtcgagggcgtcgagaagtttagcggtttttaggaattggggtttgggcgcg

SEQ ID NO: 6584 - DNA, 3753 bp, synthetic construct
  misc_feature 1..3753: note = Description of Artificial Sequence: Synthetic polynucleotide
  source 1..3753: mol_type = other DNA
gcgcggagattcgtcgtttgcggaggcgtcgagttattttagtttcgagtttcgtatcgtttttgtttttggagagaagggtttaaggggtttaaggagtcggagttgtcgtagtcgttaggaattcgggttagaatttgtagttgtttttagttttggttgtttttggttagacgtcgttgatgttcgttaggttttcggcgcgttttgggggcgtatcggtgttgtgtgtttggtcggagcgttttgaaatttttcggggtcgttcggcggcgttgcgattggtcgcgttcgggtaatttttatgtaaatgaggtcgcgtcgttttcgcgtcgtcggagattcggcgagttggcgggcgaggaaggggtatttgtatcggggttgggcgggcgtatttagagttaggcgggtaggaatttttgcgtagttattcggtgtttgtatgtttttggcgcggaagggacgttttattagtttcggcgttttttttttttagatttttttttcgtttttttttattgtttgtttgttgtattattttttatttagattatttagatcgtttttaaagggagtttttggtttttttcgattttttatgaatttaggatgggtagtaaagaagatgcgggtaaggggtgttcggcggtcggtggcgtttttagttttattatttagtttattttgggcgggggtttttcggaggtatcgcgggagttcgtcggttggttagttaggaagcgtagtttgttcgtgttttcggaggaggaggagtcggacgacggttggaaggcgttcgtttgtttttgtttagattagtacggttttaaggagtagggttttaagtattatttttttattttttttttttgtttgggtaaggatcgtacgtcgttagtgtggtagcgagcgagcgcgaggggagggaggttgagcgtttcgttaagattttcgcgtcgggttttttttggttagagttgcggtagtcgggggttcgggatcgcggggagaggggcgcgtattgtggtgtttttttcgttcggtgggtttttgggagtaggcgaatatagattcgtgtcggtttgggttttttggggaaggttgagttgttgagagagtggattatagcgagagggatacgcggtcggttttatattcggttgtttttaattattgtatatttggtatttttttttcggatacgaggtggagatttgtaagtcgggtttgggtagtttgtttttatcgtaatttttttttgagtttttttttttattcgtttcgtatttttgttttttttttttttttttttttggaatgattagtattttaagatgattgataatggtgtattttagagacggtttttttttataatatttgacgaaggggagttttgcgttagtttttagcgtgatttttaaataaacggtttgtgaaatgatgttattttataaagttcgaggaatttttttagtttaattattattaagtaaattcgttttttaaaattatgttaatgtttttttttttagattttttttttttgttgtttttggtttatttataaaggtgggagtatagagattttatattttaagtagttgggttttttttttgtcgtttttaaaggacggggtgttgggtttggggggttagtgagagggataagaggaggggattggtaaggtgggattaaggttgtaggcgtttgttaatcgtttggttttagggagagttggcggttttcgaggttttttaattaattttatggtttttttgtttgttttcgttttttaggtatttttaagggtagcggaggttcgggttcgggcggtttggagcgtacgttttttttttttttttcgtattcggattttaaagaagagaaagagaggtttttgttcgcgggttcgttttcgtcggggttcgagcggtcgcgggacggcggcgttgagcggtaggtcggcgcggttaagaagaagacgcgtatcgttttttcgcgtagttaggtgtattagttcgagtttattttcgatatgaagcgttatttgagtagttcggagcgcgtttgtttcgtttttagtttgtagtttacggagatttaggtaaagatttggttttagaatcgtcgtaataagtggaagcggtagttttcggttgagttggaggcggttaatatggcgtacgcgtcggcgtagattttggtgagtatgtcgttggtgtttcgggatagttcgttgttgcgcgtgtcggtgtcgcgttcgttcgtttttttcgcgtcgttttattattcgggaagtaatttttcggttttatttttttataatttatataataagttcgattattgatcggttcgtcgtttcgcgtcgtttttagttgttcgtagagtcgggcgcgtattgtattgtaagtagggtttcggagtaaggcggcgtgtttttagaaatatgaagaaatatattatgtgtatttattagtttttatttatggtttttgttttattttttgttttgattgtttcgggtatttattggtattttttaagttagagagtttgttttttatttagatcgaattagtacgttttgaaaattattcggagtgagatgttttcgggtggtggtgggaaagggagttttggttagataggttgtggttggtagggaaaaaaattaggaaaatatttataaaattaggtatattttttttttatatatatatttgtatatatgtatatgtatatacgttcggttaagttaggtttttagaggttttggataattattaaattgttttttttcgttttttttatttcgaggatggtagggacgaaaaggggagagtttagatttgtaaatatttttaaaaagaaaaaaaaataaaatattttaaatatttttgttaattttggtgggtttggttattcggtatgataacgtacggaaggtttttaggtttttcggtggaaagatttgtatgcgtttgtttgtggaagtttggttcgttttacgtggagggtgggatcggggttaggggttaaaggtcgggattttggcgtcgtttagattgtacgtggttggagttgttcgtttatttttttttttaacgtttagaatcgtcgcgcgggttggggcgtatttcggttggaatttagtttaagagttcgcgcggagaaagataaagattgggaggtaggtttcgttatttaagcgattgttttttgggaataagcgagttgggtgtttagcggtatattttcggtattgggttcgttttgagtttggttatagtagttttcgttatgatatgttttgtgtcgcgtattttttttttaggggtataaagtaggcgatggcgttgtttgtatttagtaaagtttttattttgttcgtcgcgagtttggcgcgattagtttgtcgttgcgtttagttattcggtcggtggtagagttatgtgtttcgcgcggagagggaattgggcgcggtgaggtagttttgcggtttaggagagattcgaggttcgggattaggtaaagaaggtgagggaggtaaaggcgtttttttatatttttttgttgttaatagtttgtattggtttagcgtgtggttggattatcggttagtacgcggtcgtttgttttgaatggaattttgacgcgcggcgggggcgtttacggattttttcgttttgatatttgcggtcgcgtaggggttgggagggcgttgtatcgagagaatagtcgcg

SEQ ID NO: 6585 - DNA, 829 bp, synthetic construct; identical to SEQ ID NO: 6574
  misc_feature 1..829: note = Description of Artificial Sequence: Synthetic polynucleotide
  source 1..829: mol_type = other DNA

SEQ ID NO: 6586 - DNA, 1328 bp, synthetic construct
  misc_feature 1..1328: note = Description of Artificial Sequence: Synthetic polynucleotide
  source 1..1328: mol_type = other DNA
gcggggtcgttgcgcgtttttttaagtgtgttagcgggggaggcggggttggaaaggaaatttggtgaagggttggttcggagtttggggtggggatatttattgcgggatagggttagtaagaggattcgatacgtatcgtttcgagtgatacgtgtaaatgttaagatatagagatatttgtaaatgttatttaagagggtgaggacgggggagcggtttcgaggttgtgtttttcggggtaggtattggtttttgtggggttgcgggttaagtgtcgtttttttttaaggaattggtatttggggggggggggtcggtttcgtcgcgttggaagcgtaagtttcggggtttcggagatgcgtcggggcgcgtcgtttttcggggtagttttggatttcggcgcgtttaggcgtagcgtgcggtgttttcggcggggcgggtagcgagtcgttttagttcggcgatttatttcgggtttcgtagggcgcgagtagagtatcggttagggcgagtaggagggcgcgggcgggggatacgggtagcgggcgcgttgttatcgtcgtcggtttttagtgtagtagttttcgggttcggcggcgagcgttgtattattttacgcgggcgtcgagtcggggtcgggcgtcgcgatcggagggattttttgtttcggcgagttagtttcggagttttcgcgtagcgttcgcgtcgtcgttgagtttttttagttttttatttttaaaaaagttttttttcgtgtgtgtgcgtgcgtgcgcgcgcgcgcgtcgttttggtataagttagttttgatcgttgtaataaatgagtaaattgttcgagttggttcggggattaggaagagcgttagtgagagaaggtaggtttgtgaaatggatttacggttagtagttatcgtttttattatcgcggaataaattattgtttttttcgtattttcgttagttggcggcgtttcgcgggttttagagatcgttcgggttttttcgttagggtttcgtttcgagtcgcggttcgtttattttcgagggtgggcggtttagacgtggtttagtggcgttcgggcgttcggagcgtatacgttttcgttttaggatgatgtggtcgtagggttcggggcgttcggttgttaagcgtatatgcggcggtacggtttagttttttaggttgaagttggaaacgatgattttgttattcgtttttcggttttttgggaattttcggagtgcgggttaggtttttatcgcggtttatagttcggcgcgcgatttcgttcggttttaagcgtttaaaggggtatttttcgttcg

SEQ ID NO: 6587 - DNA, 2957 bp, synthetic construct
  misc_feature 1..2957: note = Description of Artificial Sequence: Synthetic polynucleotide
  source 1..2957: mol_type = other DNA
tcgtttttttcgtataggtgttcgattcggagttcgggaggcgggttttttttttaggtatttagtttagcgttagtttgggtttatttttcgttattttatagcgcggggagtaggggaggtcgaaagtcgggtagtttggggggtcgggataattcgggttgtagtaatttcgggcggtagtaggattggagagttggtgtcggacgtattgtagagacgtttttgttttcggcgcgtttttcgatatttagtagagagtttggcgtttttcgttttgcgcgttcgaggttatagcgcggagaaatttggcggggtttcggatttttcggtttgggaaaagcgatgattgttttgaattgttggggcgttcgaaatttttagggtttcgatttttcgtggggtacgcgcgatttcggcgtagatgttagttcgttgtttttcgggttgagggagcgaggattttagacgattttagggtcgttgtttaggtttagtttcgcgttttttatttcgttatttcgttttgcggttttagtttggagatttacggattttattgcgattttttgcgtagtgtagtcgttttttatttttagtttcgagtttcgggtaatttaggggtttcggcgaggcgagtttttttggggcgagatgtttcgagtcgagtaaaggggtcgcgtattggacggggtttttaagttatagttttgggggttttgaggagtcgtggtacggtttagggtagtcggggttgcggggttcgtgaagttagacgaggttacggatttagggtttttgtaattaagatcgcgagcgattgtggattcgggacggatcgtataaaggaggaagggggaattagaggggcgttcggtttaggacgtgttaggtttgggcggggcggaaaattgatattagggcgaggataaggatttcgtttttttagggttgttaggggaggggttcgttatcgttattttttatgggttttggtttcgacggtgtttaaagggcggagggttgggtcgggttggtcgtattcgggcgttgttggcggttaagttggatgggtcgttagtgagtttcggtgcggtatcgttggtttaggttcgggcgcggttggatatggttatttattgcgacgatttgggttttttttcggtttcgttcggttaggtttaggttatcgcgtatttttcgggttatgagttaggggatttgggcgcggtgggcgggggtttttttttgtgggtgaacgcgttagcgtttagttttaagttttacgtttcgggtttcgggtttgcgtcgttttacgcggtttcgagttacggggttttcggttcgtttttcggcgtttcgggcggtttggcgggcgtcgatttcgtttggttgagttttttcggttagtaggagttgttgaggttggtgcggtcgttttatttttattcggcgtttatcgttatggttatttagagcgcgtcgttgcggaagttgacgtttagttagatttattagtacgtggttggtaatttttttttttataagcgtagtaaggcgggttggtagaattttattcgttataatttgtcgtttaacgattgttttaagaaggtgtttcgcgacgaggacgatttaggtaatagcggcgcgtcggttcgtttcgtttaggattttttattttttcgtcgggtcgcgggtatttcgggggtgggagtattttagataatttaatttttttttgcgcggttggggatattcggggaggagggagaaggggaagaagtgtttgggtatggataggtttttagatagcggttgagtttattataggttcgcgtttatagtgcggcggtttcggggtttttaatttttgtgcgttttttcggaggaagaagcgggagagttagtaagttgggtgattttgggagtgatttaatttttttgggttttagtgttttatttggtaaaatggggaagatagcgtttattttaaggatgggtaaaataaataggatgttcgtttggaaagttttggagtttatttgggggtttggcgtggtttgcgttgtttttggtagagcggttggcggagttttattattagtatttcgtaggtttttttttattttaacggggttcggttttttttagggttttttttttttttttttttggattgttattttttttttagttttgttgtggaggtttatcgggtatagagtgttcgttaagggtggaatgggggcgaggatttagattttttgtaagggttagtaggggatttttttgaagttgattttttcgttggtttatattacggttcgttaaagttcgaattttttgaattgggttgtttttttttttgtaggtaaaggtaattattggattttggattttaattgcgagaagatgtttgataacgggaattttcgaaggaagaggaagaggagagttgaagttagcgcggtcgtgcgttcgggagttaggagcgtgggaggggtcgaggcgttagcgttggagttttcgagcgcggtttgtttggatttgtaggtttcgttttttttattcgtattcgaggtcgttatttgttttttcggtttcgtttttgttatgagcgttttggttggcggttttggtatttttttcgggggtttggcgggcgatttttttttcgggaggcggttatcgatagtcgttatttacgttttttagatttttaattttttttttggtttcgtttttggttattagatcgcggtcgtcggttttcgttttagttattttttttatagtcgggaagggatcgaagtttgaagggaggttggaggttagtcgggtgcgggtttagaggtgttgagtttaggttttcggttttttttggtgatagttttacgtgttggcgttgaaggttttggtgttttgggaggaagcgtagagtcgggggcggttcg

SEQ ID NO: 6588 - DNA, 1860 bp, synthetic construct; identical to SEQ ID NO: 6360
  misc_feature 1..1860: note = Description of Artificial Sequence: Synthetic polynucleotide
  source 1..1860: mol_type = other DNA

SEQ ID NO: 6589 - DNA, 1422 bp, synthetic construct
  misc_feature 1..1422: note = Description of Artificial Sequence: Synthetic polynucleotide
  source 1..1422: mol_type = other DNA
tcgtgtagttcgttcggcggcgttttcgggcgagggtttggtgttggggagcgagcgcggagcgaggtgtttttttaaatacgttttgtagtgtgacggcggtcgttcggttggaagagttatttttattttgcggtaggagttcgttcgtcgttatcgttcgtttcggtttttatggttacgcgtttgttttcggtttcgggttttcgttgtcgtcgcgggaggtgcgcgtagaggcggcggcgttgttggtcgggttgggtcgttcgtgcgcggggttgtgatttatcggtcggcgtcgtagtttcgtaatttgttgataattcggttttagttcggtcgttgttttcgcgaatggagagcgggttttcggcggggggagcgtagcgcgtttgttttcgggagcgcggttcggtcgtttcggtagtcgtttcggttatagtaggtgggaaggacgcgcgggtttgggcggcgggagggacgcgcggggtcgcggttcggtagaaaagttcgcgtttcgaggtgatattggtcgcgaggaaagtagtttcgagtaattttcggtttcgttggggcgggaggcgttacggataatttagggttttcgtttcgcgcgttcggttcggagttcgagttatatttaggtagagtaggcgtcgcggtcgggttggggcgggcgggttattcggtgtcggttttcggtgtaaatttttcggcgcgtttttggttttgtgtagttcgagatggttgagtttggtttcggagtcgggagtggggcgtagattgatttttaaatatggagaaggagacgtatttgtcgttggcgcgttcggttcgagttttttatcggtttttatcggtatcgttttcgttagttttaggcgtagtttttaggtcgttcgcggaggggagggagcgataggggtcgcggttgttttttggcggggtcggggttgcgagttgtttttcgcggggatttttcgttcgtttcgttgatcgtcgttgtttttatagatgggagtagttttcggattgcgttcgtttcgtcgcggttattttgaggttaggggttcgggagcgcgattttttggtcgtcgtttgggattttgattttttagaggttatggaggttggcggggagtagggcgttatttgatcgtttttttttggacgttttttttagcggcgtttacgttttcgtaattttgtagcgtttatggtgagtacgggggtttcgggggttttgtagttgggggttaggtcgttgcgggggggcggttattcgtatggggatttttaggttggaaaagttgtggaatggcgagttggtgatcgggttttcgggtttagtgtcggggtgggaggttttgtggagtgggggtcggggataggtcgcgtgtttgggtatttttgtttttcgcg

SEQ ID NO: 6590 - DNA, 1479 bp, synthetic construct
  misc_feature 1..1479: note = Description of Artificial Sequence: Synthetic polynucleotide
  source 1..1479: mol_type = other DNA
gcggttttttttaagttcgaagtagggattcggttttgcgtatttggcgggtgtgtttagattgtaattttcgtattaggtatttaagaacgtgttttggatatattcggcggtgggagcgggtgtttggtttgtattagggatgaggggtggagtagcgaaagcgttcggagcgcgtatttatttatattttttaagttagggcgcggtcgttttgggcgcgaggttttaagttaagtttcgcgttcggttaggagtcggggagtattttaggttttcggtttggggtcgtcgttattttattttgcggcgcgtatttttgatttggtttcgtttttcggcggtcgcgagtagcgggcggagcgtaagtagagaggcgttttgggttgtgcggtatcgttttttttcggtgtttggggagggacggagggatcgggcgggagagagagaaagtttgatcgatcggttggcgaagagttgtatgtaatcggtgggaggtcgggtcggttgggtttggggttcgggtttaggttcgtatcgtttttcggtaggtttttggcggtgagcgcggacggttcggaggcggcggttttgagttggtaggcggagggttgttttttgcgttcgtttgttcggcgcggttcgaggatgcgggggggcgatgttcggggttagggacgcgttttgttattaggcgttgtagttgttggtcgagttttgtgttcgtggggttttggagtacgatagttgttaggattttatttattatttgcgggatcgtgttagatttcggtttcgcgatttaggtgagtgtcgttatcgtcgtttggagggatttaagggttttgggttgggatttggggtcgtatcggggtttgaggtagaatagcgacgcggattgggagagggcggggggcggttatcgagttaggagagtgattaagaattagcgtattgtggtttgatgttgtaattaggcggggattcgggcggtggttattgtacggaggtcgatttcgggtcggttagggtagggttggagggattacgttcgttatttgcgtttttatcgttaaggtttttgggggcggttttttagtttcgagttacgttttttatttttcgggttatttgtatttagagcgaggggaggtcgcggcggtttcggagtcgtgggaagggggacgaggtcgaaggaaattttgggaagttgggagttggggacggtttcgggttggggtcgaattttatcgggtgttgtttatttttttttttaagcgtttagtttttttttttggtatggggtgagaagggcgggacgcgattcggcgttgggtcggggatagggtgtttttggttttgggtagacgggtttgaattcgttttcggcgggtcgtacggtatggaggtggtttgggtttgggcgttaggttcgattagcgattatcgtcggttacgatggggttcgtagattcgtcg

SEQ ID NO: 6591 - DNA, 446 bp, synthetic construct
  misc_feature 1..446: note = Description of Artificial Sequence: Synthetic polynucleotide
  source 1..446: mol_type = other DNA
tcgttattcgttgataataacggaatcgtgggtattggttttttaacgtcgtttcgttcgttttttttagttagtttggtggatatttcggtgaaggttgtagatttttagagttattttttttttaagtagcgtttttcgtatttttcggcgtcgggaagtttagagggagttggtttgtttttatttttaggtgtcggcggcggtttttgtcgtttttcgcgggataggaaggttttgggtagtagtagcgatagagttaggataagtttagaagttagagcgattttttgtattgtggagtacgttatgattgtttacggtggtcgtaggtgtagacgttagtcggaatcggaatcggaatcggagtacgggttgtcgttttcgatcgaatcgcgggcggcgcggacggcgtcgcgcgagggataaggtgcgcgaggcgtacg

SEQ ID NO: 6592 - DNA, 2991 bp, synthetic construct
  misc_feature 1..2991: note = Description of Artificial Sequence: Synthetic polynucleotide
  source 1..2991: mol_type = other DNA
gcgcgcgtagttagcgtttttcgcggatatagtagtcgggtgttggagaggtttggaaagggcgtgtcggagagttaagtgtagtcgtttagggttgtcggtcgttttttttttttttgttcggtaggggatttagcgcgtacgttagtgtggaggggcgggttggttggttagtttgcgggtttttgcggttatttcggggatttttttaagtttcgtttcgtagtgtttttattggtttcggatttttttttttttagttgttcgtttgggtttcggggcgtttaggttattacggataaatagtttagggcgtttggcgagaagttaggggtgaggaagttttggggcgttgtcgtcgttttttttaattataaattaggtcggataggagagggaggggtgggggatagtgggtgggtatttagattgttagtattttgttatttatagtcggggttttcgagcggtagaaagtttcggttattttttgtcgtttgggttgggcgaagttaggatcgtgtcgcgttatcgttaggatatggagttattgtcgttatcgtttcgcgacgtagatttgacggttttcgacggttttttttgtttttttgttataacggacgatttttatgacgattcgtgtttcgatttttcggatttgcgttttttcgaagatttggattcgcgtttgatgtacgtgggcgcgtttttgaaattcgaagagtattcgtattttttcgcggcggtgtattcggtttcgggcgtacgtgaggacgagtatgtgcgcgcgtttagcgggtattattaggcgggtcgttgtttattgtgggtttgtaaggcgtgtaagcgtaagattattaacgtcgatcgtcgtaaggtcgttattatgcgcgagcggcgtcgtttgagtaaagtaaatgaggtttttgagatatttaagcgttgtacgtcgagtaatttaaattagcggttgtttaaggtggagattttgcgtaacgttattcgttatatcgagggtttgtaggttttgttgcgcgattaggacgtcgcgttttttggcgtcgtagtcgttttttatgcgtcgggttcgttgttttcgggtcgcggcggcgagtattatagcggcgatttcgacgcgtttagttcgcgttttaattgtttcgacggtatggtaaggtcgggattttaggaagtgaggaagttagggcggcgttcgggatattagggacgcgttttcgagggcggggagttggttttgcgggaggtttgggttaggatttttttcgagagagaggatttttttgttttgggtagttgttattggggtagtttgttttggaagtgtgcgggtaagcgttcgagttgttttattgggggcgttattagaatattgtagcgcgaacgtgaagatttttttttttatttatttttatttttaaaatgtaaatttgcgttttttggtgattgttcgtttttggtttggttttgtatgttgtagattttattttttatttattcgtaattatttttttaattaggataggtttgggttcggaattagagttttaggttagagttagggagggggcggttataggaattggtgttcgggtttcgagtcgtttcgcgggtttgatttagtcgtttttgttgtttgtagatggattatagcggtttttcgagcggcgttcggcggcggaattgttacgaaggcgtttattataacgaggcgtttagcggtgggtatttcgggtttttttttgttcgtttttttttttttatggagttgttttggtttttatttaggacgtttttatttttatttatatacgtttatgttttgggaagtggtgtaggagatgaaatattaagtaagtagttttttgttttttggattgtttcggattttaattaaagtttttagtttttaatttgttttaaagtattgggttcgggggtgggaggtttgtcgcggttttatttttgtttattaatcgagtttttttcgcgtagaatttaggttcgggaagagtgcggcggtgtcgagtttagattgtttgtttagtatcgtggagcgtatttttatcgagagttttgcggcgttcgtttttttgttggcggacgtgttttttgagtcgttttcgcgtaggtaagaggttgtcgtttttagcgagggagagagtagcggcgattttatttagttatcggacgtcgtttcgtagtgttttgcgggtgcgaattttaattcgatatattaggtgttttgaggggatggtggtcgtttattcgttcgagggatggtgtttttagggtttttcgcgtttaaaagattgaatttaaatgttttttttttaatagcgttttaaaagcgattttttttgaggtaggagaggcgggagaattgaagttttcgttttcgttttatagggtaaggatatagcgcggttttttttacgtagtatttttttcggagatttattgcgatggtcgtttcgtgtttttcggtgggttagagttgaattttgaggggttaggtttagttttttcgcgtttttttttatgggggtgagattttcgtagatttaagttttgtttcgggatgtatcggttatttgggggggcgtgagatttagtgtatttcggttttaaatgtagtaggtgtaatcgtaatttatttttaattcgtttttcggtttaggattattttttgtaatatttttgtaatttatttttgtaaataagagttgttttgttagagtaggagtttttggggttgtatttatttttgaggtatggtgtgtggtgttatagggaatttgtacgtttatatcgtaggcgggcgagtcgcgggcgttcgtttaggtgattaaaataaaggcgttaatttatatcgtcgtggtttcggttttttttggatatgggtgtgggattcggaggaaaattcgtaaattgggttagttgttttttagcgacgtttgtaggcggtaggcg

SEQ ID NO: 6593 - DNA, 928 bp, synthetic construct
  misc_feature 1..928: note = Description of Artificial Sequence: Synthetic polynucleotide
  source 1..928: mol_type = other DNA
gcgggggcgagggggcgagggttggtcgttcgtgaaaggaaaaataaattttaaggaagtaagaaatcggacgaaaggattttattttaagtgatttttttgaacgcgtttttttaaatttcgcgatagtttaaggagttgcgcggcgcggcggttgcggttaagatttgtgattaatgttatttgatttgagtttatggggttttgtgcgttttgttatttattgttatgtcgttatttttaagtttatttcggagaaattattcgcgttttttgttttaaggttgagttttttgtttattttttttttaagagaaaagaagacgggaggggaaaagagagaatcggagtttttggtttggggtttaaggtttttgtttacgttgcgggggaggtcgtagtagattcggttggggtttttcgggtttaggtggttaaagttgtcgaaatttgttttggatagtagaaagagcgtgtcggaacgtattttgggggtttcgtttttttcgcgtaggggagagcgagtatgtttttgtttcgggcgtcgtgcggtcgtagtagtagcgcggttttttttagtgcgagtcgtgtttggaatgtttcgggtaagcgaagggttagtaagcgaggcgaaacggatattataaagtagagagtggtgtgagttttttcgttttttgaaaagatggtaagttttcgtttcgggaaggttgtaacgttaaggttattttttgtaggtttcggatttttagttttttatgttttttgtcggagtagttaatagagtgagagcgtattttggaaagattggtcggatgtcgggcggcgatagggaaaagcgttcgacgtttggttttggggtggggggtgtggggagggggggtagggagttaacgggcgaggcgaaggaggagggttgcgaggttcg

SEQ ID NO: 6594 - DNA, 1267 bp, synthetic construct
  misc_feature 1..1267: note = Description of Artificial Sequence: Synthetic polynucleotide
  source 1..1267: mol_type = other DNA
gcgaatttcgagtaattgtttttcgagggggttcgtgcgcgttcggtggcgtcgtttcggtttgggttttttcgaggaaaaatatttattcgcgagggttcggcggtttttcgattcggcggggatgaattgtggtaatttcggtagtttttatcgcggtgcggaagtaaagagggtaatattggcgattgcggttcggaggggttggagcgcgtgaagtcgtgggggcgtcgtgcgtttttcgttttttcgtttcggtcgtaggttttgggatttcgatttcggtgtttcgggtgatagcggttgcggcgtttgtagtttagattttcgtagttttgcgggcgaaggaggcgaacggaatcggtttttagtggggagcgtaataagttatagtagttaaatttcgcgtttttgttcgggtttttagacgaacgtagtcgtagcggggggtcgggtttcgagttttacgtcgtcgtcgtcgcgttagcggtggggggcgggttgggggcggggcggtcggggttgttttttcgggcgtatatgcgagcgtagtattcggcgttgtcgagttatttttttcgtcgttcgttagtaagtttggcggttttaagttaggcgcgttttaggatttaggtttatttgtttttatttagtttcggtgttttttgttaggcggggattttcgagagcgatgtcgatggatttgattttagttgtgtggttttgtgtgtgtattgttaggataggtaagtatgattgtggcggttagagggattcgggaaatgggggtgtttatagattacggcggcgtggggagatttggagtcgagttttgcgttggtttggggaacggcggtagcgtggatcggtttttgggatttttttgttttgttcggagtgatagggtgaaaatagggatttacgggtttgaagatgttttcgttgagtgtttttttttaggggattcggttttaggggcgtaggagtgaggggcgcggtcgagtaggcgtatttttttgttgttagtaatcggtttttcgttttagggagtcgaaattcgtagtagggcgggttcgcgtgtttcgagttttcgaatttgtaaggtgttgtggaaattattttcgtcgattttcgttaggttgggaaggggtagttgcgggagtcgtattcgtagagggagcgttttcggttggcgggcgcggtcggggttcgggagggcgcggtgcggcgagggtagagagttgcgggagaattttgggatttcgcg

SEQ ID NO: 6595 - DNA, 1225 bp, synthetic construct
  misc_feature 1..1225: note = Description of Artificial Sequence: Synthetic polynucleotide
  source 1..1225: mol_type = other DNA
gcggaagtcgtttcggattatgtatggaaggttaattgaaaagattagtcggggcgtttgtggtagttttgttattttgtgatagtgtttcgtttcgggaaattgtatcgttacgataaacgggatcgtgataaaacgatttttttcgtttttatttgtagattatttagacgagattgaattgtatttgtttttttttcgaggggagtcgcgtttttagggtagtcgaaggtttggggttgagggggggtttttattaaggcgcgggtgggggtcggagttttaattcgatgagaagtgataggcgtttgggggatttgggtttcggtcgggattagcgtaagtagggattttgcggggatatcgtttttttaatagagtaaggtttggtttacgttttcggttttttttaatttttttttattgtttttttttgtttcgtaagttttatttatttttttagttatagagttttatttttaggtataggaagtttttcggaaaaagaaaggttgttttagaaagagatcgagagagattttttaaatttcgggtatagttacggtaatttttagtttgttaatgttaaggcgggcgcgtaaggtcgtttaaatttagatttttttttttatttattttaaaaaataataacgtgttagttattttcgtagatatcgtcggttggtgtttgtttaggagacgttagggttagagcgttatttttagtatcgaaatggtagagagaaagcgtagttttaaatttttttttagaggttaagttttaattattgtgttttttttttagggattgttggcgttttcgtttattggcgatgattatgcgtttagaattcgatcgcgaagtaattaataggaaaatatatggtgttaatttggatgtttcgcgtttcgcgtatattcgggaacgagcggtataaagttttgtcggtcggttcgcgatttcgcgtttttcggggtttgttagtcgggtcgtagcgataaacgtttagggttgcgcgttttggttggggttcgttcgagagatagtttgcggttggggagtttgagttttaaggggagagtttagtcgtcgaaggcgagtttatcggttaagttttggggttcggtaggttttgtataattattttcgtaaagttcgttatttttgtgttttttttttagttacgcgtttattagtttcggaagtattagggggcgatcggcg

SEQ ID NO: 6596 - DNA, 1627 bp, synthetic construct
  misc_feature 1..1627: note = Description of Artificial Sequence: Synthetic polynucleotide
  source 1..1627: mol_type = other DNA
gcgtagtagagcgtcggagaggagggacgcggaggttatcgaggggttagtagggtcgcggcgttagggtgggggtttttaggcggcgttggttacggtttattcgcgagggcgagcgcgttcggtcggtcgcgttttttgtcgttcgtgttcgggggtgggattcgcgtcgggagttgtcgagtgcgtggagggagttaggtttcggttcgtttgatggattgatttggagatggatcgaattatattatttgtcgtgtatcggtttgttttgtttttgttttgttttgttgttgttgttgttgttgtaaggggtggtggcgagttttaggattttattaaggaagttaagatttaaggagatagagggatatttatttttataatatttttttttatttttttttttttttgcgcgtggtaagtttttttttttttttttttttttttttattagtttttttttaatgaggtaagatcgtttttaataatttgttaatgtttttgtggcgttcggtgggggtcggaatttgagatttcgaatcgttgtgtgtgtgtgtgtgtgtgtgtgtgtgcgcgcggtgggggtcggaatttgagatttcgaatcgttgtgtgtgtgtgtgtgtgtgtgtgtgtgtgtgtgtgtgtgtgtgtgttgttattggatagttgatttattttttaagttgttttttttgtttgtcgtgtaagggacgcgtaaagggttagagaggtttggcggacgcgttaaaattggtaaagttggcggtttagggggaggggtaagtggatttggaggtttttttttattgtgtatttttttggaaaaaaagcggagggggtattaagtaaaagttttttgttaggtagagttagttcggcgtttttcgtatatagttggggttagtaggggttgtttttttgtcgggtatagcgtttttaggagttagtcggggagagttgagttaaggtcgaaggagtcgtttgcgggtttagtcgttttttttcgttcgttggttttagagcggacgttgggacgttcggggtttggtagttttgcgttcggttaggagcgggcgggcgagtattagtttgcgttttggagaaggggcgtagcgtcgtagttgaggtcggagtagtttttcgcgggcgtaggatatttgttagtgagcgttcggattgtacggttttcgggtagtgtttgtcggcgaggggcgggagttcgggtgatttggttatttttattttcggtttaggttcggagggcggtcgttttttatcgtttttttttttttattggtagagcgcgttgcgggcggattttcgggttcggagtagtttatcggttattttatcgtttattcggttttcggtgttttttttcggtcgttttatttagtaatttttcgtgttttgtttttcgattggaaatgttttacggaagcgttttggatagggttttcgttaggcgataagagttcggtgttgagatgtgttacgtttttatttttttattaattatggatggaaataaataaggaagagttaattttgttgagtttttttttcggtaacgagaggcgttttgtagtcgggagggagtcgtcgttcgcgtcggtagtcg

SEQ ID NO: 6597 - DNA, 1857 bp, synthetic construct
  misc_feature 1..1857: note = Description of Artificial Sequence: Synthetic polynucleotide
  source 1..1857: mol_type = other DNA
tcgcgttgtttaggtaaagggattcggcgattaagatattttcgcgagggtttagggcgcgtttttttcgttaggttttagatttcggttttgcgttatttttttttacgtttcggcgcgggcgtagttagttcggttttttttaggtttttaagtttcggatcgagtgtggggtcgtttttttttttcggaaggagttatcgtcgttttaagtggaagaggagaggaagggggcgggggagcggggggcggggagcggaggcggaggagggggagggggatttttttggtttttacgtggttcgggcgtttgtgaatcgcgtttatcggagggttttatagcgaaatataaaagtagttgggaagcggcggggattcgagtttttagcgtcgggcggagcgtcggatagagtttcgtagcgtttcgcggtcgcgatggggtcgaagcgttcgaagtttcggagtttataaattgtcgggttcgtttcgtcgtcgggattcgggtgtttgggttcggtttgaagcggcggcggcgtatcggtatagtcgcgggagtatgggtaggaggatgcggggcgtcgtcgttatcgcggggttttggttgttggcgttgggttcgttgttggcgttgtggggagggtttttgtcgtcgcggatcgagttgttcgtttttcggtcgttcgaagatcgatttttacggcgttcggttcggagcggcggtttcgcgttcgcgtttcgtttttttttgttttcgtttttggcgtgggacgttcgcggcggttttttgaaaatttttcgggcgttgtttattttggcggtcggcgcggacggttcgtttcggtagtttcggagcgagtttaggtggtacgtgttagttaggtagtttcggtcggaggagagcgtcgcggtgtacgggggcgttttttggagtcgcggtttggaggagtaggtgttttcgggtttttcggaggtttaggcggcggcgtggttggaggcggttcgcggcgttcggatggtggttttggagcgcgggggttgcgggcgtagttttaatcgattggttcgttttgtcgacggtattcgcgtttgcgtgcgttacggtattaattcggagtagatttagggcgaggttttgttttattatttggcgcgtttgttgggtttttagcgttacgtgtcgtcgttggtattggttcgggtggaggttcggggcgcgtagtgggcgtaggtgtaggaggagttgcgcgttgcgtattggatcgagggtagcgtggtgagtttgatacgttggttgtttaattttacggacgtggtggtgttcgcgttttggcgttcggaggacggtcgtttgcgtttttttcgggatgtcgggggtgagttggttaattttagttaggcggagttggtggatttagtataatggatcgatttaatttttttcgattatttgacggttaatttcgatcggttcgtaagtaatttttttagtttgtagtgggattcgcgcgttatgtagcgtgttattagtaatttgtatcgcggttcgggcggggcgttggtttttttggataatgaggcgggtttggtgtacggttatcgggtagtaggtatgtgggataagtataacgagtcgttgttgtagttagtgtgcgtgtttcgcgagcggatcgcgcggcgcgttttggagttgtatcgcggataggacgtcgcggttcggttgttgcgtttttatcggcgttacgagtttcgttttttcgagttggtcgtttttgtagatttttacgtttagttgttatagcgtcgtttcgattttttcgttaagtatattttgtattgtaaggttaagtacggtcgtcg

SEQ ID NO: 6598 - DNA, 2423 bp, synthetic construct
  misc_feature 1..2423: note = Description of Artificial Sequence: Synthetic polynucleotide
  source 1..2423: mol_type = other DNA
gcgcgcgcgcgtttgcggaggggggtggtaaggatttagaaggggagtttattttttttttcgagtttagttttggggagtcgggcgtttaggttcgttaggttgtaaagagagttgagagttgtttcgcgtttcgcgtagaatcggcggtggaataattagcgttttaagtgtgtgtatttgggattagggggcgggggagggggatttgcggtttcgcggttaattcggttggtgtagatttggggattttagaagggatagtgttcgtttagtcgcggcgattgagggtttttgttcgggcgtagttcgggttagtcgcgtgtttcggggtcgcggtttttttcggaattttcgcgggcggggtttgtttttcggagtcggttggcggggggcgggcggcgtcggggaaggggtcgttatttttttagagcggcggggcgacgttaggcggaagggcgcggggcgcgtacgttttaaatggtattcgttgttattcgagtttagagtcgtgtgggtagtcgcgggttatataagtcgcgagtttggtcgtcgcggggtagacggcgatagtagcggcggcgagcgtttcggagcgcggcggaatagcgtttttcgagtttcgtgtttttcgacgggttcgttcgttcgttcgttttttcgaggagcgtcggttcgggttcgcgagggtcgtcgttatttcgtagtagatttggatttttcgttcggcgagttttcggttgttgtttttcggggggtttcggcgtagcggtcgttttcggagagtttcggcgtttcgtcgttcggtttcgtagacgtcggaggcgttatggtcgttaagttcggcgagttgatgggtatttgttttagttattaggcggtgatgtcgtatttcgtgtgtttggtcgacgagttttcgtagttcgtgcggttcgttaagttgtttaagggtcggggtcggttgcggcggtcgcgttagtttcgttttaagacgtagtcggtgattttcgacgagatttaggaggtggaggaggagggggtgttttttatggaggaggagaaggttaagaagtcgtttttgtagagtttggagtgtttgcgtcgtagtacgtagagtttgtcgttgtagcgggagtagtttagtagttgtaaattgaggaatagtttggattttagcgatttcgattcggttttgtaaggggcgtcgttcgcgggggggacgcgcgcgttcgcggttcgcgcggggatcggcgtgtgaatttcgagagtgttcgcgttttgttttcgggggattcgtaaggattcgggatcgtcgtttttcgcgcgttcggattttcgtttcgttgcgaatcggtcggtgcgtttttcgtcgcgttcgttttggttcgggagcgtcgggagcggggtcgtttttttcgtttttgtaaatgtttattttttaattttttttagtgcgaattttgttgtgagtgtgtgcggggaggcgcgttcgcgttgagtcggcggcgggtagttattttatgtttttgttcgatggtttgtaatttcgattttgtatatcgttttatcgtgttttttagcgtatatttatttatatttacgttaatattttcgttgaatatttttataattgttaggcgtggtcgttgggattttgggcgtagcgcggttgttattgcgtttggaggattgatatttatttttgtattgcgatggttgaaggtatttatttaacgatttttttatttggatatgtttgtgaggtttttgaaaggagataaataaagttaatatatttgtatagtgtagttttttaggtttttgattttttgtattttcggggtttaggtttttaagattcggggaggtgggggaggaggtggtagggggatgtcggattagggagtcgggagtggagttatttttataagtttcggttatcggaacgaggttgcgttatcggtgcgcgggtcggttgtttgtttttttaagtggatttattttcggtttagtgtgtttttgcgtttttggtttattttttatcgtcggtattcgggttgaagtgaagtcgtaggaggggcggaggtagagttgacgatggagagttttttttttcgtatagtttattttttagagttggggttagggttttcgtttcgtattcgttatagaagacgtatttttttttgcgttgatttttggcggcgggtggggagatgtcggagttagtaatgcgagatgtttgggcgttgggattcgagagtgggttggaggttagtttgggttggtcgagagtgtgggtgcgcgttcgttgtcgcgggtaggtgattttttgatcgtagttgatttagcgtagtgtttggcgtttttgcgttgcggggaaaatcgcggtcgttatgtttttagtcgttttttgcgtttcg

SEQ ID NO: 6599 - DNA, 1146 bp, synthetic construct
  misc_feature 1..1146: note = Description of Artificial Sequence: Synthetic polynucleotide
  source 1..1146: mol_type = other DNA
tcgtcgtaggatttacgttgattacgtttaagtcggtttcgtttattcgtttcgtttatcgttaattttacgcgttttcgttcggatacgcgttttcgtagttttggagcgttcgtatttatttataagttttcgtgtttagttttcgtgttttaggagtttatatatatttcgatttttacgaagcgttttaggtttttattttcgcgtttaggtatcgggcggtcgtttttcggggtttattttcgttgtagaatttgtcgtcgaagttcgtgtggttgtagtcgtagtttatttcgtcgggggttagtacggtgtagaggtcgtcgttggcgtaggggttgcgcgcgggcgcgtatagcgggtcggcggtggcgtcgcgtaggttttggttgtttagtagcgcggggggtcgttcgtttagttttaggttggttaagaggtcgcggaagggcggttcgtatttgacggtgtttagcgtaagcgtcgagaggcgtacgtcgggcgggatgtcgtttacgaataggtcgttggttatttgtatttcgcgtcgtttggagcgtatttcggcggcgcgggtttcgtcgtttatcgttagcgtcgtgcggcgcgcgtcgcgggttagtagtattatgtgttagcggtcgtcggttatcggcgtgtttagttgtagcgtggtcggttcggcgtacgaaagcgtgaagcgtagtcgtaggcggtcgtttattagtagtagttttaggaagtcgtagtcgtcgtcgtcgtttaggtagagtagtagcgcgcgcgtggcgttggtgcgtaggttgaagttgagttcgtcgttgttcgtcgcgttcgtttagcgcgcgtagcgagtttattgttcggggtcgtcgtcgaattttaggtcgttcgcgcgcgtcgttagcgttagtagtagtagtaatagtagcggcggtggtgtcggtcgttatcggttttcggacgttatgtttacggcggtttcggtttcgttcggttttcggttttcgtttaggttttagagtcgcgggcgtatggggcgggagggggtcgggcgtttttcgcgttgagcggggtttttttgtaggtttatagtgttatgggttcggtcgcggggcgaggcgcgtagaggtttagatgtcg

SEQ ID NO: 6600 - DNA, 577 bp, synthetic construct
  misc_feature 1..577: note = Description of Artificial Sequence: Synthetic polynucleotide
  source 1..577: mol_type = other DNA
gcgggtatagtcggtttttgacggcgtttaaggtttcgttcgtgcggcgttgtttattttttattattagagatcggttcgtttagcgggtaggttttattttaatgttaggttaaagtttttattttttggattcgggtttggcgttttcgttttcggcgcgtttttattcggcggacgcggtcgcgtataaggtttagtacggttcgcgttttcgtagttcggtcgcggttgaatatttttagcgcgaagcgggtgggcgttagtagtttcggggacggcggtttttaggtttgaaagttggcggttcggggttgggcgggggcggttattgcgttcgggagtagttttagtagcgataggagttgtagttagggcgttatggcgagggcgaagtcggcggttcggatttaatagacgttttatcgatttatcgggtatcgagttcgcggttagcggggtttgagttttttttttagcggggcgacggtacgtcgattaatgggcgttggtttgcggcgtttgcgcgtttttttgtttataggaggtacgtggggcgcgtagggtagggagagcg

SEQ ID NO: 6601 - DNA, 1721 bp, synthetic construct
  misc_feature 1..1721: note = Description of Artificial Sequence: Synthetic polynucleotide
  source 1..1721: mol_type = other DNA
acgaagaatcggttggttacgtcgaagatgtttattacgtttcgttttacgggcgagagttttagtaggtttgggggcggggcgtaggttattgcggggtaggtgatttttggtttatttcgtttttcggtttgttcgttttcggggattttatttttggggtggggttggggataaagggttagggttttcggcgtagtcgtttttaagggtttttagagtttaagttgttttttagggttttcggagtttaagtttgcgttagtttagattagtttgtttgtgtaggggattttcggcggtcgtatttagtttcggatttttagacgcgagttcgattttagcggttttttagtttgggttaggtcggggcgcgtgtttcgggttttttgtggttgtatcgcgcgttttgtgtttacgggcgaaggcgttggaattcggcgttcggagttcgagtttttgaaggcgggaggcggcgttcgattttaggggttgcgttgggttgtcggagttaagagtgtttgcgtttttagtttcgcgttagaagggatcggagttcgagttcgtttcggttttcggggttttcgagtaggtgttcgtcgagggttttagagtgtgattgagcgggttggttcggcggtcgttgtttttcgttttcgttttttcgcgtttggtcgcgttatttattgtcgcgggtgttcgcgtgcgcgtcgtcgatgcggtcgtcggggagcgtttggaggtggaagtcgatgtttacgttgtagtagagtcgtcgtagtcgtttgatgtttagtaggtagtcgtcggcgtcgttttggacggtcgtttttttgggttgcgttgttatcggtaggcgcgttaacgagagcgttattaggtttttttagcggcgttttagttcggtttttagcgtgtcgttgggtgtagtgggtgcggcggcgttttttcggttcgtttagggcgttagtaaggttagtaggatcgtcgggagtagcgttatcgcggtcgtttcgggtttcgatatttcggttcgagggtcgtgcgtcggttaggcggttagtgcgttcgggaagttggggggtagagttgcgtttgtggcgtttcgcgggagcgtacggtcgatttcgggtaggagtgcgtaatcgaggaggtgcgggaggtaagcgacggggttttcgggcgtcgggttttatttcggttgtatggagcggcgagtcgggcggaaagcgcgcggttggagttgggattttgaggagtagtgcgcgtttttttgagcgttaggttcgttcgaggtcgagtcgttatatatatagttcggcgtttttttttattcgttcgttttcgcggggggtcgttcgcgtttttttgggcgttcggggcgttgtggcgttcgcggttggtcgtaggtcgtttgttaattagggtcgggggaagggaggaggttggggattagcgtcgcgagtgttatttggagggatttcggtttttatttttggtttcgttcggtttacggatttgttcgtttcgttttttggcggtttttatatttttgttttttagttagttttgttttttgtattttgtttttgtttgttttcgttttcgtttttttttttgtttcggtcgttttggcgtagttttaattcgggtattcgaagtttttagtgggcgtagaagttagcggttgttgtttgtttttcgtttttcggaggtttacg

SEQ ID NO: 6602 - DNA, 1721 bp, synthetic construct; identical to SEQ ID NO: 6601
  misc_feature 1..1721: note = Description of Artificial Sequence: Synthetic polynucleotide
  source 1..1721: mol_type = other DNA

SEQ ID NO: 6603 - DNA, 615 bp, synthetic construct
  misc_feature 1..615: note = Description of Artificial Sequence: Synthetic polynucleotide
  source 1..615: mol_type = other DNA
tcggcgtttgtcgagcgcgtagcgtcgggcgaggcgcgcgggattagcgggtgttgcgggcgcgcgggttagaggcggtcggcgttttttgttcggtgggttcggggtcgggtcgcgggggtttggggttcggcggggcggcggttttagtagcggcggcggcgcggcggtcgcggagggaggttgagcgcgggtcggttgtgttcgttaagggttttaggcgtcgcgttcgggcgtatttgtattttgtcgcgggaagtaggtagttcggtttggcgttggtttagcgttggcgttttttttggggtatcgcgggttcggtggattggttattcgagaaataggtttatttttttttttttttttttgtgcgggttttcgggacggacgttttaggcgcggcgtcgagtggaggcgagggggttgcggagggggaaggggttacgcgggttacggggtttaatttttgatttttcgcgacgttaagaatgtaggagggtagagttgagggagattttaggtggaatttttaggtggggaaggttgagttgtcggggttgcgggtatcgggaaggtttagggtaaggcgttcggcggtgcgtgttcggaatttcg

SEQ ID NO: 6604 - DNA, 1542 bp, synthetic construct
  misc_feature 1..1542: note = Description of Artificial Sequence: Synthetic polynucleotide
  source 1..1542: mol_type = other DNA
acggaggcgcggcgttttttatagtcgtttttaatgaagggaagcgtgtttcgaagttagtttcggtgcgtttttttttttttcggcgtttttttttaaatttcgtcggatttttaaaggttggaataggcggtgcggttgtagttcgcgttgtaatcgtaggatatttgatggggcggcggcggcgggggtagggcgtagtttggaaagaagggggcgaaagaggttaaatggtttcgttcgtttttttcgtcgggagaattcgtagcggcggggtatagggggtttaagggttcgtttaaggttaagtcgtcgcggggggtagttagggggttttttttggtcggggagtagttcgggacgttttagggttcggggtatagtaggttttttattattgtcggcggcggtttaaagaggtcgggttttagtttcgggggttttcgtagtacggaggtttcggcggggaatacgtcgagaggttcggcggtaagtaagattgtcgttttcgtgtcggcgtcgtagtcgggttttagtagtttaaagaattttacggttttcgcgtttttttttaggtcgtttaagtttacgttcggtttcgacgggttatattcgtcgtcgtttgttcgggacggtttcgtgaagaaggacggaggtagattgcgtgttcgtagcgggatttttttggtttttgggatcgtcgtggttttcgcggggtttgttacgttttttttcgcgtttttagtgttcgtattttttagttcggtcgtcggcgtagttattttatttttcgtcggttcggtattttcggggacgtggcgtagcgagtcgaagagcgcggttagatttcggttttgtaagttggcggtcgcggcggtttgcgacgtttttcgtcggggggtagttttgtcgtgggtcggggtcgcgattgtcggggcgttaggggcggttagcggtcgtttggttggcgtgtcggcggcgttcggggagggcgggtcggggggcgcggcgtttatgaggtcgttgtagcgtttgatttgtttttgtaggtatttgcggtggtttatttttcgtttcgatttgttcggtttgtttagcgttagtttgatgttgttggacgtcgagttaatgaagttgagtagatcgcgggtggtttcgcgtacgttttttttttcggttttcgatagtagcgtattcgtcggagtttcggttttatcgttttcgaaatagtagtttttgtttagggtttcgaaggcgttttttagttcgttcggggagttttcgaagtcgaagggtacgaaagggtgcgtgttgaggagcgtcgtttgtatcgttatcgtcgcggttttcgggttgttcgtagcgttgttcgtgcgttttcgttagtttttgttcgtcgtttagatttagttttcgtttcggcgcggcgcgcgcggcgtagtttattagtttcgggtttggttcgttgcgttgtttttcgggggagtttattaggttttgtaagtaaggggcggagggagggagcgcgcggcgatcgtttcg

SEQ ID NO: 6605 - DNA, 1542 bp, synthetic construct; identical to SEQ ID NO: 6604
  misc_feature 1..1542: note = Description of Artificial Sequence: Synthetic polynucleotide
  source 1..1542: mol_type = other DNA

SEQ ID NO: 6606 - DNA, 1768 bp, synthetic construct
  misc_feature 1..1768: note = Description of Artificial Sequence: Synthetic polynucleotide
  source 1..1768: mol_type = other DNA
gcgcgtcgtgttttttatcgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcgtcgtttgcgcgtggcgtagttaatttgggtaagggaagatcgtttggtttatagttggttggaaagtttaggttttcggcggtagtagtttcggtcgatttttcggtttttcgggtttcgttagaagagcgcggcgtaaagtatttatatttttagcggttttaagtttcgggcgagttttttgggtttattttttttagcggtacgaattgcgcgcgatgcgcgttttgaacgttttattttttagtttgtttttttcgttaggttggaagttagtcgcgtcgttttcgtcgatttcgggcgatgttatcgtttttcgaatatttgacgcggagttcggtattaagagtttcgggttaggaagttgttaggtaggggagggttagcgttagttgtggacgtttcgggatagttttttattttagtttttgtttttgttttcggcgcggcgtaaacgtaaaagttttcgtggtcgtagttttagtttcggtggtcgttcgattttcgtcgggatttcggttgtatttattggagaagcggcggtttcgattttcgaggaggcggcggcggttgtttttagtcgtggtcgttatagttattgttcggtttcgttcgtagttgttttagttgtggtttttgttcgtttgtggtatttatagtttttgtcgcggttttcgtagtttttttttttttttatttttttaagtatcgttcgcgtagcggtttttcgcgagagaaatattttttttaaaaaaagaaagaaaaagaaaatgatattttttttttcgtcgtttttattattattttatttttcggttttatttattttttttttttatttttttttgttagttttcgtttcggtgcggggtttttcgttcgtaggattagcgtagtgggaggaggtagaggtgattaggttttgttcggtttgggattttttgttttgaggtggggaggggagaaatgggaagaggtggagtagcggttttagttcgttttgcggttgcgaggtttagattcgagattaatttttttcgcgataggtgaagttttatcggagtagaaagttgttttatttgtattaagaatgcgcgttggagacggttgtttcggaggttttggttcgagagaaaattagttttcgttgttcgcgtttttcggtagcgcgttttttgcgtttttttcgtcggatatttagtagacgtcggaggtcgggaggttaagattgggcgcgtcgtaggtcgggatcgcggtagaggttgttgtgtcgatcgaggagagggttttgtcgtttttatttgttttgggtgtcgagagtttattttagacgcg

SEQ ID NO: 6607 - DNA, 2656 bp, synthetic construct
  misc_feature 1..2656: note = Description of Artificial Sequence: Synthetic polynucleotide
  source 1..2656: mol_type = other DNA
acgtttttttcgcggtaggaaagtacgttggtgttattttagagttttagagggttgagggaagattcgagttttaaaattagtcgtttttaggttcggcgtcgggaatgttttttagttcgtcgcgtttttttcgtcgttttttttcgcgcgtttttttttttttgcgttacgtttttagatcgttagttattttcgtcgtcgaggtttttttttttttcgtttttttcgttcgcggtttgggaggaggagattgcgagagataagcgcgagggggagattggagaggggtttggtcgtgcgtcggcgtcggttgtgatggggagttcggagtagttaggcggcgagtagtagcggcggcggttgtagttcggagtagataggagagtcggcgttttttttcgtaggttgcgttgtgaattggtttgcggattgggatttcgcgtttttcgttttttttttttcgttgttgttttttttatttcggtttttttttttcgtttgcgaattttcggcggcggcggcggcggcgtttcgagcgtagagcgtttttgttcgcggttttagtttcggttagcgcgcggtgggcgttgcggcggtagtagtcgggggatcggttcgttcggagtaagagcgtcgagtatcgggtgaagaagattacgggggaggcgtttcgtagagtcgtggatcgttagcggaggtaagggtgcgtggggatttgtagcgtgatgatttggttgtttggtgtatcgattggagcgcgtttgtcggagtatagttttagttgttgggtgtaaatgggttgcgaggtgggttggggaggcgagagtcgacgaagcgcgtgggggaaattttttattttgtaaagttttaattttcgcgtagtttcgagtcgtcgttgttatcgttgtaaataggagaagagggtggtttggtttcgcggcgggagtcgggaggtttatacggagagttggttaagtttggggttgaggatttggggaggggttgcgaggggggttgcggattagtgtatttattttcggtttttagtcgtttttgtaggtggatgagaaggtttaggtggcgagtttgtttggtagtcggtgtttttcgggcgtagtgggggatgtttagatgtcgatggatgatgtatttaggggatttcgaggtgtaagttgggttatcgttaggcgaggcgcggcgtagagagggagtttagtttttattttcgttaggaaagggaaagggttattagtttgcgggttcgttttttacgtttgattcgggtttgcggggtttgtggttagggtgagatgtagtgaacggcggcggcggtttttcgattggggacgatattttttacggagtggttggggatagagattgtttttgttattttgataaggagagggaatcggaatgttttgcgagagtgtatgatttttggcgggcgtgtgggaaggttgtttgtttttgaaaagaaagtagcgcgggtttgattatttttaggagtgcggaggagttgttttcggattgggggcgagaacgttaggggtattagtttcgagtttaggttttattttcgggcggttcgggacgaattttttttataggttagtgtgtgtgtagggtaagtgtagggggttgaggggcgttggcggggaggtagtagaggtggtttggattattttggcgcggcgcgcggtgagcgcgaggatttcgttagtgggagtcgttgagttaaagtgtatttggtttttcggtttgtatgatggcgagttcggatatttttagttgtgttgtgatttgaattttttttttttttttttcgttgatttttgttatatgtgtttttcgagatggtttaatattgaatatgattgggttttgcggaaagtaatttttatttattttttatcgttttttttttgtgggcggggggtggcgggggcgtgtttggggtaaggatgtaggggtggtcggagtttggttgcgagttaagagagtcgtttgggttgttcgggatgagaggaataggggtgttttcggggtgtgggtgtgttggcggtgatattttgaggttgtagttcgttggaataatgggtttaaattaggcggtggagaggggttttcggaatggacgtcgggggcggggaggttgcggagattttgcgaggttttcgtgaaggattaggaggggttttcgggagggagtggcgtttgcggttcggagcgtgggcggtcggtggttttggtacgcggaatttggtggatttttagcgtttcggtcgggagttttagttttatttcgtcgtcgtcgcgcgtttaatgggatttagtttcgggtttgggcgaatttgtagtagtcgcggcgggagggagggacgttgggatcgcggtaatgattgaagttttttttttttttttttttttttttcgttttttttcgtttttagattttggcgcgtttgttttttaagttggattttatttttatttataagtgttagataaattcgcgagaattttttttaattcgtttcggttttagttagattagggagggcgtttagggggagggggcgagttgtttgggtagtgtttggggaggtgcgacgcgtttattcggggtttgagcggttggggtttttgtgcg

SEQ ID NO: 6608 - DNA, 623 bp, synthetic construct
  misc_feature 1..623: note = Description of Artificial Sequence: Synthetic polynucleotide
  source 1..623: mol_type = other DNA
gcgtcgtagcgttttttgtttataaagttttgttagtcggagaaggtgtagttgttttaagagaagaagtgcgaggtattgggtacggttagggtcgttttcgcgttttgttcgtcggttcggttttcgtggggttcggtggttcgtattaaggggaggagatagagtagtaagaggtgagggattattttgtaggagttattttttttttgggagtttgcgggtcgggcgttttttttcgttgggatcggagcgcgtagtcggggtgcggggcgtatagtatataaggtcgtttcgaggagttagggagttcggacgcgcggagtatcgcgtcgttcgttattagttcgcggtcggtacgttagtttcgggtttgttggagtatttttatatttttgtttttattaggttgttagggagcgtttttgtttattgggtagcgcggcgtttttcgcggcgacggtgacgcgttttggttttgataagtttggttttttttattttatcgggtggcgtcgttgttgattttacgtttagtcgtttttattttcgtttgaaattttttcgatagggtttcgtttcgggggtttagtttttagcgcgtatatattcgcgtggtgtcg

SEQ ID NO: 6609 - DNA, 1967 bp, synthetic construct
  misc_feature 1..1967: note = Description of Artificial Sequence: Synthetic polynucleotide
  source 1..1967: mol_type = other DNA
gcgcgtcgtttttgttgtttagtcgaatttcgttttttttagggttgcgttgtacggggttgttttttcgagtcgttagcgttcggcgttttttcggcgcgttcgttttttttattttgtgcgttcgcggcggtgggagtagagtcggtcggtttttggggatttagcggtcgcgttggtgatgggtagcgttttttttttaaaggcgggcggcggggcgggggaggtcgcggttcgggtggtgtcgtcgtacgggttcggatttcgagggggaagtggtttgttagtttcggtttcgggaagagtgaataataaggttagggtagtcgttttagatcgttatatttttgggtttaataaagttaggatcgttgttttgtttttttcgttttagaagaataacggtttgtaaaatggggtaaaatgggtagaatcgtacggtcgttgttgttggtgtgatcgttgttgtattttagtcgatatgacgttagttttttatttgttaaattgttggttagttgtaaagtttattttcggtcgcgagtattgaaggatgggagggtcgagcgtcgcgttttgataggaggaagtgcggaggggcggagggcgaggagggcgtgattggggttgtttggtgtgtgcgcgcgcgtgtgcgcgcgtgtgtttttatacgcgtcgcgtgtttagtgttgtacggggcgggagaagaatggtaggtagtcgttcgaaatatttcgttttgttttttttttttgggcgaggttttcgattttggtaaagtgtgaataatagggagttgggaggaagatagtagtgatgttgtcgcgggtggcgggggttgcgtcgtcgtttagagaatttcggtagtgtgtagggaggtgtattttattttggttatttttatttcggtttttttggaaaatttttttgtgcgtgtttatttttttttttagttgttatttttttatttttatttaaggatttgcgttttggttttgatggacgggagggaaggaagaaaagtaggggtcgtagagagttgggtgggttgggcggatattttgggcggggggcgtgtgttgggaagcgatcgaggaaagtcgggcggaggggttgtgtgtcgcggtcgtagttttaggtatcgttgtatttgttttggacggtcgattttcggttggggagcgtacggggcgggttagggagtatttagtgcgtttttttcgcgggcggtataagagtagcgttcggtcgtcgtttttagttaattcgggttttttttacggcgattaattagtgcgaagttggttgggcgggaagtcgcgagaggtttttattgcggcgcgggtggcggttaggagttgttaggatagtttttcggtgttttagtttaacggtttcgtttatttatcgttaagagaaatttcgttttgcggtcggtttttcgtttgttcggtagttttcgaggaaataaaatggagattaggtggttatcgggagtgtttttggttcggtcgttcgtgttcgtttattttcgttttttttacgtcgatttggagtattttatcgttttcgttagcgtttattttcgcgtcgcggaattcgggtttgagcgcgtcgtcggggagggtattttggtaggtatatttacgcgcgtgcgttgatcggtcgatcgcgggtcgggggttttattgacggcggggcggggtcgtggtagggttcggagaggaggggtggggattaagtttagttcgtttggttttgggttttcgttgttatttgggcgggggttatttcggttatgttttttttcgcggtgttcgtgggtgtcgcgacgcgatttgtttatatggggcgggggaaggggggtgtttttgagatattttcgttttcgggtgggagcgtgataatggagttcggatatttggtgggttttttgggggatcgtttggcggttttttttattatcg

SEQ ID NO: 6610 - DNA, 2558 bp, synthetic construct
  misc_feature 1..2558: note = Description of Artificial Sequence: Synthetic polynucleotide
  source 1..2558: mol_type = other DNA
tcgcgatagttaaaaacgggtgtttcgtttcgataatagattttcgcggattttttggtatttggtttattagcgttcgcgaattttgtttcgggagatttattgaaattcggatgtttaagtcgggaggcgcgtagtaattaggaggatgagagggtcgggtttgggttaggaaagcggttttttaaaatagatgttagggggattgtagtttcgagttatgagaaaaaagttaaaggcgagatgatacgtattgaattggggtaaatattggaagaggagataaaattgcgtgtttgagtatcggggtgcggggagggggggataaaattcgtatttagtgtaaattaaaattttgggagtaggtgggggttgttgcgcgttttttatttttagtttttttattaaggattttgagtttttatgtatttttgttttttggttttttttttttttttcgttcggtcggtgagaggcggtcgtcggcgttttagtagtagttagatgttaggcgaagttcggagcgcggagcgtggggaagggaggggaagggaggggaggggaaaggaggggtggggcggggagcgcgcgcgggttcggttagtgcggggtggtgggcgggttgagttcggggacggcgcgggaggggggagggaaggggggtagttgtgggtagggagtcgggttcggtcgttagtattaaagatggagaggcgtcggggttttgtaggggagggggttcggcgttgacgtgggacgcggcggaggcgtagtagtcggtggtgatttgttaatttcgtagtagagaggagttgagggcgatgagagcgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggtttttcggggttggagaggtttggggggcgcgcgttcgtttcggttattcggtcgttgggtttgtgttttttttatttggcgtgttttttttttgtcgttgtagtcgtcgtcgttatcggttgggggtcggttagaagggggagtttcggttgttagtttgggcgtagttgtttttttagttttttttttttagggtacggtcggggtgagaggtggggggcgtagcggtgtgcgggggttgagggcgtgagtagaggggtcggggattcggaggttttgtatcgttaggggttggcggagtaatagagttcgtgggtgtttttatgtatgcggatcggtgcgcgggcgtaagataaggttgtggtttatttatttgtgtgtttattcgtcggtcggttgggaagttagaatcggaggagttgacgagtagatttgggggcggaggggagtaggattgggattgtttacgttttgtttttttttgagaaaacgtggtgggtttttttttgattggatttgatttttattttttttttgtaggggagggagggaagttttagagggtttgtagcgttgcgggtttttttcggttttcggcgggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgcgttggtcgttggcgtcgttggttagaggtttgggatttagtcggtcgtttttagggggttacggttttgggtcggagagggagggcgggtagattttttttcgtttttttttttataattcgttgcggggtttttgtgtttttttttcgtcgcggggcgggttcgttttttttgtcgttttcgtcgcggagtttagttcgttcggattgtcgtcgttttttttcgtttttttcgttttttttcgtttttagtttagtttttttttttttaggagtttagtttttcgggaaaagttgtttttttaagtttgttgaagtcgtttttaagtttcggtgggggtcgttgggaattgggggggtgtgagagcgcggtcgattttcggagttcgggcgggttatcgtcggttttttttcgcgtcgtttggttggacgttgtagttagcgttagtcggatcgcgggcgtcgagcggcgggtgggggagacggttgttcgtgggcgtttagattttttttaggatttaaaaggtttgttttagggcgttaagtttttatttttttggttgtttttttttagtttttagaaatttcgatgtttgcgggaaagtacgcggtggttcggttcggttgaatgtttattttaattttgacggttttcgtttttatttcggggcg

SEQ ID NO: 6611 - DNA, 2558 bp, synthetic construct; identical to SEQ ID NO: 6610
  misc_feature 1..2558: note = Description of Artificial Sequence: Synthetic polynucleotide
  source 1..2558: mol_type = other DNA

SEQ ID NO: 6612 - DNA, 1508 bp, synthetic construct
  misc_feature 1..1508: note = Description of Artificial Sequence: Synthetic polynucleotide
  source 1..1508: mol_type = other DNA
tcgtttcggggcgagaaggagaaaagttagagggttgaataggtgacgttgagtttgttggagcgtgtgtgttttattacgtaagggcgcggagttcggtcgttttatttttcgttatttgcgcgttcgggggtacgttttttgcgatagtttggaatttagattatttgcgtttgtttggtttcgatttagtgtttaggtggttttagtcggaaatgtttgtttttttttaatttttcgatttcggttgtttcgcggattaggtacgtagcgttttagtcgtaggtttggatatgtcggatatttggatttatttttagtaatttttttttttcgggaagagggatacgttttttagtttgaagatttgtttttaggtttaattggttaggcgcggaagcggagaatttcgtattttggggcgcgttgttcgaggtggttacggtggcgtattaagtcggggttaaagtcggggtagaggggtggggtagggtcgggggagggtgatttttgggtttggagaataaatttgttattcgagggatttttagttttcgggatttttattatttttattttgtttttagttaatgcgcggataagcgttatgcggtgcgttaatattcgcgttagggttggggttcgcggcgggagagggacgtacggatatagcggaggaattagtcgtcgagttcgaggtttgaataagtaaggatttttaggttaagagttacggtttgaggatttttcgattcggagggtatttcggggttttagtgttattaagtcgtaggaagagggtaaggggttgggggaggggtttagggtagaattgtcgtcgtgtagggagtagggagatgaggggtttttttgttattatttttacgggcgcgttttaaaacggtagacgcgggtggttggcggagcggtcgggggttgatttttattcggtttttgttagggtgtttgttttttttcgttgcgttttattcggggttttgtatttcggtcggtttttttacgtatttggagttcgtcgggtatttcgtttcgtcgttagtcgcgttattttggtttcgtcgttttcgtcgtttagtcgttcgcgtaggttttatttttgtgtaaagagtttaggagtaggaggaaagttattagttatatgttataaagaggttttatttttcggggaggtggttttgtggtcggtcgtgcggtagcgtttttttttcgtttagcgcgtttttagtcgttcgtattcggcgtttcgttttttttgttttttagtttagcgttcggttgcggcggcggttttttttttttcggtttttcggtttttgttattcgcggggttgggttaggcggtcgtttttttcgttttttcgcggtatttcgggtggtgagcgtcgcgcgagttcggagtttagacggattttagttttataagtttaggaataggagcggcggttcgggttagatcgtttcgattcggtttcgttgtttgagaggcg

SEQ ID NO: 6613 - DNA, 1119 bp, synthetic construct
  misc_feature 1..1119: note = Description of Artificial Sequence: Synthetic polynucleotide
  source 1..1119: mol_type = other DNA
tcgggcgcgtaggcggcggttagcgttggagttttagttagttttttttttttacgtgcgcgttaggttttggttattttggtaattcgtttcgtttagacggtattaggtagttgaatttagttttttgttacgggggaaaatgtttttattgaagcgtcggagcgtagtttttgttttttattgtaagcggcgttatcggattttatttgtaaatttattagtgtgcgttcgcggggagggggttcgggaattcgggttcgggtaatcggcgtcgtatgttaattagggggcgttcgttttcgttttgttcgtggtttttttttttcgatttttcgacgtttcgggaggagtggggtcggagcgtagggttgggaagggttttaggatttaggaaggagacgggtgttttttagagaggattttatttttttcgaggttcgggcggttttcggtttttttttggggtgtcgtagtttttttcgattcgttttttcgtagtcgtagtcgttcgggtttggaggtggtcgggtatcggtgtcgacgtcgcgagggtagcgttcgcggcgggaatattaatgtattttaaagggtacggtcgtcgtcgtagtaggtaattagttggatcgcggcggagcgcgcggaggtggttgttggttgtaaggattgcgtttagttttcgtttcgtttttcgaggttttcgcgtgggtcggcgggtagtgcgtgggttataggaagcgggttgattggattcggtttaggatttcgtataagggtagttttttgtttatagttttttttttagtttttcgtttttttttcgtttatcgtttttttttttcggcgatcggtttcgtcggttgcgggggggtggggggggtggggtgttttgtgtagtcgtttattttttgtttcggtttcgtgttttcgttggggattgtttgcggtgagtttgtcgtacgtacgttagggtcgaggtagtgatgcggggtagcgtgggaggacgggttgcggagttcgcgttattttgtttgtggggagcgttgtgtttgtttttttgttagcgcgtttagttgtttcggtcgtcgttacgcgggattgtttgttatgtcgttatcg

SEQ ID NO: 6614 - DNA, 1119 bp, synthetic construct; identical to SEQ ID NO: 6613
  misc_feature 1..1119: note = Description of Artificial Sequence: Synthetic polynucleotide
  source 1..1119: mol_type = other DNA

SEQ ID NO: 6615 - DNA, 653 bp, synthetic construct
  misc_feature 1..653: note = Description of Artificial Sequence: Synthetic polynucleotide
  source 1..653: mol_type = other DNA
gcggagaagttaggagcgatgaggggcggggcggttttcggcgtttttttttttagtttcgttttcgcgttgtcgtcggagagggattcggggcgtagtcgtttcgtttttgtcggggttttaggaggaatttaagaaaagagagatggagggaggaaatggtatcgttttaggaaggggtaggatttttaggatcgaaggcgttttttttttttttttttttagcgatattgggaaataaagtttcgcggttgaaaagaatattacgcgcggttaggattcgagtagggttttggggcgttaagggcggggaaaatagggtattcggagtgtaggagattttttagggtcgttttttttttcgggggtgttttgaggaatcgcggcggggattcgtcgttggtagtttgcgggttttggtgttagcgcgtatgggcgggttgtgcggacgtggttggttttttaaaggttttagatttcgttcgggtcgtttagttttttaaagttgtgttttaaagtttaggggagatagcgaggttggggacgtcgggaagtttttttgaggtgtggggtttttgagtagaaacgcgcgggggattgttagggttgtagaaattttggttcgaggcggtggttggttcgttttattttcg

SEQ ID NO: 6616 - DNA, 1768 bp, synthetic construct; identical to SEQ ID NO: 6606
  misc_feature 1..1768: note = Description of Artificial Sequence: Synthetic polynucleotide
  source 1..1768: mol_type = other DNA

SEQ ID NO: 6617 - DNA, 1101 bp, synthetic construct
  misc_feature 1..1101: note = Description of Artificial Sequence: Synthetic polynucleotide
  source 1..1101: mol_type = other DNA
gcgttaagtcggttttttaatttggtttgttgaacgtaaatcgttgagagtttgttgtatcgttttttggggtttttggttgtcgagtttcgttaaggtaaagacgttagtaagcgaggaagcgtagcggaagaaaaataagcgggcgcgcgaggggagttttaggagggttgtcgagtggttggtaggcggttttcgtttttttcgggtggtttcgtcggcggttgacggttcggaggacgcgcgtttcgaaaagttagatttcgggcggcggcgcgttacgtcgcgttttttcgcgtttttttttcgttgcgtttcgggaaaggaatttgttttttcggttttaggattggggagtgtgtcgcggggtcgagggtggggaatagttagagggagacgcgaattaggtcgttggcggagggtttagggggagcgtagaggcgacggtttttatgtcggcggttaatatgatggagaatcggtcgttgttcgttttgtaggtgttcgagtcgtagggtgcgttcgagggtagttcggtttggtttagttcgtcgatttttacgtttcgtcgtcggcgttttaagatgcgtcgtatgaagaacgtataggagtagagtttggaggtcgggttggttcgggatttgttcgtcgttttggttttcggtaaggagtttttgtagttgtcgtttatcgagattacgttttttagcgacgaggatatttcgtggtttaattgttttatatttagcgcgttttcgcgtcgaaaacgttttttttttcgtaagtggttgagggtgagggagcggaaggagtgtagtgaaagtaggtacgttttcgtttcgttcgttttttttttttttttttcgttttttttagagtcgtttagggtttcggggtattttgggggaaacgttttgggggagaataggagttcgttattagaggcgtttttggagggcgttgcgtttggttttagggatggtggtatttagtttttacgcgtgttattcgttttttaatttagggtgaggggttttatgttgtacgatacgtttacgtggggttttacgttgtattttattttttttgattttcgtagcg

SEQ ID NO: 6618 - DNA, 1101 bp, synthetic construct; identical to SEQ ID NO: 6617
  misc_feature 1..1101: note = Description of Artificial Sequence: Synthetic polynucleotide
  source 1..1101: mol_type = other DNA

SEQ ID NO: 6619 - DNA, 2341 bp, synthetic construct
  misc_feature 1..2341: note = Description of Artificial Sequence: Synthetic polynucleotide
  source 1..2341: mol_type = other DNA
gcgtggttcggagagcgtggataaggtaatttgttttggatgttcgggagaagggagttcggtcgaaagggtttagtttttcgaggttgttttaattggggcgcgcggcggtttaggagggaggcggggaggttttcgggttgggtcggggaacgtcggtttttaggttgggtagggaggacggtttagagcgcgggttttcgggttttatttcgggaaaagtttgggtttgttttgcgttgttgcgtgttgcgtttttgggatttgttgattgttttagagggaacgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcggtagcggagggtttgagtggaaaaatttttattggatgtattttttaatggttggtttgtttcggttttcgttcgagtttttttcggtagtaggcgttgggttattcgtagttttagttaattttttttttatattttttttattttatttttaaaaagtttgttttcggttggaaaaagtattaatgaacgtatttgtgggaagaaacggaaagtgaatgagttaggagggttattttcggttaatcgttttaggaaaagtaaagaagttaaaggtttttggttttggattttgggggaaggtgatggggggaggtttagatttcgggaattagggcgcggacgttgggcgtggatttcgttattgttttcggttagtttttattttttaggagtaagtattttgtgtgcgtagcgtatgaatgtgtttgggtattttcgcgtatatttatatagtgtgtgatgcgaaaagtaggattagtaggggaggaagagggggtgtggggggggagggaagatgagggagagtagaggggagagaagagagaggagagttcgaggcgagagagagagagagagagagagagagagagagagagagagagagagagagataggatttttttttcgattcgtaaagtgaagttattttttaaaattagttgaaaaaaaagttttattcggttaattgtttttttcgtttcgttataataataaacgtgtataggggagtgagggtagggcgttcgtagggggtacgtagggagggtttagggcgttagggaggtcgcgtcgggttaattcgaaggggttgcgaggttaggttgtaatcgggttaatgtgtggaatattggggggttcggttgtagatttggttaaatggacgggattattaaggtaagcggcggggtaacggacgcgggcggcggggatcggtcggggaggcgaagcggcgggcgggtaggtgcggggttcgcgtttcggaagacgtggtttttttttttttttttcgcgtttcggtttcgcgtcggttttttcggcgttcgggtggcgagttttattcgcgggttagtcggttaggcgttcgtattgagggcgattttttttcgaaattttagtttttaaagtggagtttcggttttttttttatttcgttgttcgtcggggttgtaggaggggacggcgggaaatcgggggattttagggtacggaacggagttaagggcgagagatttcggggtttattatttttatcgatattcggggttttcgtggttttagcgttaggtattgggtttttttttcgtagaggcggaatacggcgggggcgggggttgtagtcgttcgggttcgggtttttgtttggtgggttttggggtgggtaagtggtttcgttgtacgagggtaggggtgtaagtgagtgtgtcgggggatttatttgagcgggtttttttagatggaagtttttgtttatatgttagcgttttttttttttttcggtatttagtcgttcggttttaggcgttggagagtcgtcggtttcgcgggatttttgggtcggtttcgtcgttttttcggcggggaattttttttagttttcgttcgtatagatttttagcgtttcgagttttcgtttttcgcgtttaggcgtgcgtcggttttaggattagggtttttggagttgtcgttttcgaaagggttttgcgtttttcggagtcgttttcgttgtaggggtcg

SEQ ID NO: 6620 - DNA, 3857 bp, synthetic construct
  misc_feature 1..3857: note = Description of Artificial Sequence: Synthetic polynucleotide
  source 1..3857: mol_type = other DNA
gcgaggggcggggggcggggagggaggcgggtcgcggcgttggtttcggggttcgcggtacggttttttttgtcgcgttgtttagggttcggattttgttcggcgttgcgtttatcgcgagggtgttagattcgtcgcgtcgtcgtcgcgtttttttagtcgcggttttttttttcgtcgtttttttttgtttttttagtttttttttttacgtgtggatgacgttaaaatttcgcgaaaaagtcgcgtggtggtttttcgagcggaggcgcgatttcgtcgtttagcggttttttttcgggggcgtttggagggggagaagggcggaggcggtcggtttttttttttttcgggaggtaggatttttcgacgtcgatcgtcggacgtttttcgttttaaagtttattggaaaatttatttttgtaaagtaaatgtatttttagagttattttcggtcgcgtgaggcgtgttttaagttgaattagataggaagagggggaagttcgggttttttaatttttttttttttcgaagggaggggagtgagatgttaggtgggtgatagacggtaggcgttcgtttttttaatttacgtttgtcgtatttgtcgttttagtaatttagtttcgtttaagtcgaaattcgtcgaagggagtgcggatgtataggtttggcggattttgtttttttttagaacgtagcggtttagcgtttcggcgggcgcggttgcgattagagggtttcggaagcgagtgaatatttgtaatcgtattgttcgtttttatttattttgttttttcgtgtttttcgtttttcgacgttttttttttttttttgttcgtatttttttattttgtttgtattttttttttttttttgatgtgttttttatgtgttttttcggatttatgtgttttttcgtattttgttagtcgggttttcggttttgattgatcgtttatttttttacggagaaatataaatatagttttattttttgggggagtcgaggggaaggtagtggtttttatttttgagtttgaatttagttattattcgttttttatttggtttaggcgtttttgcgcggagaaggcgggattcgaattcgcgttgttttcgggttttgagtcgatcgcggaattatttggttgggaggtattttttaggtaagtttgggagtatgtgtgtttagtgttgtaggtttttgtagaaaagtgtttataaatatttaatattttgttgtattttttatttttaggttttgtatattttttaatcgaaattttaaaacgttagcgtagagggtggggagtcggtcggaaaaagaataaaagtttaataaaattggcgttcgttaaagtttattattagttttatatgggatatatatatatgtattttttttttcgtgaagggtgaaaaggagataaggaagaattaataatttattttttttcgtcgttttttattttcgcgttacggtgattagtttggattttaaagttagagtataggtttttgcgtttttttttgaaatcgaagtttatattgaaagaaagtgtgtatttttgtttagaaggtaatatgcgttttttcgcgtgttaggtggagtgtattttaataagatattagggttttaatatatggttggagtggcgattaaaagggaaaatttagtttttagtttaagttttttagagatatttttgttaattttcgtatttttttacgttttattttacgtgtgagagtttgtaaaattatcggggattggattcgatggcgagttttacgttcgggaatagttagtaatcggaaggggaagtggataggggaattttaagaggcgagtttgttacgcgggaagcgttcgaatttgcgggtttttatgaatgtagagggcgtcgggaagggggggtattcggtcgcgattttttttgttttttttattcgttgttttttttttcgttggaatttttttgtaaagtaagacggagtagggggagggggagagggaaggggcgagagggttttcggtttattttcgagacgtgaggattcgttatttaggtatttttttcggggtgggttgggtttcgggacgattattcgtttttttttcgttttcgttgtttttatttcgggagatttagagttttggatgttttttttcggagaagggggggtgtgcggagtcggggtggaagagattttgttcgtagagttatattaagtgatgtttagaggttgggagtttcggcggtttttgttttttgtttgtcgggttagatttatattttaaaaatatttttcgttttttttttttttttcgttttttttcgttgtaattttttttgattcgtttaaaggtggtttaggtgaaattggagtaatttttttatgggggttttaaaatgtaagtgaatgtttttattcggggtgatttaaaagtttaagtcgggaagtttaacgtgattaaaattaataggtgattgttcggggtcgattgtgtgcgggtgtatacggtattcggttcgggtgttattcgcggcgttggattgttttattttgagtttgtaatttgggttttttagcgagttttttttttttttgaaagttaatggtttttatagtaattagatatttttttcgttcgtttttttttttttttttttttatatataggagatgggatatttattttcgttgttattgataaggtcggaggcggtcgggtttttttttagttttcgttcgttttagcgttcgtttttttttcgtttttttttggtttttttttgatgtagtggggaacgcgttttattaaaaaaaaaaaaaaaaaaaaaaaaaaaaagtaatttgttcggtaataattagcgcgtagtagtaggagttttagagttattggttatgtaaatagagggaggggagacggcgttttaaatttttttttatttttttaaagcgatattttttttttttttttttattatttttttcgttttattttcgtttaaagaggttggtttcggggtttgagttaatcgtttgtatttttagtttattcgtttttttttttcgttttgtagggaatttagtgtacggtttatttagttcgcgttttatttcgttttgttggtttttcgcgtttttgttcgggttttttttttcggtgagggaggtatttagtcggtttcggtgtgtttagagagttcgagttacgttatgttcgttgtacgtgttagtttggttagtatattagggcgttggtttttttttttttttttggagtgaaatatattaaagggcgcggtgggggtggggggtgacgggaggaaggaggtgaagaaacgttattagatcgtattttttgtaaagatagttttgatttaagtatgcgttagagtacgtgttagggtcgatcgtgttggcggcgattttatcgtagtcggtttttagggagaaagtttggcgagtgaggcgcgaaatcggaggggtcggcgaggatgcgggcgaaggatcgagcgtggaggttttatgttttcggggaaaggaaggggtggtggtgtttgcgtagggggagcgagggggagtcggatttaattttttattcgttttttttttttttcgggttattttttagaaagttgtatcggtgtggttacgtttagcgtagatatttcgggcggtttgttagtagatgtaggggcgaggaagcgggttttttttgcgtggtcgttggtcgcgggggaatcgttgggagttttgttttcggtttgcggcggttttagacgttgtatcgcgtcgttttacggcgttcgaagagtttttagaaatacgatggtttttgttcg

SEQ ID NO: 6621 - DNA, 1439 bp, synthetic construct
  misc_feature 1..1439: note = Description of Artificial Sequence: Synthetic polynucleotide
  source 1..1439: mol_type = other DNA
tcgttattatcgttattttttcggaattttttgggttcgcgttagttttatttggttacgattcggtaggcgaaggggtgcggaggcggttttattagttcgtttttagttttgtttcgagagagaagttcgttgagagggtagatagttgagaaattcgattttaattttttagtcggcgtttttcgaatcgtttcgagagtttagattagtcgggtagtggatttcggagtaaagtgttatgtatattttggagaggagggaggcgtggagggaaagggcggtaaaaatgaaatgtttttaagttagtttcgtaatttttttcggttcgagggacgggcggagggtagaggaggtagcggcggttagcgcgaggtgagggatttatttgaaggtgaggacgtagagcggtcggtaggatttgtggttggtgttttcggttatgtttttgttttagaagtcgttggtgaagatgttttagcggagcggggcgtcgggtcgtacgtcggggttgtttacgatcgtttatacgtcgtcgtgtacgaattcgttttgtagggagcggtcgtagtataggtagtttgtttcggttagtagcgtcgcggtttcggtcggcgttagttcgtagtttcgtcgtcgggagggtgtgcggttttcgtcgtcgtttcgggtagaggtggttattattatcgcgtcgtcgtcgtcgttgttgttttggtttttttcgggcgtttggtatttttttttatcggggtttcggcggcgcgcggcgtttgttcggaggggggttcgggtatggtgttgcggtagttggattcgtcgcgagtttttcgcgtttcgtcgtcgtttgcgtcgcggagttggtttagttgtaaataaatagtagttttttcgtttttttcggttatcgttatttttttcgttttattgcgtatgttcgttcgtttttttttttatcgttttttaatttcgggacgcgggtcggttttttcgtatagttcggcgttttttgttttcggttcgttttgtttgtaggtggatcggggttcgcggcgcgcggttgttcgggagttgcggggaaggatattttaggtttttatttgcggtgttcggttgtgtttatttttacgttttcgtttttatttttttttttcgaatggggttgggaaggggtatatttggcggatttttttcgggggatttaggagggtttagtaggtgcgtagtttggaatttttatatttattttttagggagaaaagtgtcgttgtttttcgggaagttttcggttttttagtattcgggataatagtagcggcgttcggagagacgttttttattcgtttcgcgttcgcgtttagtcgtcggttttgtgtttttttgttcgggtttttttttattcgttcggcgcggcgtttcgtttggcggaggaattcgcg

SEQ ID NO: 6622 - DNA, 1288 bp, synthetic construct
  misc_feature 1..1288: note = Description of Artificial Sequence: Synthetic polynucleotide
  source 1..1288: mol_type = other DNA
tcgataggttgtagtcgcgggttatttcggaggttaaggtagttatttttgtaagggagttttgcgtttaagtatggtttgttcgtttcgtttggtttttattaataaggtcgggattagcggtcggtggaacgagcgagagtagttttagttttataggtgagtcgtttttataagtagttaagtcgcgagtcgtttcggcgtcgttatcgttcgtatttatttttttatttcgggagggagatgggaggcgtgggagaacgcggagaggcgcggcgaggttgggagcgggagacggcgtcgggaggcgggaagcggattagagaatgggagaagttcggtaggtggataggaggaaataaaatttaaacgttttattttcgaagtcgttaggagttgagcgaaggaaggagcgaggtaggaaagcgtggcgttttaaatatgtcgcgggagcggcgcgggaggcgtagaatttcggagtttgtagtttagcgcgcggggttttagcggagcgcgaggacgcgagcggagttttttcggttatttgtgttgttttcgttttggttgtttttgtttcgagggaagatgttcgagtattttttttattttatttggtcggcgaagtatagttcggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcgtcgttgagagtcggtaatttttaggagttttacgttggttttatggcgggagcggagggcgtaggggaaggagaggcgcgcgaggaggttgcggttgtcgcgaggtttgcgttaattttttcgtcgcgcgagcgagtcgaggcgcgttggaattagagattcggtatggagtgttgaggggaggggggagtcgtaaaaaagttaaagtaagttttcgattcgtaagtacgttttttttttttttttagcgtattggtgtttttggcgggtgtttggcggcgacgcgtttaatcgtagttcggcgcgggcgttaggtgataggcggcggagcgcgtagattcggtttttcgcgttttttgaagaagggattcgtgagggagggagggagggagggcgggcggttcggcgtttttgtcgaggtcggggatgtttatcgttgtttagagttggttcgaggagtttttttcg

SEQ ID NO: 6623 - DNA, 1006 bp, synthetic construct
  misc_feature 1..1006: note = Description of Artificial Sequence: Synthetic polynucleotide
  source 1..1006: mol_type = other DNA
gcgcgtgaagaatttagattttttaatgcgtatattatttttatacgtagggtcgaggcggtagcgcggttcggagggggttcggagggaggggtcggattcgtttcggcgcggtttcgtcggggaattagttttcgagtcgaataaaagtagttaaagattcgtatattcggtagaaggggggcggttttaagaaagttcgggttggggcggtttcgtattttttcgtttttttcgtcgttcgaatttgttgtaaaggtagagataatggagaaagtttcgggagacgcgcggagagattgtttttttggggagggaggggcgggtcgggggaggcggggtaaggaggagggaggggtcgtcgagggcgaggtcggcgtttagcgtcggtttttcgtacggttttttggatgttaaattcggtttagggagtttaggagtcgttgtagttttagtttttttttttttttttttcgatgattcgggtaatgttaattttttttcgggattgaaagttttaaatttaaggtgttaagttgatgggcggtttttgtttttatttttcgatttcgggcgcgtgttttgaaagataggagagaaaaaagattatttagttgtaggaggtaaggttggagcgagtagcgttcgtttgttttttaagtaaaggagggaagtttatgtgtattcgtgtattgggtttcggagtagtttcggggtgtagggtattttttttttagggcgtgcggaggaaggttattaaaatacgttgtattgtcgaggtggagttgggtaaagtaggtagagattggtggggacggatggcgagtttgggaagtttcgggtgttttggtggagaggttttttgtcgggggcggggcgttggagagttttttcggcgcggagagtttttcgggcgcggagagcgtagagaatttggttaggaggtgttggatagtttcggaattcgcgcgttttttgttaaataaagcgtggagattcggattcg

SEQ ID NO: 6624 - DNA, 1185 bp, synthetic construct
  misc_feature 1..1185: note = Description of Artificial Sequence: Synthetic polynucleotide
  source 1..1185: mol_type = other DNA
tcggttttttttgggcgtagtgcgtatcgtcggcgtttttagatttttggattattcggtttgggggcgcgggcgcggttggggagggaggggagagttggtttatttggcgttgaaggttggaaggtatagtttcggtttttcggagttcggttcggtagtttcgtattgttcgtagagggattgagtatttgaaaagtttatcgcgtttcgtagggcgtttcggcggggttaatttgttcggttgcggggtatagttttaggggaattgggttagtaggtaggggtcggagttgcgcgttcgcggtggttagggcggtcgtcgggtcgtggggcgcgggcggttgtagtttgggcgttggggcgttttcgattcgtagtaaattttcgattaggaaatttttgtttaggttgttaaagtcgggcgtagcggggaggttgaggagcgcggaggaagttataacgttttagtacgtatcggcgtgggttgcgatcgcgttggggagtatagtgcggcgttaatcggtttgttgcgcgttcgttttgcgttcgtttgtcgttcgggcgtttcgtatcgtatttagagtcgtagtttttcgtcgtcgtttttcgtagggttggagcgcgcggagttaggtagggaggaaaggttattcgggacggcggcggatttggaacgatattatttatttgcgttgggcgtttttttaagggatgggaggagtgagtgtgggagggggaagttgtgagtttttttggtcgatagcgtaggttttgggagcgtaggggggagtttttttttttttttatgtagatttggacgggttttttttttgttttttgtttttttttggacggacggaaggtgtgtttagtttatttatttatgttattagttttataaagtgatagacgcggttaataataagggtagtgttgtggtaaggggaggggattcgtagtgggaggaggtgggcgtggaggcgacgtgaatcgggcgcgttcgttattttttcgttgtcgtgtagagtcgtggtattttcgttagagtttaagtagttttttaggcgtggggtttggtggacgttggtttggagcgttcggagggcggggtgggggtgggggggacgcgttgtcgtttggggtgttttcgcgtatttttgttgggcgaattttggtttttcg

SEQ ID NO: 6625 - DNA, 409 bp, synthetic construct
  misc_feature 1..409: note = Description of Artificial Sequence: Synthetic polynucleotide
  source 1..409: mol_type = other DNA
tcgtttttcggggaaggggtttttgaggttcgggtggtcgtttgggtaatcgtagtttgtttgcgttttttttttttttcgcgtgggttttagtaatatttattgtagtcgggttaggcgagtcggcgcgtattatcggcgcggggggaggagagggtcgggtttgggaagatgttgcggaggacgttgcggattcgcgagttcggggtaaggcggcggcgtatcgttttttttcgtcgttttttttttatttcgttttttatcgtcgtttttagttttttttcgggatgagagagagtcgcgttgcggagtaattttagtggatgggttcgcgggggttgagcgggcggaggacgcgggaatttcgtgatatcgattagttgacgttgttcgcgtgaaattagagtcg

SEQ ID NO: 6626 - DNA, 1813 bp, synthetic construct
  misc_feature 1..1813: note = Description of Artificial Sequence: Synthetic polynucleotide
  source 1..1813: mol_type = other DNA
gcgggcggcggaggagggttggcggttagatatagtatcgttggagtttagagagtcgggtagaggttggcggagagtcgaggttggtttagtttttaggagatcggcgagttggggtgtgtgggagcgggatgtttttaaggcgaaaagaagcgttagtttcgtaagcggtttttatttgggttgtttaggtcggatgtttaggagtttatagtaggggggatggagcgaaggatcgaggggttgggaggcgaggtcgtagcgtattgacgtaggttagcgaggtcgttggtttcgacgtagggcgttcggtaaggtgtttggtattacgagagttaatttttgcgcgttattttcggaggttagtgcgtttagggcgcgtcggttcggtaggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggggacgggtcggttatatttttcgcgttatttcggtaggtatcgggtgggtttttttttcgttttttggtttgagggcggaattcggagaagagtggaaataggggtggcgtgaaggagagttgggggttgggggcgggatcgggagggggtgttgggggaagcgacgtagcggttgggagattttgtaagggggtttgaagaggagtgggggatgggtatggaagggtgggggattattgaggtgggatgcgagagtggaagggggatttagagggggcgcgatggtcggaggagggggagatggacgatggggcggggcggtatcggtcgtcgcgttttttgtcgttaggttcgtttttcggtcgtcgggtttacgggttttttttggttagcgttcgtttttcgtttttcggcgtatttgtatttatttgttcggcgtttaggttcgagtcgggtagtagtagcggacgtagcgagcgtagtttcgcgtcgtatttttcggtcgtttttttttcgttgcgagtttacgtcgttgtcgtcgtcgttatcgttttaaaaaggataaaacggaatagaaaatgaatgtatgtataaaaaaaatcgtaaaaagtaattgaggaggatggtagtcgcgcgcgcggttcggcggggcgggagtcgagaggtcgcggtattggtggtcgcgattcgggtaggcggtcggcgcgtgtcgtacgcgggtggttgtagttttttcggtcgttcgcgttcggtttaggtacggtatcgttttttttttcggggagttttttcgattggtttgtttttttgttagttaggtaggagggcgcggcgttcgtttcgtttcgttttcgttttcgttttgggtagatgtcgggagtttttttgtcgtcgtgggagggggagttgagttgtcggagcgtgcgtattgggttagcgggcggtcggggtagggttggggtttcggcgttgagcgtttttagtcgcgtcgggtagtttggcgtttcgttgagtcggagtaattttcggtaggagtttttaggttttggttaagtttcgggattcgggaagttatttttgttttcgggggttcgagtttggagtggggtttgtaggtaaagcggggttggggtcgttttggtcgttagtggttaggaagacgtagcgatttcg

SEQ ID NO: 6627 - DNA, 1294 bp, synthetic construct
  misc_feature 1..1294: note = Description of Artificial Sequence: Synthetic polynucleotide
  source 1..1294: mol_type = other DNA
acgtttttttcggatgcgcgtggagcgttttataggatcgtcgttttttgcgcgttggcgcgtatacgtttttcgttagtttgggcgtcgggtttcgaattttcggtttgtaaatttgcgtattttttttcgtcgcgttcgttagataatttggcgaatagttcgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcgttttaaaagtttttttttcgggtttttatttttcgtattttcgtattttgggggagcgtatttaattgaggtaacgtagtttttttttagtgtttgtagaaaaattaaagttaggggggtgagttcgtcggttgttaattttttcgtcgtttttttcgttttattttgttttcgtaagtcgagaacgggttgtaaaagtttgtaatatttttggggggcggaggggggaggggaggggggtttttcgggttcggggcgtcgtcgtaggttcgcgcgcggtcgtcggatttcgcgtttcgggcgttcgttttcggtcgtttttcgtttcgcgttcgggttttcgtcgttttttttttagtttttttttagttttttatttttgttggtgttggaatagttttgtttgcgtatcggggtaggcggttcgtttttgcgggcggatttttggtttagcggggtttttttggagtcggcggtcgcgttcgcgtcgttgttgtttggttcgttggcggcggggtcgggggttgtcggagttgattttatgtttttttttaatgtagagatcgttggagatggcgagtttcgagattttttttattttttgtttttagagtaattttatggtattaaaaaaaaaaaaaaaaaaaaaaaaaaaaaaaaaaaaaaaaaaagaaggagaaggcgatcggcgaaagtaggagggaaaaagtaggcggcggcgggcgggtaagtaaaagcgcgagggagcgcgcggagtgtttgggtggacgtgtgtgtgcgttcgaaaggggataagaggcgggtttggttataggtagcgttagcgagagtttttttagtcg

SEQ ID NO: 6628 - DNA, 939 bp, synthetic construct
  misc_feature 1..939: note = Description of Artificial Sequence: Synthetic polynucleotide
  source 1..939: mol_type = other DNA
tcgatgtcgagagtggttttgttggagaatcgtcgcgtttgtagtttttgtattttttttcggagttgcgttagggaattacggacgaattggaaggggtcgagaagaaaggttttggttattatttttagttttaagttttttcgtttttttagattttggatttttttcggggaggatttttaggagttttttggtagtttttcgtcgtttagggtcgatttttttatttttttttttattttcggttttcgggcgagggaggtttcgcgtcgttttttagattggttgcggtcggaagattgtagtcgttttgagtttattttttgtttttttataattaaggagtatggtggagttgggttaattttaggtatagtttagtcgagttaggcgaggtttagagagatttgattcgtttggtagttttaacggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcgtgtagttttcggtgagggtagttttacgtatagttttttatattttttttagcgtttgtagttttcggtgcgcgtaggttttaagtttatatgcgtagtttttattttgcgcgtagttttatgtatagtttcggacgggtttttagttttattggcgtagaatttattatcgtttgttttttacgcgttttattgggagtgtagtttttatttcgagcgcgtagttttacgtagtttttttatattttttttagcgtttgtagtatttttagtgcgtatagttttgttagtcgttttttcgggcgtcgtttttgtattatttcggtttataattttgcggcg

SEQ ID NO: 6629 - DNA, 939 bp, synthetic construct; identical to SEQ ID NO: 6628
  misc_feature 1..939: note = Description of Artificial Sequence: Synthetic polynucleotide
  source 1..939: mol_type = other DNA

SEQ ID NO: 6630 - DNA, 899 bp, synthetic construct
  misc_feature 1..899: note = Description of Artificial Sequence: Synthetic polynucleotide
  source 1..899: mol_type = other DNA
tcgaacgtagttacgcgtttattggttttttgtttttggcgtttttgggtacgggggagttggggcggtttcgtttgcgtacggcggtgtcgggattgggggcgggtacgtcgttttcgttttttacgcgttcgttcgttcgttcgttttcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgtttagcgagtggggtagcggggatcgagacggacggtagtcgtgttagagttcggggcgttttcggatgcggtaggataagttgatcgggtttttgaggcgcggggggagatgtttgaagcggtagggcggcggcgtgggtattattttgagtaatgtgtttaagaagcgtagttgtatttttcggatcgcgtttcggttgttgtgtattttggagtcgggtgaggattttagggttgtagatggggcgttgtaaagtagcgtcggggttgttcgcgtttttgttttagtttgatttcgtttaggtcggggagttttggggaaagttcgcgtgttatttggtgcggggtatcgcgttggtatttgtagggagcgattggtttggaagggtagagggtagacgggggtttgggtggggtagcggttattttaggcgcggagaattcgttgtttttatttttttttcgcggatttttattttgcggtttgtgtgttcggtttttttcgcgtggcggggaagtgcgggtggttgttcgggtttttagaggtcg

SEQ ID NO: 6631 - DNA, 899 bp, synthetic construct; identical to SEQ ID NO: 6630
  misc_feature 1..899: note = Description of Artificial Sequence: Synthetic polynucleotide
  source 1..899: mol_type = other DNA

SEQ ID NO: 6632 - DNA, 547 bp, synthetic construct
  misc_feature 1..547: note = Description of Artificial Sequence: Synthetic polynucleotide
  source 1..547: mol_type = other DNA
acggtagatttcggagggggtgtttaggatagtgacggttgatatgaagttagcggtgagggatagcgttacgggtattgcggttattttgcggtcgtttattaggaagtttttggaggtttgttggtcgtttttagcgaaggcgtagtagatgtcgatggcggtcgagatgattagtatgttcgcgaatattacgtagttttatattacgaaggtgtcgatgtttcgtggcgtgtttatggtcgtacggtcgtttgagttttgcgcgtaaattggtggtttcgcggcgcgtagtcggagttcggcgcgtattttttatttcggatttttggcgcgtaggcgtggcgtttcgcggggattggaggcgttttttaggtgtcggttttcgaacgtatttcgaggcggggtgagggttggtagtcgtttttgtattcgtcgttgcgagtcgcgttttttaaatttaggtatgggatttcggaaaatcgattcgttgttttgagtgtttattacgtgaggaattggagtggtcgagttcgttaaggcgtcg

SEQ ID NO: 6633 - DNA, 2505 bp, synthetic construct
  misc_feature 1..2505: note = Description of Artificial Sequence: Synthetic polynucleotide
  source 1..2505: mol_type = other DNA
tcgagttaacgcgttttagtggtaggtggcgaatggtcggagattcggttttttagtggtgtttatcgttacgggttttcgttcgataggtttatttttttttatgttggagtaaatttcggttgaaagagggtcgtattaattggtttgcgtattcgaagtgggaatagagagggaggaaaattatgttttaggtgttacggggggaaaaaagtgaaatgcgaatcgtaggggagagagcgatcgttaggtagatattttgtgaatcgcggtggagagtatatttaggtggggaggttatcggtttaatttattatttttcgggagaatgcgggtagggatagtagtagggggtagtatttacgtttttacgtttgtaagggttttttaagtttttggttattgttttttattttttgtagtttcggtgttcgtcgggggcgtgtgtgaggggcggggtcgtatggggaggagggatttaaaaaaaaaaaaaaaaagcgaggtaattagtatttttcgattttattggtttttcgtcgtttttgttttgtatacgttcgttttattggttgttcggggtttgttggggttcggtaaggtttgtagtcgttacggtcgttgttgcgtttcggtgtagggtaggttggcgtcgagcgaattagggtcgggaattgggagtcgggagtcgggagttagttgttcgcggagttgcggcggcggcggtatttggggtggttttagttttacgaatatcgtggtcggcgttcggtggttattgcgtttagcggggtttagggaagagcggtttagatattttttattttggaagaaaggggtaagtttcggcgggagtttttttttcggtttggttcgttttttattgcgtttagtttcggttcggattttggaagatgattttagggtttgttttgtatattttagcggcggtagtttcgggaggtagtcgaaagtattaatagttggtagtagcggttagtggaaaagtgagttaaggcggcgcggattcggtttttttcgcgtttcgcggtattcgttgtttttcgtcgttttttttttttggtttttaggcggttgtagtatgaagtggcgtagcgatggttaggagaggtaagaagttcgtggtgagaacgttggaggatttgacgttggattcgggttatggtggcgcggcggattcggtgcgtttttttaatttgtttttgtgttgtttcgattcgtattcggcgttttcgtatggcgggagttgttggtcgtttttagttgattttatgtatagtcggtataatagttttgatattgttaatattgttttggtggaagatttcgaggggttggattgcgtcggttagtattgttcgcggttgttgtcggatttagacgaggttttttggattttttaggagttggaggcgttgttgttgcgttcgcgggattttcgggtaggttcggcggttttcggcggtttgtttaaggacgcgttggttaagttgtcgacgttggtgagtcgggcgttggtgcgtatagttaaagaggcgtagcgtttgagtttgcgtttcgttaagtgtattaagtacgagatttagagcgttatggagatcgtgttgttttggggtttggtcgcgtattgtacggcggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacgtcgttatttatttgatagtttgtatggagagtttttttcgggatatttattcgcgggtcgtggttttcggggtgtttcggagttgtagtggttttgggttaggttcgggtttcggtttaggttcgagttcgggttttggtgcggttttcgcggcggataaagagcgggaggcgttcgggggaggagcggcgagcggcggcgtttgtagcgtagttagtagcgttagcgggggtagtagttgttgcgtttcgtcggtcgtcgcggtcgtcgtagtttcgtcggtagtcgtcgttaattattattattattattattatgcgttttacgaggcgtttaagtttatcgtggagattttggagtatacggttaataacgattcggagatttggggttttttgtagttttattagtatttgatttgcgggaagaacgttagcggtaagtgtttgcgcgggtgttatttttttttatttaatttggttaatttttggcgtaagtttgtttcgcgtttttttttcgcgtttttttagttacgcgttgttgttttaagtcgttgaggaggcggtcgggttggaggtagttagaataagaggttgtttgtttgtttttgtattcgggtgcgcgtattttacgttgttggtgttgttttaggttcgggagcgcgaggtttcgttttcggtgcggggcggggcg

SEQ ID NO: 6634 - DNA, 1587 bp, synthetic construct
  misc_feature 1..1587: note = Description of Artificial Sequence: Synthetic polynucleotide
  source 1..1587: mol_type = other DNA
gcgcgtttcgatagtttttaagatggtcgttaatgtgggatcgatgttttaatattggaagcgatttgatttacggcgattttaggttagtgcgggtagcgtcggtcgcgcggtcgtgaggagttttcgggcgcgttttgggcgtattggggaggttttcgggcgggtaggcggacgttttggggcggcgggcggcggttgtcggggttcgtcggggttcggtcgttcgttgtttatcgataggtattaggaattgatttcgtcgttgttttttgttcggtttagttatcgattagttgtcgcgattatggagaagcgttagtgagttttcggtcggcggagcggtcgagcggttaggcggtcgggcgaggagcggggaaggtaggggttacggtttcgggtagggggttgttggcgggaattttcggcggttttttttgagtcgtattttgcgcgttttttaatttcgcggcgttcggggaggtcgcggagcgcgtcgtttgttagttcgtattcggttggggtttcggcgagggagggagggagttggcgggtagggaggaggaggaggagaggaggaggaggaggagagaggaggagggagtcggggttggcgaggaggcggtttcgcgtttcgtcgttcgtcggtattttagttttcgtcgttcgtttggttgcgtagttcggacgcgtcgttattcgggggtcgtcgtcgtcgtcgttagagtcgtcgtcgtcggattggtcgtaagcgtcggtagatttttttttttcgggtcggggttttggggttcgttttgttttttgtttttattttttcgttttttttattttttttttaagtttagatgtagacgggcggtggaggtgggttcgggcgttcgtaagtttgcgtttttgtttttagggcggtggagagtcgggagcggcgtagagtaggtgatttttagttttcgggtttaagggaatttttaaatgagagatttttttgtttgttttgttttttgcgttttttttcgttgtttttttcgttttttttttttcgtttttgttttttttttgtttttttttttttttttttgttttttttttttttttttttagggcgatttttcgaaattttattattttttttttattttttttttgtgggagtttgtgtgttttttttagatttggaggtgttttttgcggatttcgtaggagtcggggttgggaggtggaattttagagaacgtatcgtggaggcgcggtttcggtttttgttttttttcggagtgtttcggacgcgtttggtaaggttttttagttttggagtttcgtaaagtttcggcgggtgcggcggggattaggggcgggaaaatggtgcggataatagggcggttagagtattttgttttgatcgtgatattcgcggaagacgcgagattattagtttggagataaaaagggatttatttttttttttttttttaattcgtcggtaaatttcgttaagttttttttgataagtggttttagtattcgcgtttttttttcgttttggtcgttttttagttttcgttttttcgaacgttttatttttcg

SEQ ID NO: 6635 - DNA, 5693 bp, synthetic construct
  misc_feature 1..5693: note = Description of Artificial Sequence: Synthetic polynucleotide
  source 1..5693: mol_type = other DNA
tcgcggttgttgggagagtattggcggtgggttgaggtttttggagagttcgcggggtggagatgggggtcggttttttttcggcgtttagtcgaggagtagttgttagttgagtgcggattcgagagagaattttcgagggatatttacgttttttatcgcgtttgcgtcgggcgttttggttttaggaggttgtttcggggcggggttttcgggggtcgagcgcggggggcggttcggcggttttattatacggcggtttcgttgagttcggggttgggatgcgataggggttcgttgtagtcgttggtgtcgtttattgggaagggcgggttgggttcgtcgttgaatatttcgtcgggtatggggtgtagcgtgttcggtaggtttggttcggggttcggtgtgttcgggtgcgagattatgtcggtgaatttggggttgttcgcggcgtgcgggtcggcgagcggcggttttagcgtttttagcggcgtcgagtcggggttagaggtcgttaggaagttggagtcggtcggggattgcgtttgcgaaggcgggtcgtgcgcgaagaagtcgtagttgtttttcggcgcgtagtagtcgttttggtagtttgtggagggggagcgggaaggagatagggcgcggtgagagaaggcgaagtaggcgggggattcgggattcggggaggggattcgggcgggcgagagaggggagcgcgcgatatcgatttaaggttagagagatttgcggaggtcggcgttttttgagacggtggacgtcgtaggtttacggggagggttggggagagagataatgagagatttcgaaagggtaagagatttagattgttagagattatatatagagacgggagagatttcgagatcgtgggggatatacgcggtaaaaattcggagattttagttataggttttttgatatttagagatggagagagatagaggcggttagagacgtagagatagataatgatttttaagtgttttagggtcggtgagagatatagagatgcgggatagcgagagatagacggagagatcggtagaggggtagagagaaaggcggaaaagagatttagagatgcggagttcgcggttgagattcgaaagttcgagatatcggagggtcgcggaggagtcgaggagacgtagagagaggaaagacggtcgcggttagagatacgcgtggaaattttcgggggcggtagcgagggagttaggagtgagttcgaagatggagagaagtcgatgcgtttagagaacgtaagacggtggattagagatgagttttaggaatttttagagaagcggaggttgataggttcggggagaggaatcgggtagggataaattagcggatagagtagagcgcgaaatggttgagatcgggaagcgatttggtcgggggaaattggattcgggtcgcggtaggagcgattggtgggttgggtcgggcggggcggttttggcgttttaaattcggtttttgcgttttattaatttagtttaagtttttcgtttcgttaagtacggtcgtcgcgtcgatttcggtgagattatttgtatcggtttagtttagtttgagaaagagaaaattgagttttagcgatttgggagagggggaggaggatacgaagattttttgggttatggttagagtttcgcgggttttttggggtagaagttcggttttttagttttgtttcgggttggttttgttagtatttttaggttttgaagtatttgaggatattgagattttttgagaagttggtgatagttatgggtttttttttaaggaaaatgtaaggatgagaattttgtttataaatttaggaggtgtagggatttcggattgtaaatttattttgttttaataaatttgtattaattttttgatcgttttatatagttttttttttagaattttcgggatattttgtttttttttattaggtggggttttgaaggattgacgtgggggacgttacgaaaggattattttgtattaggtattcgttttgtacggcgggaaaattagcgagtttagaagtttgagttttttttgtaaatttattttttttgttgagttttgggattttagttaaggggcgaatttttgatgttttttgttatttttttttttttttaaattttgaaatttgtttaaatggggggtgtttggaggcgtggtttggaggtagtttaagtaatagttaaaacggttgttaattattttttaaaattattaatttaatttttttcgaaagtgaaggggaagatggggagcggtaaatttggagttttaaagggatagggatgggagacggtcgcggttcgcggcgagtcggaaaattagcgaaggtcgttgttttcgcgtcgtgcgcgtcgttttcgtttatatggcggtcgggtcggaggtaattggaataaacgtcgtttgaaaagggtataaaagtcgtagttggggttttgttcgcgtttttacggggagtcgtcggtttcgtcgttcggtttttttttcgttcgttgtcggtcgttatcgtcgggattttttagcgcggattaggcggggttgtttcgttgggggttggggagttttttttattattacggggaacgaggggtttttagtatttagttttttattttatttagcgcgtagggagaggaggcggtgggataggtcggggcgggggcgaagtggttttcggggaaattttggttaattatttaggcggggaaaaatttcgggtcggtatcgtttttattatttcgttgtttcgggtttagattttgtagggaaagaggtaaatttaggtggagagagtcggtgagtggagatttcggaagatacgtttattattcgggttttttagggttgggggtttgttcggggttgggggtttgtttagggttggggggttgtttagggttgggcggttggggcgttttagtttgagttttgttattgtttggggtttttgttttgaaaagtatagtttggtattttgtttataatttttaggggtttcggttcggttttaaggtttaatttttttttaggttttcggatgtgttgaggttagtgatggggttattttttttttttttttgcgtttatttgggtgtttagtttttgttttgttaatattgttattgaatttattttttaagagaaattgtttttttttaatttgcgttataatttagaagtgtagatgttttttagatatagatagttttggggtttttttaaatttagaagttttagaatagaagaggagaggtgtttttttgagtttttagttttgggaagaataggatagtgagtttggtgagtttaagtaatgcggtttagggtaaggagttgaaaaaatcggatagggggagttgggatggtttattaatttagtgtgagggaagtgagaggaggaaaagttgaggtggtaaggggatagtttattttaggtttaagtttggtattattatttgaagttttttgtaaattggggtttttcgttttttgtagttttaaagacggtggaaatttggggttggtttaatatttgtgtttttagtttgtaggaattttaggggtttcggggttggagggtggattatagttttgtttagagtaattgtcggtatttgggttaatattgttagatgttgtgcgtatatatttcgttatatggaataggagttgttgttttcgatgttagtgagtaggcggtttggaatgaatttagatttttattttttttttttatattattttttagcgttcggaatttattttatgttaagtatattaggtatagggcggtaggaaggttgtgcgtttgttcgtgggggtcgtatgtatgtggatttgttagtattggttttagtgtgattggtgggagtgtgcgcgtttgtggagttgtgttttcgtgagtgtatttgtgtgtgagagggtggaatttatttatacgtgatcgtgcgatcgtgtttagacgtgtgtttttggagtttttgaacgtaagtgtgagtgtattttgtgttttgcgtgggtgaatgtgttattgtatttcgtgtgtgtttttgtgtgtattattgtatgggtgagattatgtatttgattttgtgtttaggatatgtgggtgagtgtatatgtgtttgtgatcgtgtgtttagcgagtgggcgatgttttggagcggcggaaagcgtgttggtcgggatttttcgtttttagttttcggaataggataggtgcggaatagcgaatttcggggcgttttttattttcgtagtaggtgtacggggtggattttaatattttagattcgtttaagcggtcgtttagcggacgtatgcgtcgcggatttcggaagaaggcgtgttttcgggcgtttagggcgtttagttgttttattcggcgttttttggatcgtcggttttgaaattatatttgggatagaggagggggttgtgaatttaggattaggagtgttttttttttttttttttttttttttttgattgggttgtttttgttgggtttttgcgtttttttcgtattaggattttttcgaggcggggtcgggtcggattaggtcgggaggggtggagagaggtttcggcgaattagttaagggtgaaggatttcgcggattcgtggggcgatttataaagatttgggttttttggttttcggttcgttcgcggtttgacggttttataaaggtttttttttcggtacggttttcgtttcggtttttcggtttcggagttagtttttggtcgtttgtttgttcgcgtttcggcgtagggagggagggggtatcgtttgtttttttgttcgaaaggtggaggtaaagagggatttcggattttagagaggtttataattttttataagtaaggcggggggcggaatttagagaggtaaagtgattcgtttttaaatcgtaatattaggaggatagtagggttagatggaatttttcggtttatagttttcgatttcgggtaagtgttttattcgggcgtacggtttgtttttagattagaattaggcgcgttcgtagttaaggaagtttggcgggagattttttcgaggttttcggtttttaggttagcggggttaaggagttgtgttcgtttcgggtcgtatttggatgacgcgtatgttgaggtcggttttttgcgttagttgttcgcggatgtggcgcgtgggtttgggcgtggcggcgaaggtagttttgagcgtttttagttgtttggttttgatggtggtgcgggggtcgcgtcgtttggtgttcgagttttgtttttcgttttcgttgttggtcgtttttttgttcgacgaggtcgagttgttcgtttttttggggtcgttttgtagtgcgttttggaggttcggggataaattgcggttcgtataggatgatattgcgggcggacggatcgggaaggggatagcggcgttagcgacggttagacgtttttttagtttagtggcgggttttcgtcggtttaagttacggtttgtttaggttacggttagtttcgttggatttttttttaaatttgcgatagttttttttttagggattcggtgttcgtttattttttttaggcggggttgggtttttggaggggcgtttttaagtttttttcgcgcg

SEQ ID NO: 6636 - DNA, 589 bp, synthetic construct
  misc_feature 1..589: note = Description of Artificial Sequence: Synthetic polynucleotide
  source 1..589: mol_type = other DNA
tcgtttcgttttcggggttttagggaggcggcgattggagtttcgttgtttatttataataaaagaaagtagggttggcgtttttatacgcgtttttatttattgtcggtcgcggggagaattttatttcgcgttttcgttagggtttcggggagttttgggttggcggaggcgaataagatgcggtttgatagaattaggtcgtgtttttgtaaattttaatgtcgtttcgttagtcgcggcggttttttagattttatttgtcggggagtttcgagtcgcgtaaaatttttgtaagttgtgttttgtagaatgtaaagtcgggttggaattcgttattttcgtcgttttagtcgattcggtcgacgagtttttttttgagtttttcgggttatttgtcgggacggttatttcgttcggtgaagtcggtgtatttattatattttttgttgtttttagtagggaagtcggcggtgaggcgggggagtaggtatggtggtttcggggtttatgcggggtttattgtttatttagaatagcggttattgttgtttattagggcgtatttatcgttggagttttcgcggcg

SEQ ID NO: 6637 - DNA, 1294 bp, synthetic construct; identical to SEQ ID NO: 6627
  misc_feature 1..1294: note = Description of Artificial Sequence: Synthetic polynucleotide
  source 1..1294: mol_type = other DNA

SEQ ID NO: 6638 - DNA, 1373 bp, synthetic construct
  misc_feature 1..1373: note = Description of Artificial Sequence: Synthetic polynucleotide
  source 1..1373: mol_type = other DNA
gcgagcgtttggcgttttttggggcgtagtttcgagagagtttttttcgggatttcggacgtaaggtttttgagtggttttggaagttggatttttcggggattttgtttcgaattttggttatttggaagtaattttatcgagcgttttttttattgtttagtttcgaatcgtggcggaacgcgtttttcggtttttttagagttttttttgcgggagaagtataatttttttaggttttggagacggcgtttttatattttaatttcgtttagacggaagaagtgagaggtgcgggcggtttcgttatgatcgcgggaggagagcgtaaggaggtttttcgtaaagttggaggttaggtcggagcgatgtttcgggagcggagtttttttagtttcgggtttttagtcgcggatagttggtagtgttaaagatttcgttattatttgcggttcgtagttgcgattcggtcgtagagtcgggtatcgaggaaggcgtaaagttgagtttgggtaggtataacggtttttagggattggtattttttagttcgggttgttcgcgggagggtagcgagttgtgttaagggtttcgttattatcgttagcgtatagttcggagttaagcgcgcggttgaggaacgattagggttttgtaaagttggagtttgggcgcgtagattttcggatcggagttttcggtttgaggtcgttcgttaggaggaaaatgaggtcgttcgaattaagttgggacgcgtagtaaagttcgagtttttcgcgtatattaggggttcgggcgggagcggggagttttggggacggagaaggggcgcgggacgtttggattaggaatttatttgacgtcgagtcgggtagcgtcgaggttgttttttcgcgttgcgtattcgttcgttcgtttcgtattttttttttttttttcgggcgttcgcggtcgtcgcgtttcgggttttgaatttttcgagttcgtcgtttcgcgcggttggagggcgtcggttgtatttattcgttttttggtaggagtcgcgcgcgtttttttttttttttttcgttttgtgtttttaagatttttttttatttttttttttttagtttttattttttttttttttttttttttttttttgcgtttttttttttagttttagcgaatttaagttcgggacggaggttgcgggttttttcggcgtagtgttgggcgtttcgcgcgcgtttttggtttatttcgttcgttcggtcgttgttcgttgttcggtcgtttttcggaggagtcgcggcgttaagtagttttttatttagcggttggaaacgcggtataaatatgtagggattgagtcgtgagtttagcgagggtcg

SEQ ID NO: 6639 - DNA, 1524 bp, synthetic construct
  misc_feature 1..1524: note = Description of Artificial Sequence: Synthetic polynucleotide
  source 1..1524: mol_type = other DNA
gcggttttgcggattttaggtttaagggggtatcgttttaaatattcgacgcgtttttattattagttttttattggtaggttttaagcgggaacgggattgggaaggtttcgggtttggggggttttatttcgatgttttaggggcgttttgaatttagttttagttaggcggcggtattttaggtagcgtagggagcgcgatcggttcggggagggggaggacgcggcgttttcgttttttttcggttcgtttgtttatttttaggtttttttgttcgtcggttttttggttttgtttattttggggttggtggtgggcgcgggtcgggtttaggtttatgttcggttttttttattgtttgttttttttttttattattttattttatttttttagtgttcggtttcgtttcgttatcggattttttggaatgggggacgcgggcgcgaaatacgaatttagttatcggtagttttttttttacgtgcgttcggttcgtagcgtagagggcggttcggggtgggggcgttttatttttgttttttatggcgtgtacgaagtttttttggtatagttggttgcgaagttttttttttaggttgaagtcgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcgttttttgtattttattattgtaatttaagtaattttgcgtaattgttaaagatgttgaaaagtaggataaggagaggggttcgtatttcgagggtttagttgcgttttacgcggggtattttttttcggtgttttcggaagtattgaagggatatttggggatttttttttgtttttcgttttcgaaatgtgttgggtttcgtttattcggtcgggagtttggttatgtaattcgcgaagggggtttcggatacgggttggcggggtaaatgtaggttttaggaggagtcgttgcggcgttcggttcggcggtaatagtagttttagcggtcgcggcggtagagtcgggaagtcggaatcgggggtcggcggtatttttaaagttggagtcgttttcgagttatcggggaagttggaaagttgaaatggaagggttgagattttagtcgttttcgtcgttcgttcgttagtgtaagaagaggaggtggggggaggagaatcggggtttggaagggggagaggtagacggttcgttataaagttcggatcggagattttaaaacgtattagtagttgttttatttttttataagcgcgcgcgtatatttattttttaaggagatttttttattatttttcgtatttttttgttttttttttttatcgtttagcgttcggttttttagttttttagatttcgggcgaatttcgagttcgtttagtttttttttacgttttttttcg

SEQ ID NO: 6640 - DNA, 1009 bp, synthetic construct
  misc_feature 1..1009: note = Description of Artificial Sequence: Synthetic polynucleotide
  source 1..1009: mol_type = other DNA
gcgtttgtagcgaaggattcgcgtgggagcgagaaatgtttttgtttagtgtttcgcgcgttggatcgcgggggcgagtttgagggtggagaggtcgtcgggtggaggcgcgtaggggtgcgtgggtgggtgcggaaggagtgtagggtatggaggggaattttggggcggcgcgaaggaggagcgtttggaaaggcgcggtgtttggttatagaggggttcggagtgggagtgtaggggtgcggggagggagtgtagggacgcggggagggagtggaggggtggggacgtgttggaggggcgcgtttcgatagaattggagaaattggaaaagtggaggggcggggtagtggttggaggaatttttgaagcgacgcggggaatatgtgaaggagtgttatgttggaatttggaggggaggggggatgttggagaggtatacggtgatggatatggaaggattcgggaggtgtggagtggtgggttcggttcgtcgcgggaaggatatagagggatataggttgttttggagaggcgttttcggatatttggaggggcgtatagtgttgggatttggcggcgtttggggcggaggggcgcgtcggatttagtcgggcgcgttcgggggtcgggcgtagtgggagttgacgggcgtttagtcggcggcgttttgggttcggttaggcgtaggacggttttggtagcggtgtagtagtttaggttagtttttggggggtttttggttttcgttttttcgcgcgtttcggttagtatcgttcggagttcgggcggggaagtgggcgttcgcggtttgggaagttgttttttcgttttggagtagagtcgtcgttgcggtcgttgaggaaggacggagtagaggttcgcgttgtttggggagaagattgtggtgttatttcgtcgggaatgaagggaaatgtagcggttgtttgcgtttcgggattttaagaagtatagtaggtaaagagaatagttacggttcgttatttcg

SEQ ID NO: 6641 - DNA, 961 bp, synthetic construct
  misc_feature 1..961: note = Description of Artificial Sequence: Synthetic polynucleotide
  source 1..961: mol_type = other DNA
tcgtttttttcgatatttaaaagtttcggttttgcgtaatattgcggattttttttagtttttcgttcgttttttttttcgcggggtttcgtttagggtcggtttttcgtttttacgtcgtagttcgggttagcggggttcgtcgcggtggcgttcgcggatgttgtcgtattggtcgttgcggtacggacggcgtagtttcgggcgcggttcggtataggcgtcggcggttttcgttagttagtagttcggcgaggcgttggtttatttatggttttcgggcggcggtttttgcgtttagttttgcgcgtagttttcgtttttcgttcggggtcgtcgagttttcgatacgggcgagatgttgaacggcgtaggtttggataaagtttttaagatgtttttgtcgcggaggtcgaggattcgttcgttcgtgggtgagttgggaggggcgcggcgagggagggtgggttcggggcgggggcggcgcggggcgcgtttgcggttatgcgatattgtttcgttcgcgtttcgtttttttttttgggttttttgggttttttgggttgtaggattcgtcgacgcggcgcgttggtcgtacgggggttgggcgtcgttgtatttgcggggttaaaaggttttaggtcggggcgaggtgagcggcgggcgttagagattttcggttcgtttttgtatagatgtgtgtgtgtgtgtgcggtttttttgtgcgcgtgttcgtgcgtttttacgcgcggatgcggtttagggatgcgatttaggcggtagttatcgcgatggtgggtacggtttggcggcgtagagaagatgtagttttttttgtcggcggtcggtatcgttgtgttgtagagtttaaaagtagagggggaaaaaggtattcgaagggtttttcgagtgatttttattatttggagtttcgggttttcgcgcgtttatagcggcgacg

SEQ ID NO: 6642 - DNA, 961 bp, synthetic construct; identical to SEQ ID NO: 6641
  misc_feature 1..961: note = Description of Artificial Sequence: Synthetic polynucleotide
  source 1..961: mol_type = other DNA

SEQ ID NO: 6643 - DNA, 980 bp, synthetic construct
  misc_feature 1..980: note = Description of Artificial Sequence: Synthetic polynucleotide
  source 1..980: mol_type = other DNA
gcgtgagcgaggtaggtatatacggattcgcggcggtttgtttgtaatagcgttgggaatgtatattggaaaattatattttgtatgttgaaaacgaataattgtttgatatttgggttgttgtcgagaaaattacgcggtagcggtaggtttcgagttaggggtcgttattttcgatggaatatttaaatcgtttatttttatcgaatttttattttttaaacgtatttttcgcgcgcgtgtatatttttaaacgtattttcgatcggaataaagaggggttttagatttttttcgtgcgtacggggtagtcgggagggttacgagagggaggtgtgtgtaatggaagtatcgagatagatagatagatagatgtttatgtattgttgtcgattttttggcggcggggacgggagtcggacgcgagggggatagatagggtgcggggataggcggttcgcgggggcgggggggttatcgagggggttattttggttcgtttaggtcgagggggttttttcggtgttttcgaagcgcgtgggttattcgtgtcgtatgtcggcgtagttgttcgttgtggtaaggggggggcggtcgggtttcggagcgggtcgggagggcgcggggcgcgtatttcgcggtaggtgagcggcgcggttgtaggtgagtagtagtttcggttcgcgcgtttagtttttttcgtcgcgttcgttcggtttatacgtttttcgcgcgcgcgtcgttttcgtttcgcgcgcgttcggtcgttcgttcgttcgtgggattttcgcgaggtcgcgcgtttttacgggttagggttgttttagggtgcgggtaggcgagggcggtttaggggcgcggggcgaggggcgaaggagttaggaggttgagaattgtatggtagttttgtttgtttgtcgcgttgcgcgttttattttagtcggcggtttcgggtttgtatcgggcggggtaggggagcg

SEQ ID NO: 6644 - DNA, 408 bp, synthetic construct
  misc_feature 1..408: note = Description of Artificial Sequence: Synthetic polynucleotide
  source 1..408: mol_type = other DNA
tcgtattttttgaagttcgttgggcgcgttttgggttgtttttttttgagtagtcgggtttagagttaaggcgcgatgattgtcgcgtaagttagggtttacgcggtcggggtttttttttcgtttcgggcgtattagaggttagaaagcggaaagcggttttgttaggttaaggtcgatagaaatcgagagtatgtcgttatttgtcggagagaattgttttgttaggttgttataggtgatttgttcgcgcgagttacggtttttgcgtagagtttttttcgaaggggagagttagagttattcgcgggtttggtcggggttttttttagttcggcgtttacgtttcgcgttttgcgttcgtttttgcggttgtttatgtttaggtgtttcggaagaggcgtcgcg

SEQ ID NO: 6645 - DNA, 2190 bp, synthetic construct
  misc_feature 1..2190: note = Description of Artificial Sequence: Synthetic polynucleotide
  source 1..2190: mol_type = other DNA
gcgtttcgaaatttggttttttgcgtttaggggaacgaggtataaattttcgttatttagttttattgagtagagattgcgagttcgaatttttaagtttttcggggttttgattttttaatggcggcggtttaattgttggtaaaattttcggtttttgattgttttatcgttcgttttttaaacgtttagcgaaggttgatttaggtggcgggcggattttatcgattttttaaattatatcgtttggttaaaatcgttcgtttttttttcgttcggattttaaaggttaggtttgtaagttagtaagttaacggtatttgggttttgggttgtttttgtgggttagggttattgatgttcgcgatacggattggatcgcgtattacgtttgttttcggtagaggttttattcgggtggttgagcgtagcgtattggggtttcgcggttcgagagcggcggggaggagcgggcgttcgtcgagcgtttttcgggatagttcggtttggggatttaagcgggttatgggatgtcggcgttggtttttttttgagatttttttgttttttcgtaggtacgagttttttttaaatcggttttttttttatattttcgtgacgcgaggtcgcggttagtgtttaatattattaaagtttcggttttagtttagtttcgggtagtttggtaggtttttaggagtttttgttttcggtttcgggggattttgcgtatttgttttaggttttttgggaatgggttttgggtgttaggtaggtttcggtgcgtgttgtttttagtgtttagggtttcggtagtgagattttaattcgatagttggataagggattagcgattttgtcgtaaacggatagttttagcgcggattcggtttgagcgttgatgttcgcgggtttaggttagttatttttcgaggcgttttttcggagaaagggcgtagcggttttaagcgtgttcgttgtaattagtgttttaggttttcgtcgtagttagttttttcgggttatagtttcgttttttcgcgtgtatttcgttttggtttcggaggttttgtttttcggtcgttttatcgtagttcgttttaggtttcggtttttagtcgcgttttatttgtgagaagtagatagttgagtagcgcgtatagtaggatttcggtgttttagtagttgattatggtgagcgcgacgcggtttgttcgttcggtgttcgcgtttttcgcggttaacgattcggtcgttagagttcgttttttcgttcgtcgtcgtcggtttcgcgttttgagcgttcgtttcgcggttttagttaggagataattattttttcgggtaattttcgtcgttaggcgttcgttggtcgttgtattcgagtttcggagttcgtttcgagtcgtcgtcgttgtcggggaggagtcgagaggagtgttcgtttggcgcgtttcgagtttttcgcggatttcgatgaagagtagtcgagggcgggggcgatttataatttttttttagtttattttttatttcggtatttttttttggtgacgttaaggggttttttattttttattcgtttttttatttattttttttttttttttaggttcgtttttttgcggttacggagaggggcgggggtcgacgagggcgggtggttcggggtcgagcgcgcgtggggaggtgttggcgacgcgggttcgggagcgcggtttcggtaggtttagggtttttgtttcgcgtttttttgtttttgtttttttttttgtttatcgcgtttaggaaatttttgtagattttttttattcggtttatttagttttgggggtcgttcgaaattggggaagggataaggttgaagtttcgtcgtttggttttaggggcggaaagttcgatttaagggaagttggtcgcgttttcgcgacggtgtttttggtacggaggattgaggcgtagttcggttgtttttttttgtttgtttttttcgcgttgtttcgtcgtttttgatttttttagattgtttcgagaagtttaggaaggtatcggagattttcggtataaggtattgaatttggagcgtttgaggggaattgacgtttgtttggtatttttgggaagattgcgaattagtttaggttttaggggagcgtgttcgtgtttttttcggtcgtattgatgtattcg

SEQ ID NO: 6646 - DNA, 2190 bp, synthetic construct; identical to SEQ ID NO: 6645
  misc_feature 1..2190: note = Description of Artificial Sequence: Synthetic polynucleotide
  source 1..2190: mol_type = other DNA

SEQ ID NO: 6647 - DNA, 679 bp, synthetic construct
  misc_feature 1..679: note = Description of Artificial Sequence: Synthetic polynucleotide
  source 1..679: mol_type = other DNA
tcgagtggagagtagcggtcgtagcgcggcgttaggttcgggttgggttggtcggcgcgaattttcgggggcgtttgggcggttaggtcgggtggcggttgcgtacgtaggagtattttttgagtttagtcgttcggtcggtttgattcgcgggtgatcggatacgagtaacgcgtgcgtttcgatttgtgttttgcgcggggtcgggcggggatcggtcgggggcgtcgcgcgttcggtcgggttgattgtcgggggcgattttcgcggggtaaggcgggggcgcgggagtagcgcgtagttgcggggttattttatttgagcgttttgaggttagggtcggggtttgaggatacggcgttgggtttcgggggacgcgggtttacgtcggcgttcgagcgttattttttcgtttttcgtcggtttacgtagtttcggggttcggtacgtgaagtgtcggcgcgaggttgtttaggttatcgtatgggtcgggcgataaataatcgtataggatatataatattttggattgttataagtttttcgtaggaaaagataaataatatttgaggcgttgcggcgcggttttttcgggttgaataaaaattaggaggtggggggcggtggggcgaagtaaataatagaatcgaagaattgtcgtacggagtttgggtcggcg

SEQ ID NO: 6648 - DNA, 2013 bp, synthetic construct
  misc_feature 1..2013: note = Description of Artificial Sequence: Synthetic polynucleotide
  source 1..2013: mol_type = other DNA
tcggtagatttggagacgttttcggttttttgggagtttttgagggtttaggtcgggtggggcgcgttttgcggtaagttttttttttttagttatcgttttgaggagtagaaggcgcggggatatatatatatacgttcgggtacgtcgtcgtatttttttaattgaattttggtgttttttttttgtttgtaaagatattttaggttttgggtttgggagttgttttcgcgcggttttgtttgattttagcggggttatagtagtttggcgttcggagcggttttagcgcggcgtcgcgggtttaggtgggtgttttagagagcgggcggttgcgcgattgaggagttggaggcgtattttttcgttcgttagacggttcggttcgcgttttcgttttatttttttcgcgtttttttttttggaaaggaaggtcggagttgtatttttaaagcgttttcgtttttatttttttcggttcgtcgcgttttaggggttttataaatttgttgtaagtcgtcggggttgtagttgtaggtaagggtgaggcggggtcgcggtttgggttgtcgagtacgtttttttttagttttaagcgtgtacgttttttacggacgcgtatttagtattttattttcgtcgttgttttcgaggttttcgtttaattagaggtcgcgcgcgtcgcgtcgtcggcgggtagatatatcggtttttcggtttgcgtttttgcggttttggtttcgttgtagcgtttcggttcggttatatttatcgtttcgggcgcgtcgttcgcgcgcggtttcgtttcgggtcggtatttttcggttcggttgttttcggttttcgtttcggtttcggttttcgtttcgtagggttcggtttcgcgatggtggtcgcggcggcgagcgcggtagggagggcgtgtgtatgcgcgtgagagcgcgtagcgtgtgtatgtgcgtgtgcgcgggagggtttcggtttttttgcgcgtttcgtttttgttttttgttcgttacgatgcgatgtcggtagaatttttatcgcgcgtttttattgttcggcgtttatattcgcgtatatacgcgtatatttaggcgcgtatattcggtttcgtattttcgattcgtttttttggagcgtttataaagattttttgtcgggacggtcggagtttgcggagcgcggttttgggttttttcgggattcgtcggttttaggtgtttcgttgtttttcgtagggatttcgcgggcggttcggttttcgtattttgtttggtcgggtcgcggtcgcgtttttagttcgaatttgggtttaggtgtcgattcgggtttttcgtattttcgcgggaagcgtcggtttttttcgcggcgtcgtcgttttttttttttttttttagttcggttttttcggcgtttttttgttttgttttatttgtttagttcggttttcgtttttttcgttgtttttcgtttgtttcgtcgtcgttttttttcgcgtttttttttttttatcgttttgcgttgttttttatatttttcgtattatagcgggtgtcgttcgtcgttcgcggggtttagggttcgagcgcgtagtgggcggcgaggggattcgttacgttcggtttcgtcgtttttttcgtttttcgcggtttcgcggttgttagtttcggtttggcgttagggtggcgacgtttcgcgttagtttcggttgtcgttgatagtttttatttcgttcgggtttaaagggatagcgtattcggttcgatcggttttattcgggggtttcggggaagggatttcgttgcgcgggaatagttcggggcggtggtatagtcggggtcgtgcgggcgacgtttttttcgtcgtcgtggagttcggttttcggggttggaggtgagttaaggagaaggacggttagattacgttatttagggggcgtttagcggttaagtttttgggtcgataatgggtgtgcggcggtgtaggttgagcgttttggattgcgtggcg

SEQ ID NO: 6649 - DNA, 1501 bp, synthetic construct
  misc_feature 1..1501: note = Description of Artificial Sequence: Synthetic polynucleotide
  source 1..1501: mol_type = other DNA
tcgaaagaggggcgcgggtgggcgcgttttttcgcgagtattttatttaagggggaattttttttagcgtacggcgaagttttttttcggttgttttatttggtagtttttttaggatttcggttagtttttaattggttttagtaatgtttagtcggagtttttttgggttttcgagtgggagaaaagtgagagtaggtgtttttttagcggcgcgtttcgttagggttcggtaggatttcgtttttaagtcggggaaagttggtcggcgtttttttttttcgacgaagtcgttttagggttgtttttagaggacgcgcggtaggtaaagagaatgaatttgagcgtttacgaaacgttttgtacggttttcgggagttgggagaaataggtgttttttttcgacgttcgcgggcgacgtttgtcgtattttgttcgttgtcgcgtttttttcgggtatttttcgttttcggcgtttttgttttcgtttttagtgttagggcggaggtagtttcggttcgtaggtaattattgttagcggagttcgtcggggagcgggggtgggcgcgtcggcggtgggcgggcgggcgcggcggggcgcgggtataaaggggcgcggcgcggggtttcggagtttggttttcgcgtagtatgttcgttagcgtttcgtcgcgtcgttcgcggtcgtcgtcgtcgtcgttgtcgttgttgttggtgttgttgggtttgggcggtcgtcgtttgcgtgcggagtcgggcgacggcgcgtagatttgggttcgtttttcgcggttttttgttttcgaggtcgcgggttttttttagggtatttttttcgacggttttttttgggtcgtgggtagcgtcgtttattagatcgagggcggttggtagtagtacggtaagggtgcgtttatttgggatacgtttatttattattttttggtattttcgggagattttcggaacgttagtttgtcgttgggcgtttcgtcgtcgttgtagttcgttatcggggacgtagttagcgatagttataataacgtttttcgcgatacggaggcgttgcgcgagttcggggttatttattatcgtttttttatttcgtgggcgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcggagttttgttttcgttatttcggcggttaggttaagtattggattattatcgataatttttacgtggtggtttggtacggttacgttatcgggcgtttggttttcggtattcggggtagttcgcggttcgggtatttggtggcgtataatttttttttggtgagtgcgaggggttaggcggagggttacg

SEQ ID NO: 6650 - DNA, 668 bp, synthetic construct
  misc_feature 1..668: note = Description of Artificial Sequence: Synthetic polynucleotide
  source 1..668: mol_type = other DNA
tcggggtcgttcgtacgtaacgttttcgggtcgggttaggttggttagggtagggcggtcgtttttcgaggaattgcgggcggggcggcggggttaagttgagcgttcgttttgttttcggcgtttcgcggttgcgggcggagcgggttttgcggagtttttcggtcgtttttttcgtagttttcgtttttagggaaggtaaattacgtatcggttcgcggagagacgtcgtcgggggtttttgtggtcgcgttgggggtcgttttttggtgttgttttcgtcgggttgggcgcggtcggggttgcggggttgtagggttggggggcggcggcggggtcgggttgggcggtagtagttgttggagcgcggcgtttcggttgcggttattagtgtagggatgtgtttcggttcgtttttattgaaatgcggcgtttcgtatagttttattttagtttttttttttagaggagggcggcggcggcggcggcggcgggcgcgttttttttttttgttttattcgtttatacgttttttcgttttttttttttttttttttttttgcgtgcgcgtttcgtcgttttcgttttttttggtagggcgtatttattacggttgcgttttaggttttttttttttttagcgttttttttttatcgtagtaatttcg

SEQ ID NO: 6651 - DNA, 1006 bp, synthetic construct
  misc_feature 1..1006: note = Description of Artificial Sequence: Synthetic polynucleotide
  source 1..1006: mol_type = other DNA
tcgggcgttttgttcgttcgttcgcgcgttttaggatttaaagtcgggttttaagtcggcgttttacgtcgaggtttcgtcgtagttttcggagttggtcgtagataagaaggggagggagcgggagagggaggagagtttcgaagcgagagggtcgagcgttatgcgtcgcgttagtagagattatattaagtatttgcgtggttcggaggagatgggcggcggtttcggagtttcgtacgagggttttttgtacgtttcgtcgtcgtttgcgtcgtattagttttttgtcgtttttcgttttatgttcgtggtttttttggggttggggttgggttaggttgtttgtagcgtcgttttgtttttttattttagagcgtaggtgagtggttatttttttaggggatcgcggttgagagcgtttatttttttttttcgtatttggaaattgagtttggcggtagggttgggttatttagagtttgtatatttcggaagggaaagtgattttagaagggagagaggaagtgttgagtttggggataatttggcgtagggttgtcgggcgtattttgtttttttttcgtttacgtattttagtttttcggtgttttgggggcggatttttttggtcggacgatgggtttgaattttatttcgttttttcgttgggaaataatattggttttttattttttttggtagtgattgtatattttttttttttgttattttttatttgaagttaagaattaatttttgtttacgtaggaaaaaagatgagcgtttttatttgggtatttattttttttttttcgtttattattcggcgggtttcggtttttgcgtttggttgttttgtaggtgtgttggggttacggtgttggagggttgcgcggagcgggaggtcgcggtgttcgtgtttaggtcgtttaatgggtgggtagaatgatacggcgcgattagagaggcgcgggttcgggatgggggttttgcggttgtggcg

SEQ ID NO: 6652 - DNA, 867 bp, synthetic construct
  misc_feature 1..867: note = Description of Artificial Sequence: Synthetic polynucleotide
  source 1..867: mol_type = other DNA
gcgcggaataaggcgttgattgttttttagttttttttttttcgcgttttttcggtagtagcgaaaattcggaaatttgattttggttttaggagagtcgggttttatgaggtgtattgagtatgttttgtagggttcggcgtgggagggacgcgttggcgttttttaggttcgggcggaagcggcgttcgtaggcgttgaaagcgagcgattttttgagttcgggtggttcggcgggtaagggcggcgcgggagattcgtagggcgcgggcgcggattcggggaattagggttatcgttgcgggcggatgggggttatcgaggcggttcgtttttaggcgtatatttcgtatatttttttgttaagtgaaggggttaaaatgtatagatgggggagtttatttaggaatagaggcgcgagacgtatagttatttttgggttgggagtacgagttagtagattttcggagcgcgttaaacggataatatgttcggtgttgtaaatagaggtttttgttggtagggatattggaaagaagggcggagagggagtatagcgaaaggtggggatcgtagaatttggaatttttgcggagatcggaaagaaaattaatcggagtattttttatatgtagagttacggaaattgttttggaaagagaaagtggtagcgtttgggttttttcggttagttcgggttagtcggttgcgcgtgcgaagttttttttagcggagcgggatcggtcgcggcggtggatcgtggcggtttttgtatttttgttttagtcgcgtttggaaatttgagttcggattcgcggttgttgtaaaattcgtttttagtttattttattgcgaattttgttttcg

SEQ ID NO: 6653 - DNA, 1072 bp, synthetic construct
  misc_feature 1..1072: note = Description of Artificial Sequence: Synthetic polynucleotide
  source 1..1072: mol_type = other DNA
tcggttgcgtcgttttagtttagggacgttttcgttttcggttgttatttatcggttatcgagcgttcgtttcgtttcgggtttattatgtttgttgtagtttggttcgtattagaggcgcgataataaataagtgtattggattgggttttgtattcgtttcggagtagttgttttagagattcggtgttgtttatcgcgttgttattttttcggcgttcgggaggaagacgtaattttttcggagttttttttagagttatcgggttgttaggataagttataggtatagaacgacgcggttgttgttcgtttttttttttttttagaaattttaaaggatgtcggtgatagagagttttaattaatgacgattgtgcgtcgtatttggggaagggatatagaaaaaaattttgtaaatatcgtgaggatgaaattgttaaagggatgtaagagttttttaaatattaattaggggtcgcggcggcggcgggttcggcgcggagatagcgtcggcgggattttagcgcggtggtcgtcgttgcgttggggggcggaggatagcgtaggagttgtagtcgtcgttttcgttggagtagtcgaggggtcggtgttatttttgttcgtttttttattattatgtatagtgtgcgttgtaagaagaaggcgggagatgtatgtatattttcgcgattcgttttttttggttcgtttttcggcgtgcgttattgattaggggggaatgtggtgaagacggcgaggaggagagtcgaggggggaggggagggtcggtcggcgcgaatttaggtcggagggtgcgaggagttagaggaggttggagggggcggcggttatagttgggtcggagaaagttgttttttatgtagatggtaattgtgagtatttttgtgggggggagggtgtagcgaaggttgttagggatttcgcgatcgcgttttaatacgtattggagcgagtgtgcgagtgattatgagtgtgagcgggtgcgagcgttcggcggggttgatcgttacgttggcggggtcggcggggttaggtagtttttttcgcg

SEQ ID NO: 6654 - DNA, 1633 bp, synthetic construct
  misc_feature 1..1633: note = Description of Artificial Sequence: Synthetic polynucleotide
  source 1..1633: mol_type = other DNA
acgcgcgtatatatattcgttttcgtttgtttatttttttttcgggggagtcggcgcgcgtttttatttttgtcgtatatttcggcgagtcgagttcgtagcgttttaggattttgcggttcggaattcggattgtagttttgaatttttatggtggttttttaaatattttttttttttttttttttcgttttgattgtatcgtttttatttgggggttagaggagtaaggtagtagtttttttagttagtttttgttggtttgttatcgtttatttggtttataaaagtttgttgagcgtagtttagagggttgcgttgttcgttttttcggttggtagaagggggtgacgttgggtagcggcgaggagcgcgtcgttgtttttggcgggttttcggtttgaggggtaaggtgaagagcgtatcggtcgtggggtttatcgagttggatttgtatgttgtattatgtttttttggatcggggttgtgatttttttttttttggggttgttgtttttttttttcgtcggggcggatgtgaaggttcggagttgcggagaggttcgttaggcgtacggtgttaagggatttagtttggcggatattttttattaggagatcgtaggtaagcgcgggcgcgttgtaggggtaggttgtagttttcggttgtcgtacgttttattggtcgttcggcgtttttttttttttttttgttgttgagttggtgtttattttttgttatcgttatgggatttcgcgttttcgtgttgggcggcggatgtttttgcggttttttcggcgggggaaggtgtgcgttttcgtcgttttattgtgtgtatacgcgggagtattttggttttcgtttttcgttgttttcgcgtttttttattttttagttgatggtttaggttcggttggttagggagttcgggttatttcggggcggttgtaaggcgtagacggagagtcgagtcgggcgtttatttcgcgttttggttcgggtaaatttggaagaattgcgatcgtagtttgtttagcgttatagtttgagtggcgttttttttattttcgtttttgcgtcggtaggggcggtggagagacgcggagggtttttttagttttttttttttttattcgtttttcgggcgatagagcgttcggcgttcgggtcgggggcgggtaaggttgggagggattttcgtcggggatttggtttttggacgtcggcgttttaaggttggtttggggattttacgggttgtttgttttagatgtggggcgggttttttcgttagggttttttagtgtttttttagttgttgttggttatttagggttcggggatattttgttattcggtttggagtcggtttcgtttgttagcgaatagttaattttagcgggtggtttagttggggattcgggttcgggttcgggggtttcgtgtttttcgtatgttcggttattggtattgttttattaagagtttgagagcgtttattttttttttcggcgttagtgtgtgtagtatttggttttcgataatttgcgcggtagtttgggtgtttgtttttcggtttttagttttaatcgaattcgagtttttttggggttttgtgaatgaaacgtgtcg

SEQ ID NO: 6655 - DNA, 1143 bp, synthetic construct
  misc_feature 1..1143: note = Description of Artificial Sequence: Synthetic polynucleotide
  source 1..1143: mol_type = other DNA
tcgcggagttttcgcggagatttgttggagttaggttgtttatttttatttttttattcgcgcgttggtttagaggtttatttaggtagcggttttggtgtcgagggggtaggtgtagcgttgtagtgatgtttagtggtttcgtttttagttatttgttttttaatatttgttagatgtttaggcggggtaggttcgaggtgtcgtcggttttgggttttttaagttagtttaggggtatttcgcggtaggcgttttcgatatttacgcgtaggaatagggagggcgtatcgcggttttcgcgtttcggttaggtcggtaaggattttatcgtttcgttttcgggtggaggcgtttttttttatttttttttcgcgcggggttttcgttcgtagtttttttagtagtttttttcgtagttttagcgtttttgagtcgttttggttcggatcggttaaggaattaacgagcgcgtatcgcgggtttcgggcgtagggtacggagtcggtcgcgtcgtagtttttcgggtatcggcggcggtgattaatttgtaattttagcgtttagagttgttatggtgttcgcgggcggcggcggcggcgatagtgggcgatcggtaggattagtgttaggcgcggcgtttagggcgggcggggacgcgggttttttatttacggcggtttagtttaggtagcgcgttcggttcggttggggtcgcggtttacgttcgtcgtgttatttattgagcgtcgtcgtcgtcgggtaggttgggggaggggtgggagtcggagttttcgggtttttaaaaaattattattttatttaaatttttaaagttagttttgttatagggattgtagtgatgtcgaagggcgggtatcgtagaggaggttgcgtcgtagttggtggggagcgttagggtcggtattggtagtttttttttgtcggttgttattcgtagttagttttatagtaatagttaggtttttatttgcgagtttttttcgggggtttttcgtatttaatagtacggcggcggtgtgtacgggagttcgtcgggtatacgcggggtatatttaagtgtattgttaggaggtcgggagtttagcgtgcgagcgtgaggttagattgtgtacggtatcg

SEQ ID NO: 6656 - DNA, 1143 bp, synthetic construct; identical to SEQ ID NO: 6655
  misc_feature 1..1143: note = Description of Artificial Sequence: Synthetic polynucleotide
  source 1..1143: mol_type = other DNA

SEQ ID NO: 6657 - DNA, 1371 bp, synthetic construct
  misc_feature 1..1371: note = Description of Artificial Sequence: Synthetic polynucleotide
  source 1..1371: mol_type = other DNA
tcggttgagagcgtatggcgttttgagtagtgtaggtttcggtatcgagggcggaaagcgttttgagtttatagtcgtacgatagatcgtcggtttgggttttttaggaattttttgtagttttgttcggttttcgattttcgttatttattagtttttttaggtatttaagagttttttagcggcgggttagggtcggttttttttagtaggtttttttggagagcgggaggaagataggaggcgttttttcggtggagggttttttagcgacgtagttaggagcgttaggaggttataatcggaggagaggttggcgttttagttttagttttagtttcgaagcgattttttttttttcgaggtggttttggttaagtttttagttattttcgttaaatgaggaggtgggcgggatgtagacggtggagcgggaggtttgggcgcgttagtttgggagttagtgcgcggggtagggcgacgggtagcgcggggacgcgaatttttaatttttgcgtttaagacgaaggattcggtttcgatttttttattattcggcgcgtattagcgttcgtttagtgatttttaggtttggtggtggttaggggtgggaggtgagtcgaaagggaaaaagttattttatttaagtcgtcgtcgggttggagttagtttgcgcgggtttcgagttttcggcgacggcgttagtttttttcgttcgttcgcgcggtgttttcgtcggtagttttttcggatttcgcgttttttttcgggcgttcgttttttcggagttttaacgtttgtgcgcgtatttggtagtagagatagtagtagtagtagtagtagtcgcggcggcgatagtgttaggggtagcgagagcgggttagagtttatggttggtggtcgggttggtcgcggattcggacggtcgggagcgggcgcggcggtcgtagagacggttttttttcgcgcggttttagcgtagattttagatttggagtcgtgcgggcggagacgcgcggggttttttttcgtttcgtcgtcgttgggtttttagcgttttcggattcgcgggaggataggaattattcggagtgaagttgcgttaggtgcgggcgggcgggcgggcgtgcgcggggcggggcgtacgtgcggtaggggaaggggttttaggttttagtttttagcgtcgggcgagtttttttttcgtcgggttgggtgtttcggtcggcggcgttcgattagatttgagtaggtgttgttattattattaggaaggagagggatttagtttttgttttaggttttcggggcgtgtgtagttttcgtagggggttgggattatcgggttaggcgggcgtcgtaggagagacg

SEQ ID NO: 6658 - DNA, 1545 bp, synthetic construct
  misc_feature 1..1545: note = Description of Artificial Sequence: Synthetic polynucleotide
  source 1..1545: mol_type = other DNA
acgcgaatttcgcgggtggtttcgggtggtgggttttttttagcgcgtagttttcgttcgtttttttttcggcgttgtagtcgcgatttgggatcgaacggatatcgttttttcggggtttcggcggcgttttgatttttattttttttcgtcgtagtttttggtagggtatttttttggcgcgacgtcgcgttttttttcgggatcgttttttcggttttttagggtgcgtttagttgttgttcgtgcgtttcgttagtttgagcgtttcgggcgggcggcggtggagaagtttagtttagttttttttagtcgcgttttcggttcgcgttgtttttagtttgtaagtttatgacgtggcgacgtcgatcgagatataaagatcgaggttgagatcgttaggggttgagggtgaggtcgcgtttcggggtcgttggagcgcgggcgttatgcgagattgtttcggttgcgcgtcgttttagaggagttcgagcgttttttttagtcgcggcgcgttggttttggtcgggattgtagttaggtgggcgtcgcgcgtgtgagcgtcgcgcgtgtgagcgtagatttggattcgggcggcggaggcgaaagtcgttttattcgcggggtgtaattttgggcgcggaattcgggttgtcgggtgatagtgattagttgattttggagtttatcggaggcgcggtatcggaggtcgtgcggattattgtcgaatagtcgttggagattcgtagagaagggcgggttttgcgttcggggcgtttcggaggtaagttcggagagttcgggtcgggcggagggcgggagcgtacgagtgtgtgtgtgtgtgtgtgtgttcgcggtgtgttcgcggttcggtgtatacgcgcgcgggttgtaaagttaggagttgcgggagcgtttttttgtttcggtttggtttcggagtattgcgggtcgcggaggtgtgggggtttttgtcgttgcgtttagggtagcggcggaaaaggtgtgtgcggatgcggggcggggtcgtatttggtggatagagtagggattcgggaagagaagttacggaagatgattatgtagtttggggtaagtttttttggttgagtatcgttttaggaaacggtgttttgagggttaaatatgtgagttatttgtgtaaaaagtttgatatattagaggcgcgaagtaagatggaaagttggataagttttaggtggatcgatcggtgtatttaatttttaaattgagatttttagttacgttgatgtggaatgggatcgttgtttttttcgagggtttgataaggatgtttaattttatttgttagaaagtacgggagttgggtttggttcgcggggagcgtaagttcgtttatacgcggtttaatttaggtaaatgtagtatgttcgatttgttttgtcgttattttttcgaaagcgataatttttttgggttatcgaatttattagagtagttatttgttttttcgtcggcggtgcggggagcgtaatatttgagtagtttaatttttatagcgcg

SEQ ID NO: 6659 - DNA, 1545 bp, synthetic construct; identical to SEQ ID NO: 6658
  misc_feature 1..1545: note = Description of Artificial Sequence: Synthetic polynucleotide
  source 1..1545: mol_type = other DNA

SEQ ID NO: 6660 - DNA, 1027 bp, synthetic construct
  misc_feature 1..1027: note = Description of Artificial Sequence: Synthetic polynucleotide
  source 1..1027: mol_type = other DNA
tcggtttcggttttagtttcgataacgtttttagtgttcgtagaagcggttttcggatagcgaggatagttcgtcgtcgtaggtttattcggcgtttgatggatatggtggttacgttttggagtataacgtattgtattttattgcggagaggacgggttagagtatttcgggtttttcggttggggtaagggttagcggatgaggggaaaaggtggggtaagtcgttgcggggagaggattagtgcggagggtaggattacggttagtgtggagcgggtgggtagaggtggaagcggttggtgggcgtgagggggcggagtcgggtagttcgtggggcggggtaggaggcgagggagggggcggggttgggggcggagcgtatttgtggttgcgtagtaggcgtattagcgttttggcgatgacgtttattttcgttttgggcgttaggtggaagtagagttgcgttatcgttattattatcgcggcgttgcggttttgtagtaggggtttggtgttgcgtagtagtagtcggtggtcggggtttatgatatagggttttcgggagggggcggtcgcggcggtcgtttttttagatttcgcgtttttggtttcgtttttttttgagtcgtagaaggtttttttcgcgtttttttttagtagggatttttggacggggagatcgacgggtttgtgggcgttttttcgggatatatttcggttcgttttgtttgggttgggtttatttacgttttgggtggggtttaggaattgcgtgcgggcgtagcgggtgagtatgttgatgatgattatttggttttatttttttacgtcgattagtaggttatagagttttcggtagtttttgtgaattaggtcgatgcgtttcgggtagatttttttaaaggttattattatattgttcgttattagttggggaaagaataaagacgagagggtgaacgcgaagggtggaaggtcggttgtcggttattatttttttcggagcgtttttatatacgtatcg

SEQ ID NO: 6661 - DNA, 693 bp, synthetic construct
  misc_feature 1..693: note = Description of Artificial Sequence: Synthetic polynucleotide
  source 1..693: mol_type = other DNA
acgaataaacgttttattttcgggtagtcggcgggtgcggagcgagtattcgtggggcgggataagtgcggaagtcgttgcgttttcgtttttttattttcgggggacggttatttttagggttttcgaggagttcgtttcgtgtatttaggttttaggtcggtttttaagttttggttcgtcgttatattagcggttttttattcgtaagtataaatgtgatatagatattagtttttcgtgtttttggtttttagggttttttttatcgcgttttagtatttgtagtttttttatttttatagcgttcgtcgtcgttaaggtaatagagggatgttcggtgatagattcggcgtcggttttcggcgtcgtaagagaagcgttcgcgcgggcgttttggattcgtagagttttcggcgttttcgaagtttttggtgtggtcgggattcgggagaaggagtagggttggtggggttgttgtagtcggtgagtgtgtgttggcgttgggggttggaattttttaggttagtttttgggcggtgtcgtaggattttgttcgttgcggttttgaggcggaaataggggttggggtcgagcgcgggttggaagttttggtttttggagtgtcgtttttagtttggggtcgaggcggtcgtttgtgtagattcgggatttttaaatagaacgaattcg

SEQ ID NO: 6662 - DNA, 1496 bp, synthetic construct
  misc_feature 1..1496: note = Description of Artificial Sequence: Synthetic polynucleotide
  source 1..1496: mol_type = other DNA
acgtcgagcgattagatgtaaaattttttagcgtttgaaattatcgcggacgtcgtcgtcgtcgtcgtcgtcgtcgggtgggagtcgcgaggagcgtttagtggcgcggtttgtcgggtatggtggtcggttcggcgatcgttgattcgtcgggttcgggggttttggaagcgaggcgcgtttttcgatttcgagattttgtagggttgtaatagacggtggggaggtaaaaaaaaaaaaggaaaaggaaaaaatggtgttaaagttattaagttttatttattgggtagaattaaaacggatatattacgtatttgtaaaatatatatatttatttttatatatatatatattcggagttcgaggaaaggaagagaaggaagatgtagtaggagttgtagtagtcgtcgcgaatggttcgtcgcgcggttgtagaaatgtataagtgtttcgagttttacgaaacgtacgggttatcggagcgtttttttcggtttttttttttttttttttttttttttttttttttttttgtcgcggtttttttttttcgtttttcgttcgggttgggagcggtaggagagcggaattttttttttttttttttttttatattcgttttttttttcgtttgtttttttttttttttttatttatttatttatttattcgttggttcgcggttgtagtcggtatcgttattcgtagtttcgcggtagttcgttcgttttacgtttcgtagcgcggcgttcgttagtcgtagttcgggggaaatcgagatcgaagggaaaaagttgtatttgagattgcgagggtcggggttggggagggagagttggcgagttggttgtacgatacggaaaggcgtttttttttttattttttggttttcgcgttattcggttttgttgtaattcggatcgcggtaggaagtgaaatgaacgtggcggaggtgattggggagtgtttttaagttttgggtggggggcgtttttaagtttgggtgggtggggggcgtaggtttacggacggcgacggggggtgtcggagcgtatagatattttagagaagtatttagagtcggggatcgggatcgtagacgcgtagtttttggtttgaatgatatttattttcgtaatttagagtttggggttttggttttggttgggaggggattgcgggatatggtacgttaggtgtttttcgtgttcgttgcgtttttttggaggtgggttttgtattcggttttgagtaggtatggatcggggaaggaagaaataggggtcgaaagggttgcgttggagagtcgaggtggtttcgggcgagttgtgcgtgtaagagaaatggtcgggggaaattgagatgtaaggggtatattttggtaagcgttacgttagtatcgttagaggtcggtttttcgggtttagttttcgggtgagttgagttggttgtcgggtgagggggcgggcgggttgtttttttcggattcgggggcg

SEQ ID NO: 6663 - DNA, 5820 bp, synthetic construct; identical to SEQ ID NO: 6416
  misc_feature 1..5820: note = Description of Artificial Sequence: Synthetic polynucleotide
  source 1..5820: mol_type = other DNA

SEQ ID NO: 6664 - DNA, 699 bp, synthetic construct
  misc_feature 1..699: note = Description of Artificial Sequence: Synthetic polynucleotide
  source 1..699: mol_type = other DNA
tcgtggtgggcgaggtattcggggtttttttttttttggtttacgaatttttaatttcgaacgttgtgggattgtatgggtttttgttcgggttaatgaaatgcgttgtcgagaggaggttgcggcgcggtttgaggtcggatttttataggtcggagagttttttgtcggtcgcggtcggatttttcgggaaatgggattagagcgcggagggagtttggttaggaggttttttaggatttagtcgcgacgttgaaaagtatgaagggtcggaattaggtatttatttagcgagcgttattaattcgaagttatagcgttaattttttgattcggtcgtttttatacgtagcgtcgggattagaggcgcggtcgtcgttcgtttcgtttttatattttaaacgcgttcgtttcgcgttttcgaggttgcgggtttagggttaattcgtcgcgtcgcgttcgtttggttcgagcgcgcggcgggtcgggttcggttagttggggcgagtcggtttgttcgttggttcgggcgttcggtttcgggttgggtaaggagcgtttggttatgagtcgcgggatagtttaggcgggacggatgcgttttttagggtttaggcgaggtcgcgcggtgtagaatcgtcgggatttttttaattcgggtatgcgtatttatagtagcggtttttggaggtcgcggcg

SEQ ID NO: 6665 - DNA, 1845 bp, synthetic construct
  misc_feature 1..1845: note = Description of Artificial Sequence: Synthetic polynucleotide
  source 1..1845: mol_type = other DNA
tcgttttttcgtcgcgcgttgggggttgtttttaggtgttggtttttgtgtcgagaaaattttgcgaggaggcgagggagttggataaagagcgggcgagggagggcgtttgttagtttgaggggtgcgtcgggcggtgcgcgtatttttttgggtttagtttcgtattcggtcgttcgcggtggttagagtttagtttttttaggttaggagtggcgttcggttgtattttcgcgttttcgggagttgaataaagttaggcgggagaagtaaaggttagcgtttggacgttggagttggtgggaggaggcgagtagaggcgcggagtaaagttgttaaattgcgcgcggagtcgggcgtggggcgggggaagggagaggagggagggaggggtaggcgggagtcgggagggagcgagcgggttcgtcgcgtttgagtaatttttgtttgtcgttgtcgttgtcgttgtcgttgtcgtcgtcggttcggattcgttcggagcgtagggtgtttgtttagttgcgcgcggcgcgcggaggtttcggcgttcgtcgttgcgtttttcggtttttgtttttcgcgtcggttcgcgtgggtttcggcgggcgcgaatttattatgtagttgtagtttcggagttggatgttggtcgcgtttacgttgttcgtggttttttttattttcgtagatattttagagatcgaagaagaaatcgggtaaatagttgtttttaggttcgtgttacgagttttggcgggatttttttttttttttgtattttttatttttcgattttttttgtgtgcgtcgcgtttcgttgtagtttcgttggagagatggggacggtttggtagaaggtggcggcgataggggttcgggacggtttggggagaggagggtgggggcgcggttgttgtggggtgttttcgggcggggtttacgggaagtttttagttggttcgcgtcgggaagcggattcgtttattttgtttttttgtttggcgtgtttaagcgtagtgtcgtcggggtcgagggagggcgtcggggagtgtttcgggcgggcggaggggtcgagagtggagggaggtaggagtttttttgtttttagtacggtcgttttttcgttttggtaaagtgggtagggggcgcgtagggatttttgagttgggggaggggtttttggggtcggagcggagggcggggttttgtatgggttattgggaagcggaatgttttttgtatatatagataggtatacgcgtttttcgtcggttcgggagttcggcgtaggagttggtattattagagaagggttcgtatagttggattgagatttttcgttttcgtttggttttggacgtttagttaagttacggtaatttcggcgattttgggtttttgtgcgttcgtagcgcggagacggagatatttcgggaaagtttgtatcgtcgttcggtgggtttttgggtttttaggcgggcgatttggcgttttttttttttcgatttcgttagaggtagggtgggatcgcgagttcggattttttcggtttcggattttttggagtgcgtatttgaggcgcgggacgtatcggttgtgtgttttaggggttgagattcgcgtttcgtttcgtagttttcggttcgtcgggtcgggttttttttcggaatttttaaagggcggtagacgataggtggggaggtagtcggggttttgaggaggttcgaggagagttttttggttttgggtaaggggaaggtgaggttttaaagagggtagaaggtttttttttttgtgggatttgtgttttgttaggcgtttttttcgagtttcgcgtcgcgtgcg

SEQ ID NO: 6666 - DNA, 1844 bp, synthetic construct
  misc_feature 1..1844: note = Description of Artificial Sequence: Synthetic polynucleotide
  source 1..1844: mol_type = other DNA
tcggcgattttttggtattttggatagtttttcggggagtagtttatcgttaggcggcggttgttaagagaggaatttttttgacgcggagtttgtcgtttcggggttcgtttttcggtaggttcggggagaggtggggtgataatgggttggggtgcgcgcgtgttttataggtgcgagatagagcgagtcgtcggggtgtgagttagcgcgttgggggttaagaagttgggtgaatagttacggaattttatttacgttcggtttttttatttatttcgtttatagcgcgtgttttagtttagggcgtgcgtgcgttcggtgttcgatttcgggttgtgtgtgtttatttggcgagatgtcgagagcggggggagtgtttttgtcggtgtatttgggtttaggttaggggattttttttttttattttcgcgtgggtgtgggggtgtgttcgggttagggcgcgtgtgtttttgtgtttgtgcgtgcgtgtgcgggttagggtggtgggatcgcgtattagggtagggtgtttgcgtttgcgtttgggtttgtttggtttgtatgtcggcgcgatttcgatttggattcgtgtttttggatgtcgagaggttagcgtggtgggggtgtttagtttttcggaggagtattatgttttgatattttcgttttatcgttttaaagttggtttggggtttcgtagggagtggtttgtatggggagggttcgcgtgttgtgtttttgggaggggtaagagagtgggggcgtagggggcgggttaggtttttgggcgcggcgcgggttcgggggattcgcgcggttgacgttaggttattttttaaatagagtcggtagcgcgtttcgttcggtatttttcgaagagttagatcgcggtcggcgttagcgttatcgttcggtttattcgttagttcgtatagtcgcgtcgtcgtcgagcgtttcgtgagcggcgtttcgaggattaggaatggggtttcgggcgttgggcgcgtttcgaattcggcgtacgtaagagtttgggagcgttcgagtcgttcggttgttcggagttttatcgtttaggatcgggagatgttggaaatgtaatcgtttgtttttcgaggagtcgttgttttcgggattttttggtattgtgcgtattttggttagtagttttcggagaagacggcgtttttaacgttcgattcgcgtggtcgtggtagcgttacgcgagttttttaggcgatcgtagggttatagtagtttagtcgtcggtgttttttcggaaattatgattttcggcgcgggtttatggagttatggtttatagggttttgggtcgcgcggggttattttagtcgcggagggcgcgtaggttgtttttcgtttttacgttttcgtttttttgtatttatttgtgttatagttttttgtgttgttgcgacgatttgggtcggagtcgttttttcggcgcgtttcgttgttttcgcggttttagcgcgggcggttagaaatttttttagaagtttcgtttttgtgattttttcgggtcgacgtttagcgagtttagcgtttttagcgcgttcgtcgtcgtcgtgttcgtttttcgttttttcggttttaattatttcggtttatttaagttgggtattaagcggttgttttaagtttttattgtgggcgtgaagaaggggggtattcgggtcgtgttggagtttattcgagtatattcggacgtgcgggttttgggtacggaattttatttttttgataggaattacggtcgcgggttggattggtataggtaaggattaggagtttcgtttcgtgcgtcgggtttttgatcg

SEQ ID NO: 6667 - DNA, 1480 bp, synthetic construct
  misc_feature 1..1480: note = Description of Artificial Sequence: Synthetic polynucleotide
  source 1..1480: mol_type = other DNA
gcgggtgcggtttttcgggagttcgcgggatttttttattttttattttcgtttgggaggttcggcgtgggttggcgatgggggtggaaggttttcgggtttgtggatttgcggtaggaggggcggttggtagtaggagtttttgtattatttttatttttaggggcgtttcggggtgggtgggggtatttagtgtttcgcgaaaggaagaggaggagggggcgagcgtggagatgagtttaggagcggaaagtagcgcgcgttttttcgatcggtagcgggggtgggcgttttttcggggcgcgggagcgtttttaaagtcgcggggcgttcgtagcgggtaggagttttgttttgtatttttttacggcggggcgtttcgtacgtttttttatgttggttttcggtttcggaacggcgcgcgttttttgtttcggaacgtcgtttttagttaggcggagcgttgggagttgggtttaggcggcgggaggagggcgaacgggttcggggttcgggtttcgatggtcgcgtcgtttcgggggagtcggagtcgagttggtcgtcgttcgcgcgtatttattaagttcgttgagttttttttcgtacgagtattagatgtcggtgtggaaatttttgaagaggaagcggtcgtcgtcggttttttagttgtagagcgcgtcgttaggggggtcgtttttcgaggcggtggcggcggcggcggcggcggcgggggcggcggtgtcgttggtcgtggcgttggcgttcgagttggggtagttggcgcgttcgttttggtcgtagttcggtttggggattcgttgcgtgttttggtattagtgcgtggtgaggaaagcggtggtggcgaatagtagcgttagtaggtttagggttacggttaggagcgttcggtcgcggcggttagtttttatgtcgttcgcgtcgtcgggacgggattgtatcgtcggggagtttcgcgcgcgaagttggtagttggcgtttcgcgttagcggtcgttgttcgtcgcgtttcggggttcgggtgtttgagatcggcggcggcggacgcggcgcgggtttatgttttttttaatttcggggtgggggcgcggcgcggggggcgtgcggggcgggttggcggggcgggcggcggtggaggagcggttacggcgcgttcggagttcggagcgcgagtgtatttcggttaggagtcgttggcgtttggtagcggttacggcgtagggacgcgcgttttttcgtggggagatatttgtaggcggtcggcgatattgtttcggagttcgttcgtacggggagagggggtcgttacgtcgggcgcgggcgggggtttgggagtggagggacgttttcgaaagaaattcgagttagggtgagggtttgagacgtaaggagaattttaggtaaggcgtttttgagaaaagatttttacggcggacgtggggtaataaaattcgtcgggagcg

SEQ ID NO: 6668 - DNA, 5065 bp, synthetic construct
  misc_feature 1..5065: note = Description of Artificial Sequence: Synthetic polynucleotide
  source 1..5065: mol_type = other DNA
acgagtcggggatttgggggttcgggcggtcgtagtttagtgggttgaggtgtcgattagggttacgtttcggagttttgtcggggtttagtttttttttttatattttaaaatgtcgtttagggcgtgggtatttcgagtggtattcggagtcgttgagatttcgtcgagattgttttttgtgcgtttttttatagtcgagaggttagtatcgtgtcgggacgattcggggattcgagttcgggcgtcgttatatcgtttcgggcgttaggtttgggagttttgaggtcggtatcgtgaaatatttttaggagtaaggagggattttaggtgttttttttttgtattttaattttttgttcggattttttttattttttgttatagtttttatatataaattttgttttggatttgtttagttttttcgggatttatagttgtcgtttttatcggagaaaataagtgtttttgttttaggggggattttattttggttggttattcgtaaatttggaaaattattttatgattttttttttgatttttttggaagtagggagtattacgattcgtagagggcgtatatcgattagaaagattttggggggtagagggtgtaagtgttgtgggaagagatgcggagataaattttgcgagttagatttcgatatttttttcgttcgtttgtatcgttttcggaataattggcggttagtagtattttttatttcggtcgtaattttagcgggttaggcgttggcgtttcgatattagtttttatttttttgtagttttgaatttttaaagatattcggttttgtttcgtaggtcgagggggagtgtgcgtgggggtaggggggcgtagcgaatttttttacgttcggagtttagtttagcgttcgaagtaaatttttttatcgttggtagtaaggtcgggcggcggaggtcgggtcgggtgttttggggtcggcgtcgggagcgttaggggtttcgtgcggttaggtcggggcgatttttattcgtatttacgttttatggggttttcgggttttggtcgcggttgggattttcggaaaagtagggacggagaagttaggtcggtatgttcgttttttttttttcgggaggatttaataatttcggaaagattttgtcgggagatgtgttcgtttttttcggggtagcgggggaaagtttagtaaaggtatattgaaaattaaaaagaaaaaaaaaattacgtcgagtggaagaagtaatcggggtcgcggcggcggtgaggtagggggcgcgggggttagtcgcgtgtgagtgggttcgagtgtgcgtgagtgtgagtgcgtgtgtgtgtgtttacggcgcgggtcggagtatttattatttcgtcgggggagcgaggttatttcggggtcggattggaaatgttgaggtttcgtttgtttttttcgcgatatgttggtttaaatattagttggggtagaataaaaaattattaaaaaaaaatttttttaaaattacggaaatcgagcggcggcggcggcggcggtttttttcgttcgtcggttcgttcgtttttttttcggtttttcggtttcgggcgtagcgcgtatgtgttttgttataattatgattattaataatgtattgcgattaattatagaggggttttttgaaaggcgattggtatcgggttagcgttatttaaattcgttcgttttaattaattagttcgtgatttgttgtagatttttgttttttcgcgcgttggtttaataagtcggtcgcggggttggttttgcgcgtcgcgtcgttcgatattgggttaattttttttgcgatcgttcgggatttcgcggttcggtcgtcgggggtcggttttttttttattgcgggttcggcgtttcggtaggcgtttttcgttttttttttttttttttttttttttttttttttttcgtttttttttataatttcgggttgggtcgatttaaattagtatgtttttttcggaattgagtcgtttcgggtggggggtggggtcgggcggcgagggttggggattcgggttgtcggcgcgttgcgaattttttaattcgggggcgaggcgcgtcggttcgcggggggagggagtttcgcggcgggattaggggggagggcgtttcgtttcgtgagtgttttttcgtttttttaagagttattagaaagtagtttatttttatttttattaaaaaaaaaaataagcgagtggggaagagttagttttacgtcggttcgtttttcgtttacggttcggtttttttttcgtttggttcggcgttttttcgtttcgagttttttattttttggatttcgggttcgcgggggcgcggagaagaggatttaggaaaggtttgggaatttgatgggtttgtggttggggggaggggtagttttttcgttattttatttttttttcgttaggggtattgattttttagttttttgtttgttttttcgttttttttttttatttcggatatttttaggataattagggttgaagttttcgggagaagtagtttcgagttcgtgggataagggggcggttcggtttcgtttaggatttttttcggatttttttttcggttgtttcggttggttgtagggcgcgttatttcgcggggaggcggcggtagcggtggcgtcgtagagtttcgggcgggcggagagcggggatcggtttgggtttcgagtttagtttcggtcggggggaggggaggggttgcggtttatattgagcgtagtagcgagtatcggtttagggagatatagttcgggcggattcggtattggattgggttagtttttgggatttttgggtatttcgttttggggagggggtcgcgttttagtttttcgggacgaggtggcggcgtagagtcggaaagcggggtggggggagggcggtggggaggtgttttgttcgaggttgtttggcggcgtcgaagttcgtttttattttttgggtatttgtcgagcgcggcgttcgaatttttcgttttattattattttttttaagttgagatgtaatttttttattttcgttttagagtttagagttaggagttcgatttttttgtcgggtttaggcgttcgcgaatttgagattcggtacgcggtttagtttagtttttttttttcgcgtttcggggttttttcgttttaaggttttcgaagttttgcgttcgaaggattaaattaaattaaatttcggttgagtaatgggggaggaggggggtgtagatatataatttttgttttattttacgattaggaaaggagagggtttataaggacgttttaattcgcgagcgtttttgagtttggtcggtgttacggtcggttcgcgcgaagtgggtatcggtttttcgagtcgatttcgtgtatttcggatttgtattgcgtttcggtagaggattttttttttttttttagttttttaaatttttttttttaaggtgtaaatgtgtgtgtgtgtcgatgaatgtttttgttttttatttgttgattttatttttttttattggtataattttttttttttttttttttgttcgttcgttttttatttttttttttatttattttttgttttcgtttattttttaatatatatatttatatttttttcgtttcgttttttcgttttcgttaggttttgatgggtatagtagattttgataaaaagataaacgaagttattagtggggttgatgttgaagaatgaagataataatgtttttataggtggtgttttaaatgttattattttttattgaatatttaaagagatttttcggtaaagatggatttgcgtatttttggggtgtgagcggttcgtattttttagatttcggggaacgtgtacgggagtacgtgtaaatttcgtattcgtttttattttataaataggggttttcgtatatttattaatttatattgttttaggtatacgaacgcgtttgtgtgtatttgtatatttttttttcggaatgtgttcgtgtttggagtcgttcgtatttttttttaataattttggttttttgaaagttcgggtttttcgggtatcgtatgtagttaggaatttagcggagttggcggtttcgtaaagttttttttttggtgcgcgtcgcgtgcgtagtaggaagttttcgggaataattttatacgtgtttgttatttggtttacgtgtgatttaagattaagtgtaggaaaaaaaaaaattttttttttttaaaaaaatattataataaataattaaacgaaatgaatatgcgaaaagtagttacgcgatgtttaattaaaaatgggcgagtagagacgaataaattgggggatttaaattttaataatttttttcgtttttttgcgttttcgacggcgtagaggcgggcgtttcgatttgcgtttggcgtttttcgttaattttttgtttgttttttttttttcggtggtttcgggaaaggagatgggaggtggaggagggggggatgggaggagggggatggtcggaatggcggggagaggagaattggtttttattgttgatggtaatatattaattacgggttattgtttcggttttaagtttcgtggttcgttggtgcgggcgttgtagtgttagggcgttggcgaggtttcgcgtgtcgcgatgtaaagaaatatattaataaaaatagaagtagagtgggggttattttttatttttgtgcgggtcgaaagtaggcggcgagcgggagtgaggtgttatttttggagtttttttacgcgttttgtttattttagagatttgcgcgttttacgtgcggtagtatttttttaattttgggtggaggtggggtgggggggggattattggggaattcgggtagcgaagtttggatttgtaggtttcgttagagggtttggtatttaggggttgattcgtaatagcgaatggggatagttcgaagtgaggcggtagttgcgtcggggtcgcgattttattggcggagaggaatcgtattcgggggaggcgtttggcg

SEQ ID NO: 6669 - DNA, 2372 bp, synthetic construct
  misc_feature 1..2372: note = Description of Artificial Sequence: Synthetic polynucleotide
  source 1..2372: mol_type = other DNA
tcgcgattgcgtaaatttcggttttgatattttagttttaggttttaatttcggaagggtttaggtttaagtttgtacgtcgcgttgttatggcgatcgttggttgtttttttcgttttgttttttgagtacgtggtattaggatttcgcgttttttttagttcgagagttaggtttggtttagagtcgggtttattagtatttcgtttgcggcgttttttcgatttttcgtcgtgttttattaggttcgtttatttagtagcgatagattttcgtcgttcgcgcgattttatcgtttttattttagttttttttcgagggttcgtagttcgttttgttttcgagcgtgtttagcggttttgggtattggcgcggttttatttagttatgtagtgtttttttatatattggtcgcggttattggttgtagattcgtcgcggaaagggggcgttttgagtttcgttcgtaggtagcgcgtttcgagagattcgttttaaggtattttcgtaataattttgtgggggtatttaattttttcgtgcgtcggttaagatttttttatgttttttgtaatgtattagattagggaggtaaatatcgaaggtatttgtattgcgtttttattgggatgcgttgtgcgtaagagacggggatcgtttgttgtaaaatcggatgatcggagacgtagggagttaggagtgggtttttttaggatttattttatgtagtttttatatggtttttagagttttgatttcgtggttggagtgtttgtttttttttaagtattggtagtatacgggtattttgtattgtacgtagtatatgttgtggttttttagttcgtggtttgtgtaggtggagattttgcgtgggtttagttttcggtttatacgattttgggtcgggggtattaggcggtgtttggttaggggttttcggggcgggtggtagcgtaggcggtacggatcgtagtagaagatatcgtattgttcgtatatgacggtggtttttttgggcgttttttcgtagagttggtatttgagggtcgcggttttgttttgttggtagcggttaattattttttttagtacgcgatttttggggaagtcgcggagttttcggttatttaggatgaggttgcggtgatattgggggtaggtgatataggagttgcggggtatcggggttagggtcggtgataagtgggtggtcggtggcggtatagtcgggggaaatacgcggacgtcgttgggggatttttggtacggggtagtgggggcgttggcgaatttttcgtaggagttatagtcgttgttcgtttcgttgtataggtttattttgtttaggtttagatagttatagtcggagatttcggagttcgcggttcgatggttttggggggatttagattttggggtttgtattaggatgttgcgggcgtacgtttgatataaattgtgagagtagggtaggatgatgggttttcgatagaaggagtcgtatacggggtattttaattttttttttattttttttatggggatcggtttgggaggagatagcgacggttgtagcgggtgtttgagttggcgaggtggtcgacgggttcgttttgtttagtattttggttagcggcggcggttgtggtggtggtgttttttcgcgtagtattggtacggatatttagagaggcgttagttttgtgagtcgtagtcgcgtagtcgtcgcgtcgcgcgttagttcggatcgtttttatttgtttttttagtttcgtttcggtttatgagtagcggtttattgggcggggggtaagagatcgaagtttttattggttattagattcgttcgttttttcgttttcgtaggttatagggggttcggtagagtttgaggatagggtagttttcgttcgcggttgtaagatttttgaagggggtcggcgtgcggaggttaggggatcgggaaggaggagttaggcgggatgatttattttcgttcggtttattttcgattttcggtgtagttttttaggagttgggggcgtgagaaattttttttcgtagcgagtgggttgtcggagggggttggggtttttcgttagcgtttgcgtttggtttttagttttgagtttcgcgtttatttatcgcgggcgagtgttgcgtagtacggaggacgttttttttttttcgttgttggtagttttcgtaggcgttttattcgggtttaggtttttgtacggtagtggggttttttttttttttcgtgaattcgttgacgtcgtgttttggagtttttttatttcgggagtttgacggcgttggcgtaagttttggcgatatttttggttttttttattttgcgtttttcg

SEQ ID NO: 6670 - DNA, 2372 bp, synthetic construct; identical to SEQ ID NO: 6669
  misc_feature 1..2372: note = Description of Artificial Sequence: Synthetic polynucleotide
  source 1..2372: mol_type = other DNA

SEQ ID NO: 6671 - DNA, 2372 bp, synthetic construct; identical to SEQ ID NO: 6669
  misc_feature 1..2372: note = Description of Artificial Sequence: Synthetic polynucleotide
  source 1..2372: mol_type = other DNA

SEQ ID NO: 6672 - DNA, 2142 bp, synthetic construct
  misc_feature 1..2142: note = Description of Artificial Sequence: Synthetic polynucleotide
  source 1..2142: mol_type = other DNA
tcgagggtagcgtttcgcgtttgattttttcgtaagcgtttatttgtttttaggtggttaggaaggcgtgggtgggggtaaagcgcgtagagcgcgggaagttagcgcgtatatagcgggcggttaggtttagtattgcgggggaggtgttttttcggtataggattcggtttttgtcgtggttcgtgtcgatgttcgttagaaaaggggcgatggtcgggaagtcggtggggaaattatagtttatatattgcgtttttttggggaagttttgagtggagatgatgtcgttggtgtttatttgggagaggagagggataaaaaggtgatagtcgtttaagtttaaggacgttattttttcgcgtagggagggaagggaattgatttaggtaaaaagtttttttttttttttttattggttagggagtttggatttagggaaataagcgtaatttttgcgattgttttagtttcgcgttgtagtaggtttaggggttttaaaattcgtttatttatttttttattttttttataatttcggagttttatgttttcggagaggaagtttttaggtttgaagagggaatattttagtttcgtagacgggtatagttttttcgcggttttaattgtaaagttcgttggtcgttttagtaacgttattttttttgtttgggacgcgtacgtggttgcgaataatttttgtttttttttttaggttatttttgtttttttatagtagcggggtaggtagcggtatcgttttttggtcgggtattatcgtaagggtgttggggggttttaggagtggggtttgtttttttttttttggaggtagggttttcgtgagatcgattttagggaagaagttgcgggaaaagtgttaggagggggttgaatttacgtagaggttgttgaatcgggtttcgtagaagtgtaggggattcgttagttttattacggttgagttttcgtcgtcgtttttttgtaggagttggtttttttacgatttttcgtgtgggaagagttcgtttgggtgtagcgtcgcggttcgtaatattagtaacggtagtagtagtagtattggtaacgacgatagtatcggtcgttcggttattcggtttttttttatgttcgttcggtcgtgcgtttattcgttgtataacgcgtttcgtttcggtttttagtttatttttcgcgtcgcgttagtttcgaatttggattttcgcgggcgtttgggcggggcgggattttaggtttatttagtaagttaattggttgaggttttcggttggggattaattatcggttttgagaaagttcggtagtggttattatatttggttttcgttaatttttttaaggtagcggtcgttggagtagcggggttggcggggtaaaagtttttggttagggttgtttggagttgttttttttatttcgtttttagggagttttcgggttatttttttattcgggttgtttcgcggtttttaaggagttttattttcgggattaaatggttcgtaaggtttggggtagcggcgttgtaggagatgagtttagcgtaaagggaatttcgtagcggcgagtgcggttgttggtttgcgcgttgtggttttaataggttggtagggcgcgggcgggtggcggggttgcggtatgagttttgttttttgttttggggtttcgggcgtttttggttttggaggtttggttatcggttcgaaaagtaaagggatattgtcgtggttttttcggtcgtttcgttttatttagagacgttttgaggagaagcgagtttttgtacgaaggtagagggttgatttttaagttttgtttttttttcgaaggtcggtcgttagggaagatttggttattttttggaagtattttttttcgggaaaatcgtagtaggaaagattatgaaatattattgtgtgtgattcgtttcgtttggggagtaggatgaggtatttcgtttggttattaggtagaaaggggcgagtcgcggggatgggaagattttgattttttgtttattgttgcggtcgtcggagatgttttttttcgcggttacggaggcggtaatttgagttgtttcgtaggattggaaatcgtataatttcgaaattagttgcg

SEQ ID NO: 6673 - DNA, 544 bp, synthetic construct
  misc_feature 1..544: note = Description of Artificial Sequence: Synthetic polynucleotide
  source 1..544: mol_type = other DNA
tcgaatttgggcggtcgtcgggtagttttttcgttcgattatggcgattgatagtgagtgcgtttcggtcgcggaggttaggggtggggggaggtcgcggtgtttagggtgggaagttcgattttagacgttgtttttgtgttggttcgcggtagtagcggtcgggttttttttcgttttttatttttggttgtttggcggggtttgaaagggtaggtggttttggcggcgcgtttcgcgagggatgtggtagaagggcgtgcgtttggcgtcgaggcggagggattttcgatgtcgtgtggtagcggggtttgttatcgtagtttttcgcgggtattgtttttaggtttagagttagtttttagcgagtcgggtaaacgaaggtattgcgcgtttttggcgttgtgagtttaaggttcgtttcgagttttgggtcgggtttgtgcgtttgttttttggggattagggtggtttgtatggttcggttgttcggtggtttacgggttgtattcgtagcgggtagtataaggtcggttggagatcg

SEQ ID NO: 6674 - DNA, 2002 bp, synthetic construct
  misc_feature 1..2002: note = Description of Artificial Sequence: Synthetic polynucleotide
  source 1..2002: mol_type = other DNA
tcggaggttgtgtcggggttcgttaaaggttataaataaatcggacgggtgggaagtacgttttagcggcgattggatttttaaaaatttgttggtagagtgaaaataaaaattgttttttaagttggtaaaatcggcgttttagacggtgcgtaggagggttttgcgaggtttgttttcggagtttcgcgttagttttgtaggttcggttgggttcgtagttcggtgttttattcgtgggtcgggttcggttgcggggttttttcgtagtcgggatatttaggatagtagcggttggggagtcggggttaggggtttttttgtaattttaatgatttttattattattattcgtaaaggataaacgcggttaaggtcgggttttatagtggttgtgttggttatcgcgtggaggagtgtgcgttaatttaggggcgaggggggcgcgttcggtgtttcggggagagtttagaaggaagacgttttatcgtggtttttatagttagggatagtttgggtgttagaaatttttagagagaattcgaggggttgatgttttgggttattagtttttggtgtttgtggggttttttgcgcgtttatttttatttttttttttttttttaggttcgacggattttttcggaggtttaggatagtgatttatagtaagtggtgatagtggaataacgtgatagttcgttgtatttgttagttggtttttgggtaggtttattcgtcgggttcgattttagagtcgagttttcggagtcgtcgggtaaagttttttttttcgtttcggtgtagtttcgcgtttttcgcgttcggcgttgtcggggaaaagtggtataataggaaagtttcgttagagggttttttttagtcggttttttcgttataaaaagttagattttagtcgaggttttgattttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaaattcggagcggggaagtttaggggttgagagtttcggttcgggtcgtaggagttggggagcggggacgcgggtaggttaggtttttttatttgtcgtcggggttttttttcgtagtagtaaaggggttttagtgttcgtggtagtgtatgttttagcggatacgttggtttttaaatttagagattagaggggcggttgagaacggggcgttcgttgtgtgtgatttttgatcgtggaggaagggcgggagtcgggagtaggcggtggggttcggggttaggtcgcggtcgtcggttttcggtaaaggcgttttggtcggggaagggggcgagggtgggcggtcggtttttgtcgtcgtagttatatttgggacgttgaaatgggttttggggatagagtttatttttagcgcgttttataggagaagttcgtagtttaggtttgggtcgtgtagatcgttgggcgggttcggggttcgaggagagtaatacggcgcgaggtttagtcgcgagtaataatttcgatagtacggtttttcgaagacgtgtttcgggtatcggggttgtgagcgggggagtttcgggttttgggttcgtttggtacggggcgggggcg

SEQ ID NO: 6675 - DNA, 983 bp, synthetic construct
  misc_feature 1..983: note = Description of Artificial Sequence: Synthetic polynucleotide
  source 1..983: mol_type = other DNA
tcgttttttttcggtttttcgagcggagtgggtaagggaggggggtgaggaaggtacgcgatgttttcgtcgttcggcgttttatcggtcgtagcggtttatcgttttcgcgggttgttcgtcggtcgtagtcgcgttcggggtatgttagttcgtcgtcgtcgttttttcgtcggggttcgtgggttcgtagttgttagggagttgcggggtagcgtatttggagcgcggggtttgggagggagggtgtttggggttagggcgaggggtttcgggaggggttttttcgtacggattttagaaagagggaaatttcgatttagagcggtgattggaatttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgcgcggagaggttggtttttgggcgagcggagagttttgtttattaagttgtcggaagaagttaaattaaaaagttaatttttaagtttttaaacggaacgttattttattagttgggagatagcgtcgtattgattgataagtcgcgtatatttattttcgcgcgcggaggggagatttttagaacgtttttcgattagtagcgaggaagtcgagttcgtatttcgtatttcgtatttcgtatttagagttttcgagggacgaatttagatttaatttttgtttcgcggttatttattttagtcgttggagtttggcgttcgcgtttttcggtcggtagtacgttaaaacggcggcgcgttttgatttggatttcgtcgagttgggagttttaggtagtaggcgggcgcgcggtatcg

SEQ ID NO: 6676 - DNA, 947 bp, synthetic construct
  misc_feature 1..947: note = Description of Artificial Sequence: Synthetic polynucleotide
  source 1..947: mol_type = other DNA
gcggagcgcgttagagcgcgagggacggagggagaggaggagcgcgggagttgcggaggcgatttcgcgaatttattattgtaaatatattcgggggtgttaggaggggtaggggtgggggtcgcggcgtttatattagttcggtcgcgtcggattgaggtagtagtgtggtttgagtagtttttagatttacgtcgggcgggcgtagtatttggagcgagttttgcgttcgttttcgcgtagcgtcgtacgttcggtttcgagttgttcgtatatacgcgtcggaggagagttcgtttagttttttcgtcgagtttcgggattttttaaattcgaggagtttcggcgtcgcggggtagttttttgtcgtttttttcgttcgttgtattttttttggggttcgttggtttggcgaagcggagagggggaggcggaggaggagagaaggcgggggtcgcggcggtcgaagttaagagaaagtggtatgttcgaattttggaggcggtggtggcggaggacgggggaagacgatgtcgtagtttcgtaggggacgtaggcgagagtaagcgaggcgagttgggcgtttcggtttcggttcgttgcggggaggcgcgcgtcgttttgaggtttcggttttcgtattttcgcgtttcgacgttgcgggcgatagggtttggttttagtagtcgtcgtcgtcgtcgtcgtcgttattcggaggatttagtaaaagtttggatttgggggagggcgcggcgttgagcgggattattattagggttggaaggagatttcgagaatttttgtaggtaacgcgcgtttttaattttttttttttatgtttcgtcgttgcgttttcgtttttttttagagttttttttggttttcgcgggtttggtagaaagtaagagggaggcgaagtttaagatttcggggatgagtatcgagcg

SEQ ID NO: 6677 - DNA, 1362 bp, synthetic construct
  misc_feature 1..1362: note = Description of Artificial Sequence: Synthetic polynucleotide
  source 1..1362: mol_type = other DNA
gcgttttttttattcgcgtttttaggtttttatgtacgttacgtgggtgggagcgtgttttatatattcgcgcgtttaaagttatattcgttacgttttcgtcggggcgggtttatcgcgcgtttttgggtgtcgagtttttataggttatatagtcgttatttgttgttgtatttttattgcggggataggggtatttagtgttttttttcgtttttttcgtttcgcgaaggttttttattttttagggttaggcggaggttacgtttttttcgggttttttttttaacgcggagagggaagcggagggaggagtttggttcgtagtcgtcggtttttttcgtattggagttttttttttttttttttttcgtttttcggttgtcgtagttcggttcgtagcgcgcgttagcgggggtttttcggagcgagtcgttaggtaacggggttggtttcgtagacgcggggtcggggaagttcgcgcgcgttattagtagcggcgtcgcggggcggggggcgtagagattttttttaatttcggtttgttattatttggttcgcgcgtagtttcggtttagaatgttttaatttgcgtcgattgttgtcgtcgaggtgttttttttttgtagggatttcgacgtcgttagttttttttttttttttcgtaggtgcgtattgttgtgtttgcggtcgggtgggcgtttcgtcgttgcggtcgcggtcgtcgttggtaagttgcgttttggggtttggggtaggaagtagtggggggcgttcgaagagtagggtagttacggttatcgtggtcgtcggatcggttatgtgttaaagtttttggggttcggcgtttcgttgggcgcgtagcgcggggagtagacgcgtcgtgggtggggtagcgcggtgttgttggcgttcggttttcgcggggtgtagttttgcgcgtttttatgttgttttttttttttttttttcgcgttgttttttcgaggttttttcgtcgagtttcggcgcggggtatgaggagttttcgggtgtcgtttagagattagtaggttgcgcgtatatttagttagcggtagacggggatatgagtagcgcgtacggggtttcgcgttcggcggttagttttattcggcggcggttagcgggttaacgttgttcgggagaatgaggtaggagtcggcggtagtttttttttttttttttttttcgtttttttgcggtttcggcgtttcgggttcgggtcgggttgcggttttgttgcgtgtttcgcgcgttttttaatcgttttcggatgcgtttttcggtaagttaggtttttcgtttcgcgaataaagtttttttcgtagggttcggaggtcg

SEQ ID NO: 6678 - DNA, 1092 bp, synthetic construct
  misc_feature 1..1092: note = Description of Artificial Sequence: Synthetic polynucleotide
  source 1..1092: mol_type = other DNA
tcggattttgggaggagcgttggcgtggaaagttaggttatttcgattttggtttttaggttcgggataacgtgttagttttaagagagcgttgtttatagtttcgggtgggttgggtttaattgtacggggcggggcgttaatagtttaggatttgggttgtaggttggtttttgtattaattagcggggcggtttcgggttttagtttttttatttcgtttacgaagggaggcgattgcgagcgtttggggtttttgacggatttcgtttcgggggtggggcggggagtggttacgtggaggggcgtttcgttcgtcgagtttcgttttatttcgtttcgttcgttttcgtgttcggggtttttcgtttagtagagatttggagttagaagtttagagatagtcgagtgcgtcgtgcggttttcggacgttcgttgtttagttcgattttcgttaattgtgtaggcggttgattcgtagcggtagcggtagtagcgaggattcgagcgttggttgtagcgatattatggattttttttttatggtcgcgtaggtaacggggcgttttttttacgcgtttcgggtcgttaagtttggggaggttcggggttacggtttcgttttttacgttggggttgggtagtggcgttcgttcgcgattcgcgtttcggttttttgtttcgagtcggatatttttatttggtgtacgcgtcgggggcggcgatcgcggttttttcggggtggggcgggttgcgcgtttcgtattttcgcggttcgagttgttttcgttcgggtttttttcgttggtaggaaggttgcgaggagtttgggtagttcgagtcgtttttttttgtttattttttattgttgttttttttttggggtttcggagttttttaaggtcgggttagtttagattcgcgcgaacgtggatgggtatatagtttcgtttttttttattttgttttttcgaggcgttagtaatttgttttttgtcggtgatttcgggcgttttttttgtcgtcgtttgaggaaggttttgagattcgttttgtgatcgtgattcgttaagcgtcgacgcgtcgcggtcg

SEQ ID NO: 6679 - DNA, 1092 bp, synthetic construct; identical to SEQ ID NO: 6678
  misc_feature 1..1092: note = Description of Artificial Sequence: Synthetic polynucleotide
  source 1..1092: mol_type = other DNA

SEQ ID NO: 6680 - DNA, 1092 bp, synthetic construct; identical to SEQ ID NO: 6678
  misc_feature 1..1092: note = Description of Artificial Sequence: Synthetic polynucleotide
  source 1..1092: mol_type = other DNA

SEQ ID NO: 6681 - DNA, 580 bp, synthetic construct
  misc_feature 1..580: note = Description of Artificial Sequence: Synthetic polynucleotide
  source 1..580: mol_type = other DNA
tcgttcgggttcgcggattgtcgggtcggtttttagttatcgtataggtgttttggagagtgcgattattttttgtttttcgtttcgcgtcggttttcggtttagtgtttcgttttttttggagtacggtttgcgtatgcgcgcgttttagggtttagttttgtttttgtttcggtttttgcggggatggatgttttacgtagtaagcgagtaagcgagttttggagatcggggttttgggtgtgcggtcggtttagtgttacgcggtgagataggtatggttattaatttacgttaaggcggttgtgtatttggtatagaaaatattgttgttgaatgttgtttttatagttattcgttagcgtttattgatgagaggtgttattacggatattcggttttgtttcgtcgaagttttggtttattaggattaaagttaggttttagcgggtttttttgttatttttggacggtttcgcgtttttttagagtttgatttttttttatttttgtagtttaagtcgcggaagcgtagatattcggtttttttcgcgtgttttatcgggtttttttggatacg

SEQ ID NO: 6682 - DNA, 888 bp, synthetic construct
  misc_feature 1..888: note = Description of Artificial Sequence: Synthetic polynucleotide
  source 1..888: mol_type = other DNA
tcgtgggaggttagagcgggcgttgttcggcgttatttttgtagcgttcggatcgtttcgtataggtaggggtggtgtttttttttcggggtatagaaacgttatatttcgggggcgtcgtttagaggttgtttttgtttttgtgtttttttatgaggttttgttttataaaggtagtttgagttaggattttaaagaggtttggttatcgggatcggagggagtttcgttttttaggtcggttttgtaaacgcgagtttgcgttaaggcgttttgcgggtttgttggtggtatcgaggggtagcgcggggttagcgttgggagtttcgaatttatacgtttcggttagttgttcgggaagcgtttaagtatacgtttcgagttttagattggattaagttgtttaattatttattttttttttttttaaggagaagtttaattggagaagattcggtttttttcgttatggtaggttttttttttttgattcgtagttgtaggggttgagggtaggcgtaggttcgttttggggtcgaagttattatcgggtttcgaggttgtttttttaatattcggtttgtacgtttggcgggggcgtaatagtgttttacggttcgggagttcgtttttggtttttgagtaaggtattttttttatttgtcgtgtgtttagttgaatttagtatatttttttcgtatttttcgtttttttttttttttttttgaatttgtttttttgttttgcgggtttttaatttttttcgaatttcgggcgttcggttcggtttaggcgagcgttcgcggttggggacgcgggtggggacgcggcggtttgggcgttgtaggatgcgtttggtcgcggaggagacgattagggagcgggtcg

SEQ ID NO: 6683 - DNA, 1483 bp, synthetic construct
  misc_feature 1..1483: note = Description of Artificial Sequence: Synthetic polynucleotide
  source 1..1483: mol_type = other DNA
tcgaatattgatatcgttttaaagttgtaatttttcggtttcgttacggttttttatgtataaagagagggaattagtcgtcggtgatttcgacggttttcggattagggatgtttcgagttcgagcgggtagggtgtttagtagggttaggtgatgggaattatggggttatcgagtacggattttggttttttcggtggtttttgtgagttttggggttaggcggggattggaggagcgttcgcgtcgggagggagcgtatcgcgttacgtgttcgttcggcgtttcgtttttatttcggttacgtttttcgcgttttttttaaagtttcgttttttagtttcgttattttcgttcgtttcgtttttcgtagttttaagtttagcgttttcggaggcgcggacggtggggtttcgcgttttttgtgtcgggttttgatcgtcgcgcgcgtttatttattttagcggtcgcgggcggaggggcgtacgcgcgcgtagttttttcggagggcggtggggcgaatagtaacgcgcgtattttagtttttggttgttgtgttgagattagttcgcgcgttcgcgcgtttttttttcgaggattcggagtcgttcgcgtattcgttaggggtcgtcgtttcgagttttaggcggacgcgtacgcgttttcgtcgttcggattttagtcggttcgtttttcgtttttttatttttcggcggcggtttttaggtacgcgttcgcgtatacgtcggttcgggtacgcgttcgttaagatggtaggggtcggggtttagttgttagtcgtcgtcgtcgcggttttttttcgtagttagcggtttcgacgtttattcggagaagatgagttttcgttgtttttcgtagtttagttagacgcggagtcgtcgcgttcggggtcggttttttcgttagcgttcgcgtttcgcgtttcgtcgtcgtcgtcgtcgtcgtcgggtcgtttttggttcggcgcgttcgttttcggtagcgataatgaggtgagtcggggtcggcgtttcgtgggaggtggtagcggttagcgtcggaggggttgggttgggggttcgcggtgttttcgagggcgggaggggggttttacgggcgcgggggtttttagagaatcgcgggggttttgtagagattcgggggtatttagagcgcgggaatggtttcgcgagagtcgtgggggcgtttggagagtcgggagggtttgtagggtttgtggggggtagtgttttgtaaggggtaggcggcgttggttttggttgtttgtggggtttttttaggtttcggggggtttgcggcggtttgggaggtagattttcgcgggtaggtgtggtcgtgtttcgatcgcgcgaggatcgaagttggcggaagtttttgtgcggtgttttttagttcggaggaggttggtttgaagtttttaggcgttgtcgaagtttttttttgttagcgtttagagtcgcg

SEQ ID NO: 6684 - DNA, 3714 bp, synthetic construct
  misc_feature 1..3714: note = Description of Artificial Sequence: Synthetic polynucleotide
  source 1..3714: mol_type = other DNA
gcgcgcgaggttggggtagtttataggaggagcgcgggattcgggtttgagtttgtatttaggtagagcgtttattttcgtttttagtttcggattttgaaagtaaagtcgtcgtgttcggtagttagttcgaattttttagtttttagggagtcggggtcggggtagggaaggttacgggtggcggtataatcgggattttggagtggaggcgtagattgcgggtttcgttgcgtacgtttcgtggttcggttggggtgggttttggaggtttataggttaaggttgaacgggggttttggagcgtgggcggggtggagtgtataggttattgggttttgagcgtttttatgggttaggattttaacgcgtcgtgtttttaggatagattggagggggaaggggttgcgattatgttttagtcggaagggttttatagtagtcgcgttgttttttttttgtcggatattcggtagtagatatcgacgtttgggggttagcgaggtaggtgggcgcggatcgcgattcgattttggtttttaattttcgtttagtggcgcgcggggtcgtcgttttatatttttagttcgcgtggttggtgtttggttcgtcgtcggggcggaaggggcgttgtcggcgtaggtgggcggggtcggagcgcgggggcgcgcggcgcggagcgagcgtagggttcgggggcgcggggcgcggaggatcgggggtttgacgggcggttttgcgcggtgcggggcgcggcggcggcgggcgcgcggttagtgaacgcgcgggcggggcggcggtggcgggaggtattaggggtcgtttttcgcgttttttttttttatggcgttgttttagtcgttcgagtcgtttcgcggcgcgtttcgtaaggtttttagtttgttggagatgggggcgttttgtttggattcggagattattttgggttttattagttattttttgcggcgacgaggtaaggtgagggttgtcgggaggggggcgggcggcgtaggcgtcgtttcgttattttgtcgcgcggttcgcgcggtcgggggtgttgcgtcgggaaggagacggtaggttcggagtcgcgtttcgtagttcgggttgggattcgttgtcgtatttttttttattagcgttgtttaagtttttttttgtttttaaggttgtgttttaatcggatttattcggaggttgtggttagggcggagagcgtagcgtagggattttcgggtttattttgcgttttgttaggatgggcgaagtagggggtcggggtttttgattgatcgtgagttttcgaggtgattttagttttgtgtatttcgtgttttgcggatatgggatgtgagtttgtgtttttcgaagcgtcgcggcggtagaagcgttgaagttgcgggtgtggttggttaggggcgtaggatcggtgttttcgatcgttgcgtgtttttgtgttgcgtgtgtgggtggggggacgggatatagagagtgtgtgtttcggagtagtggagcggcgggaggcggtgttgtttgtcggtagtgcggggtggggtttgggtgttgtttttagtatttagatttagatgtgggttgacgttcgtttttattttttaggttgcgaagagacgggtaggggaagcgttttcggttttttaggttgggtggaaagcgattgtaggtttacggattttagaaagagtggagagtttttgttattttattttatatttttttgcgttttcgaatttttaaggttattaacgattcggaaagtcgggaggggattatttattttattttttggggagtgcgtgcgtgggcggggaggtttatttaagtaaaagggggtgggtaaaacggaaagggttattttgacgtattgagtttttgcgaaggttttatcgtatgtgtcggtagtcgcgtgttttggttttcgtcgggttacgattttcggagttttcgagtgcgttttaggtttgggacgcgcggcgttgtttttttagtttcggagtcgtgtgcgtagcggtcggtagggggtattcgcgttacggggagttcgttcgtcgcgttcgtttggtttgattcgggttttggggttgattcggagtttggttcggagttgtttgcggtcgcggatgtcggcgatatttggggttcggttaggtatagagtaattggtcgttagggaagggcgggggggcggttttttagtcggagataaataagtaattaatttcggagttgagtttttatttgttaggtttgttgataataggttcggcgtacgttcgtaggatttttcgtttttcgggcggtacggcgcgtatatttatttgcgggtatacgcgcggttgtaaagatacgtgtcgttcgtagacgcgtcgaggtatagatacgtcggcgcggtcgttgttcggttcgaggcgtatatcgcggcgatattaatttacgcgcgatagttagatttaaagtggttcgcgatatgtagagtacgttgggtttgttggaaaggcgtttgggagtttcggggtcggggtttcgtttttttttcggtttatttcgtcgtgggttttgggtaagagcgtttttttcgtagttttagttttttcgtttgtagagggaggggcgtcggcgttttttgggagacgcgtagttttggtgtttcgggagaggggcgggaggcgtatgcgcgcgcgtaattagattttcgtcgtcgtttttagcgttttttttcggggtagggatttatttaataggttggggtttttggagtgcgcggggtcgcgtggggaagcggggattttattttttttacgcgtcgtttagtattgggtaagggcggggtattttttgggttttcgtttttcgtcgttcgtttcgggagttcgagtttcgttttttttcggtttcgttttcgtttttcgagcgcgtttatcggagttatcgcgtttttcgcgatattcgtaggttttgcgaattttcgagcggttgggtcgggttatgggggcgtttcggggtcggattacgtagtcgcggcgttttcggagagttagcgtggtcgggagcgtttgtcgggtttttttcgcgtttcggttatggtcggtcgcggcgtttttttgtgcgttgcgtagttcgcggtacgcgcggttcggtttggagagggaggcgggcggcgggggttcgggacggcgaagatattcgcggtgtgcgttggatttttgggggtcgggttttttgttgagggtagcggattcgtaggcgggattttcggggatggagggagtgggtgagcgttagggtcgtgtttagggtttttaattttggtaagagcgttacgttggggtagggcgcgtaggggtttggattcgacggacgttttaggtttattgttcgttttcgtttttatattttgtaggtggtcgagggcggttcggttcgcgagtcgtcgtcgttgttggaggtgttttttcgaaagaggttattcgtcgggttcgattaggatttatgcggtagtcgttttgttttcgaaggcgtcggggtcggtttagagtagggttattcggtcggcggaggcggttggtgtcgttattgttatacgaagttggtggagtttaagcgataggcgtggaagttggttagcgggttcgggattatttttcgggtaagtgatatttttttaggtcgattttttcgagtagggttacgtcg

SEQ ID NO: 6685 - DNA, 1266 bp, synthetic construct
  misc_feature 1..1266: note = Description of Artificial Sequence: Synthetic polynucleotide
  source 1..1266: mol_type = other DNA
gcggcgaggagggttgtaggtgaagcgcggggagagggaggtcgttcgtttcggttttttttttaggggttttgcggttggttagcgtttcggttgtattttttggtgcgcgtcgcggcggcgttataggtttttcgattttttgattatcgttttcgggtcgcgcgttcggtagtcgggatcggtgatggcgcgggattgacggtcgtttttttttagatttttttgtttcgtttggggttcgttggggttgcggcgtcgtttcgagttgtatgtggggcgggcgcgttcgagtttagagcgagcggttttcggcgttttcgaggcggtgtttcgtcgcgttagagtacgaggaggagcggcgggtcgggttaggttttttacgcgtcgtagtttcggagtacgggtttttcggaggggatttggggcgttttagtttaggaggaaggattcggaagtagaagcggagtcgcgagtcgagtcgagttattgttttcgttgttcgcgggcgtcgggtgggggtttcggcggttggatgggtagcggcggcgcgggtcgcgggcggcgatgggcgaggagtagagtacggtgagcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagagggaggggatgaatagtaggaggcgtttttcggcgaagagttggagtttaggattcgcgtgggggtcgtcgacggattggttttggacgtgttgggttagcggcgttcgtttttcgttaagagataagttttttgtttcgtgtattgcgtggagagcgatttgttcgaggttttcgtttcggagtagttttcgtcgttcgcgtcgttatttggggtttcgttagtgttgaatttttttagtattcgtttttttttttttagttttcgattgttttttttaacggattttttttttttcgacggcggtagtatcgagttggagttttatttggcgttcgagtcg

SEQ ID NO: 6686 - DNA, 1316 bp, synthetic construct; identical to SEQ ID NO: 6563
  misc_feature 1..1316: note = Description of Artificial Sequence: Synthetic polynucleotide
  source 1..1316: mol_type = other DNA

SEQ ID NO: 6687 - DNA, 10783 bp, synthetic construct
  misc_feature 1..10783: note = Description of Artificial Sequence: Synthetic polynucleotide
  source 1..10783: mol_type = other DNA
tcgcggagatatttcgagtttcgtaggtgtttgagttgcgttgcgcgttttagtcgggaagtttttttttatttaatcgcgtcgtttcgcggaaagtttgggtattgtagacgtttttatcggtttatcgatagttggttttgaagcgggggtttagaaaagtaaaggggatagtgtttggagttacgatgtttttgatgtgaggcggttttatttaataattaacgaattaagttggaattgtaggttttatttttgttggggggaggattttaaggaatgttatttttttgttttttattttttgttttacgtttagttttttagaaggtattaggcgtgagtagagtgcgaggcgtttatattttcgtgttttttttattttcggatatttttgtattttagtcgaggttttagtacggagtgagggttgtttggggtgttttgttgtgtgtggggcgtttttgtttttcgggttttgattttacggtttgggtcggcgaggcgtttttttttggcgtttggattgtgcgtttgtttcgtttttaggcgacgaacggtaggagtcgggggttcggcgggattcggatttagggcgggcggaaggcgagggtttttttttttcggaattttcgtttcggaaatttgtaattaaatcgggtttttttttcgtatcgttttcgcgttttcgggtcgtttttttacgcgggtatttatttttcgggttttcgtagtatcgtttttttcgcgtttattcgcgcggtcgacgtcgttaggggttttgagatcgcggagatagcgcgttttggcgtttggtggggtttttttagtggttagagcgtttttggattagtcggttgtggtttgtgtttaaatacgatggaaatcggggttgggacgggcggtggtacgtacgtggaggagaagaggtatggcgggaaaattatagtcgaatataggtcgattcgtattttttaggtattcgtcgtcgtttgattcgcggttttttttaaggtttcgattcgtcgttattttttggtattatttatcgggtttcgattcgggtcgcgagttcgttgatgcgtagttgttttcggcggttttcgggttttgttcggattcgcgcgtagagacgttcgggaacgttgggttcgggcgttttttggcggcggtagtacgcggtatacgttcggtttttcggttcgagggggcgcgtggagcgtacgcgggattcgcgcgcgggtttgggttgttggtttatattttttcgtttgttcggatggcggcgttgaggtttattcgtttttttattaataacgatgtttcgggagggaaaaaatagagtttttaaaaattagagtgcgagagaggagtgtgtgtgtgtgtgtgtgtgtgtgtgtgtgtgtgtgtttcggggcgttggtgaaagtaataaaatttagatcgtttttttggcgagatagcggcggttataatgcgtcggggggattaggggtttatttgtagattttggataaaagatgatatatcgatacggtttagagtgttattgcgtttggttttttagggagttataagtatatattttttgaaatatcgtttagtatagtatttaattcgttcgttatttaatatcgggaggggaattttagtagcgtataagcgcgttttcggttttttggttttgggtggggagagtttaaatgagaaggatttggtatgtttagacgtttttttttttggtttttgtttttagtttaagtaattatttagcgatgggttttaataaatacgtttgagaattgtttttatgttcggtaaatattggattagttttttaatgattaggtttttgaaaaggttcgagaaatatatattaggttttaattaagtttaatagttaataggtaaggaaataagttatttttttatttgaggtggggaatgttgggaagggggatttttatttttattaaattatttgattttattaaatatgatcgttgtattaaataggaaagggggcgtatttaagttttttattagtcggaatttttattagtttagttttgtttattaagggtcgagtgattttgtggggaatatatttgggttttagtttttatttttatagagtttagtataaattatttttgtttagtatatatggtttatttggggattgtttatgggagttttgatttggtaattgtaggggagaaggtatgatttaaattattttcgattgtttcgcgttaatttggatcgtttagaggaggtaaaaaatgggtaaattttttggaagttttgttgtgtttttttggtattgaattttgtaagtacgcgatataggagatattgaaaattaaagaggaagtattttttttttttaatatggggagagacgttgttggaagaagtttttgaagtggttttttatcgtattaagaggttagtgggatggattttcgcgtataatttaaaggaacgcgcgcgtttttagtttttcggggttggtaattaagtggttcggtcgggcgtaagtcgttttggaatcggttgtagtttaagtttagttgggttcgggattgagcggtatttttggttttttagaatttttttcgcggtgagtggaagggcggtttcgcgcgcgggcgtttcggggtcggtcggttgcgaaattagggggtggatttttatttatttaggagtcgttaagttcgtaggggatcgagtattatttaggttttgggtattttgagttgttttttgagttttaggacggttcgatggtgtagagtttttaggtagaagttagttttttgatatatatatagtagtgagtaaagtgcgtataagtgagttaaattttgaagacgtaggttcgcggatttttattttagcgttagagttaaggagatagaagagaggaaggagagaagtgaggaagggagagagattatgagaaaaagagattatgaaagtagagaaagagattatgagagcgagattatgagaagagagaaaaagagagattttgagagagagagatagaatgagagagatttaatttttagtgttacggggtttaggcggggtaagcgtttttcgaagttattaaagataggggtggttttttttttttttttttagttttttttttaatagatatagtacgaatttttaatgcgttttttttttatagataataatatagggtttgaaagtcggatataatttaggttttgtgcgggttttttttcgcgttttttcggtttagttggttatatggaatttagtatggagttcgtggatgataaagggatttagtgataggtttaataaaattttaaggagatttttgtttgatttcgggatttattgtcggcgataagcgcgttgaatggtgcggggtggggcggggggtggggggcgggttttttttttttttttttttttttttgttttcgcgattttttttttgtttttttttaatatgtacgtttttaatattttcggtttttagtttttttattgtgcggttttgtatcgttcgttgtagattgggcgaagatagattgttgaagcggatttcgcgtcgggtgcgtttttagggcgttggggttagggttatatagggtttcgtaggcgtttttattgattttatggggattcgaggatagagagaggcgggcgtcgggtttatttttcgggttttcggtcggttataggagcgtatatttagattgtaggttcgcggttttggttatagttttaaatttgtttttaatgagtaagtggtggaagtttgttagggtgaggattttttacgtttttttttttttttttggaaatttgagggttttttgtgattatttttattttggaagttttggggtttggaaaagttaaaatggttttaggttttttgatagtttcgttttaagagatttgaaatttttatttttttttttaagaggattttgggattaggggaagttgtaagtggatgttgagtggttagtattagggtaggttgggcgtttaattattgtataataaattatttgggagaaattcgttggtttttaaaaatagtaagatataagtttttaaatattgttaagttagtgtggagaataaagggagattttttagtatttagaaaaattgtttttttttcgaggatgagttcggagatgggaaaggatttttattggggtattagaaagattttcgagtttttaattatttaggggcggtgtggaacgcgggaataaagtgttatcgcgtttttgggttgttgcgtagagtgttatcgacgtatagatttggtcgtacggataattatgtttgttttagatattgaattaaatttgattattaattatagggagcgagaaagttagttgggatcgttttttttgttcggtttttttattgttatttaattttttagttttgatggtgtagtttcggagagaatagagatataatttttaaatgcgtcgacgtttagttttttagcgtttgtagtattcgttgggttttgagttagagttttaagtatttttagaaattcgcgagatagaggagaaaggtttattttttagttggttaggttttttaagacgttttttcgcgtggttaagtgtgcgttagtatttgttaaggagatttttttttagtaataagggtgggacggaattcgtttttcgtcggaaagatggatgcgtttttttcgggcgtgttcggggttgtgtgtttattttttattcggggagtttattttatttttaaatttttattttttagtaatttatttagttttacgtttaagggttgatttggggggatcgtatattttggttcggatcgtcgaacgttggagggaaggaggttcgggatttagttttcggagagaggtttggaagttcggaaaggatgggagcgtaagggaagggagaggtatggtttgttgggattgttaaagattttcgttttttggttttttggggttaaagattttagggagggttgtagtattttttttttttttcgagtttagaatttcgcgtattttttttaagttttttaagttaaagtttcgcgcgttttgatcgtttttatttttagttttagcggttttttaggttagtattagttcgtagattttgaaaaggagtggggagtggggagaaggtagttagttttaattttagatttttatttatttatttttttagcgtgaggtaagttaaatgtaataaagtgaaagttatcgagtgtagtggttttaatagttttttaggttgaaggagttatttatagatttgggttagcgaggggggtttgtttttttcgtttttgcggttttcgaagttattttttttttcgtagtcggacgttgtcgttcggggtttagatagcgcgcgagattaggggagatgcgggggagggtgggcggttttgggttttcggtcgatcgttcgtaggtcggaggtcgagcgttttttttttcgttttaattttaggcgcggggtgtagtttgtggtcggaggggtttgtatcgggagtttcgttcgttttagggtttcggtattttcggttttttcgttcgagaggaatcgtttgtgggagtttcgcgggcggtcgggttcggtttttaggtttaggttttcggttcggcgtagtaggataaacgggagggtagggatttttttttttttttttttttaaatataggatttttattaaaatttttatttaaaaaatcgaaagttttttgcgttcggcgttgttggggaatcgcgtcgaatagttgagttttaagttcggggttgaaggttcggaggatagggtagagggttttttgtttatagggtttttttttttatatttgagaaatgtttgtataataaaataaaaagagaaaggaagaaagtaggggaaaacgtaaaaataaaaataaaataaaaaataaatttaaataagttataaagaaaggagttggatttagacgggaaataggtcggttttgaaggttattttggtaataattattatcgatatttataacgaaaagcgaaatttgttattagttgttagaacgtttatatggttataaatatttagtatttttttatttttttttaaaaaaaggaagaaattttttgtatttttaaagtgttttttatttgttttagaagacggttgataatatcgttatttatataaatatattttataaaatgtacgaaagtaggggtggggggtcggtttttttttcgtttttaagtgacgatattaacgttgggacggtttggttttttcggggagaggtaaagaagcgaagttgcgtaaatattttgtaaatacggcgtagagtttagtttttttttaaggtttagaaggagaggtatgggtagagttgggtgggtggaatttgttattttaaggagacgtaggtaatttttcggcgtttttttagtggagtcgagagttaattcgattttataataataattataataataataataattattataaggatcgaggttttttcgtcgttatcgtcgtcggggtggggtttgggtttggggtcgcgagtttcgttggggcggcgtttattaagtttattgttgggtttggattagggggtgtgttgtcgggtattggggggtgttggtcgagttgtattgggcgttgtattgtatgtgttgtagcgattgcgcgttgtaggtagaaaagggaatgttcgtttggaaggtggcggttgttaggttttgggttttgagcgcgtgatatggtttgtcgtttttgattaagacgggtacggttattcggcgcggcgagggtaggggcgttatttttatatttttttcggttcgggcgcgttttattttgtagcggtggttttggaattagattttgatttgcgtgggcgtgaggcggatgaggttggttaggtgttcgcgttcgggcgtcgataggtatcgttgttgtcgaaagcgtcgttttagttcgtaggtttgcgttttggagaaaagtattcgtcgttttcgttttttgtcggcgtttttttcgtcgttcggggtttttttgttattgttcggtgattcgtcggtcgagggtttcggggatttggagtttgagttttgagggggcgtttcggtagttagatcgtgtattggggggagggggagagagaagcgcgttaggcgtttggaggtcgcgcgtagtttgtattagattcggagtattttggatttttcgtgcgattttggattttcgcgtttggtagtttagtttcgttgtttttgttatgatttttgtttttttttacgtttgacgaagacgtcgggattttttagggtaaagagggaaattcgtaggagtgggggttaggggttcgttttttaaggggtttatatagtgtgggtgagaatttggggggggaagtggtattgaagattatcgcgggttaagggtttcggcgtttttaagcggtttttttttcggcgagacgtgggtagatttttaaaagaaatattttataattttagtattgatcggttcggttatttaaggtaggtttttgggggttttcgtttttgttttcgggttttttagatattttttgtattgtataaagcgttttttatgatcgcgtagggggtagggtgagttatttatattcgggttattcgaagtttttttattttttattcgtattcggacgaggttcgttggttatttttagggcgttaggttagttttttttagcggtcggagttcgggggttgcggttggagttatcggttcgggttgatattatatattagtttttgggaggtatagtttttttttttttttttttttaatttttcgtattgaaaaaaattttggagattaagttttttttcggaattaaggaggtttgaagaggagggtagaggatattttatataggtgttaaaaatttttttacggattcgagtgagggggttcgggtttatatggttttttttttttttatttttagcgtttaattcgggttgcggttgtaggaatggaggggattacggtttcggtagttaagttttgttatttacgggagtattgaaggttttcggtgttggttagttagcgcgtgtacgggttgtcgttgttgtcgtagaaggggttttttaggggtaggttttgtatcgcgtttagggcgttttgttttagcggttcggtttttttggttggttcgggtttttcgtttttttttttcggattttcggttatagagttttttttatcgttggtgttcggtaggtttaagatgtttttgatcgaaaatttcgtttttgtgttggttagcgatatggttcgagattttaaaatttatgtcgtaaagttgtagttttatttggttaattcgtggcgtttttttgttttggcgggcgggggaggggggagttggggggagggattgggggaggggaggggggaattggttttaattattgggataattattatttttaaaaagagaaagaaattggggatggggaggaaaaaaatgaagtttaatttagtgtttttttttgttttttttgaaagtacgcggaaatggacgtaggaagtcgggcggtttgcgcgtcgagcgtcgcgggtttcggttttagtttttaattttaggaggggtgttaaggcggcgttagttcgggtttcggcggtcgttcggcgcgcggtggcggttggtggcgaggaaaaaatgggttattgttcgagcgattagtttatataaggttgggttttatttacgaatttggggaggcggggagagggggagaaagagagggagggagggaaagaaagagggagggagggggagcgagagagggagcgggagaagggtggaaaaaagggggaagagatattaaaaacgtaaaggttggttacgtgtgggcgggttttgggagttaagtggatgaagatagtatttgtagatgtgaaattgtgggttttggggagtttcgcgtttttagttaacggttttttagagtaagatgagaggtgtaacgtgttaattaattgtaaagacggggcgagtttttttttttttaaatttagtatttatatataaagggttatcgcgtcgttcgcgagtttatatatttgaaagggtcgttttaataaattgtattttaaaaaaggtgggggtggggaggaggaggggagaaaataaaatagaaattaggaggagggaaaaaattttttttaatatttatcggtttttattttttcgttttcgcgcgtttattttcggtaagtcggaaaattggcgatttgtggcgtttttggaaaagggggagggggcgaaggtcgagttgcggaaattttttttttttatcgttggtggttgtttaaataagattcggtttaaatggtaagagtttaatttttgtaagttttttaggttaatattttggttgaggtttaaggatgagtgttagaaatgataaggtaagtaattgattttagttaatcgcgagagagtttaaaatttaggagagagtttcgtttcgggtcggttagagttattattaagcgattcgtttttttttagtcgttttttatttgttaaagatttatttattttttttatttcgtttttttttattttttatttttaatttttcgtttttatttttttgcggttaaggaggacgcgtagtttattttttgttttgcgggcggtttcggggagggcggggtaagagtgaggagttttaatttcgtttggggtcggattttggttttgttgtttttgggttttgcgggttttttttttcgggtggaggaaagggtagacggttttgtttttttttgttttttattattttttttttttcggttttttttttttttagtttttggttagaggtggagtagcgggaaggcggcggggcgggattgcgggggtgggggtgggggttgtgtttttagtttgggtgaagatttagaaagttgcgggggaggggggtcgttgggtggttcgacgatgtttcgttttttttttagttttttttttttacgcgagttttttagtgtggtttttttttggacgttttgggtgcgttcggagtacgcgttttacgtttttaggttaagttaggttagtgtgaagtttttagttattttcggttttgggaattgaattttttcgggatttgtatttttttttcggcgttggggttggaaaagattacgtcgtatttgttatttttttttttagttaaaatttttttggggggggggtgtaggggtgtagattggttatttgatgttcgttcgttttagaggagtgttaggaaggagttttgtttgggggcggggaggggtatagaaggttatttttgcggggtttaggtttagtttttttataatttgggttttttcgcgcgggttaagttgagcgcgcgggtatcgggtttttttcgcgcgtagttgtagcggacgtcgtcgcgttttagttgttttcgggttgttagcgttgggtgagggtattttttttcgagtcgttcggcggttttttgtagttttagttgtttcgtttttagtatgtgacgtgggtgataatggtttaggttagagtaagtttttcgtcggcgcgttttgggtggtcggattcgggtaaatataaatataaatcgattgttaagttgcggataatgagcgaaatgtagataaatgtttcgttttcgttggaagtttttgtttcggttcg

SEQ ID NO: 6688 - DNA, 810 bp, synthetic construct
  misc_feature 1..810: note = Description of Artificial Sequence: Synthetic polynucleotide
  source 1..810: mol_type = other DNA
gcgtacgggtcggggagggggttatcggatttggatttcgggatatttcgggggtttggggggcgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcggttcggggtcgggtcgaggtttcgttgcggggttggcgggcgcggcggggtcggcgggcgggttaggagttggcggcgcgcggagttcgaggcgcgttgtgttgttggcggcggcggcggcggcggcggtggcggcggcggtggcggcgtagcgcgttttggttcgcggcgtttttcgtcggtagcgcgaggcgggtttggagcggcgtcgtagttaattcgtgtcgtcgggggagggggcgtcgttgcggggcgtgggagttcggagggcgcgggttgcggttttttttagtagttttcgggttcggtaggtgcgcgcggggaggtaggcgtcgggcgaggttgtttgggttttggttcgagggttgttttcgatttcgtttcggtttttatttttagtcggtcgatttgcggagaggtcggcgtttagttttttatttagataggttttttttagagatattggcgcgttcggaggggatgcgtttaaagggtttcgtttaggcgggtcggtattcg

SEQ ID NO: 6689 - DNA, 1142 bp, synthetic construct
  misc_feature 1..1142: note = Description of Artificial Sequence: Synthetic polynucleotide
  source 1..1142: mol_type = other DNA
tcgggggagaaatttcggtttatagtcgggatgcgttttcgtcggggttatcgcggcggcgaacgtttcggatttcgtatttcggtgattttttgggatgaatcgaagtcggattcgtattttggtcgtaataagcgcgttttacgtcgttacgtattagcggtgattttcgagttttttgtcgttttggttttttcgtaggcgggtttcgaggttttcgtagggagtttagggttacggttacgtgtagtcgttttcgagttcgagtttgtaggttcggggttcggttcgcgttttggtggcgttcggcgaggttgtagcgcgtaaagtttttattttaagttttcgtcgcggcgttttcgtttcggagttggttcggtcgcggttttcgtttttttcggttgtttacgggttcggggcgaggacgcgagaggggtttggaagtcgttcggggagttcgttttgtttttcggagtcgtcgttaaatttcggtttcggggttcggtttagttttcgttttcggagttacggtcgtttcgtttttgtttttcggttttcgtcgggtttcgagtgcgtcgggagcgcggcgtagtagtcgtcgagggagggagcgaggtaggaggcgggacggagggaggggattgagcgcggggcggggagaaggggcgggtagtcgaaagcgtagcgtttggtttcgtttcgtttcgggatagtggtagcggcgttatcgttacggggcgtttaggcgtttaatcgggatttcgtattttggattcgggggttttggcgcgtttgttggattgcgtttttcgcggttagtttttgagttcgcgttcgggattgttcgcgttacgttttttttttcgttgttttttttttcgtttgtttttttaggagcgattattttgcggttttttcgtttgtacgcgatagtttttaaggttttcgcgtttcgttgttttggagttttacgtattaggcggcgcggtagttttttagggtcgcgcgttttgttagtttttttcgcggtgtaagtgtttcggtggtttcgggttcgcgtttttagtagtatcgttttagggtttatatgtgttagatattaaaattttatttttcgttgtttcggggtcgcgttttacgcg

SEQ ID NO: 6690 - DNA, 2885 bp, synthetic construct
  misc_feature 1..2885: note = Description of Artificial Sequence: Synthetic polynucleotide
  source 1..2885: mol_type = other DNA
acgttgtagataggcgcgttgtagggcggcggttttttttttttggtattatcgatagtcgaggaaattgggttaataaagtcggatattgcggcggggtcgcggggcgtaaatcggcgcggatagatgggttttcgggggtattttgttcggttttttggatttcggatggtggtagagttgggagttgcgtaggacgggtattgcgtagcgtattttcgtttatattcggcggggtacggggttcgtagtagtttatttattcgtagttcggttttttttttcggaagggagaggggatcggtggggagggggtttgttggatattagggttagacggggtttttttttgatcgttagggttaagtagggcgcgggttgtgaggatttttttttacgtagtttttcgaggtagagggttcgtaaagcggtttttatttaattttatttcgcggacgttttaggtagcggatggcggcgggggggggaggttaggggatatttaggggataaattttttagatttcgaggtagtcggcgacggcgtttaatttttaaataaatagaataaatttttatttggaaaaggtttttttcggggtttttttgcgttcgcggtttagtttttttgtagacggttatcgtgggtttttcgtagggttgcggagtttcggagttatcgaggtgggaggtgtcggttacgcgcgtttttaggaatagagtattgttttgtagtttagtacgaagggtcggttggagcgggagcgcgaggtttattgtaagaggattaggagttagtaagttcggttttttttcgtttttatttttcgtgcgttcggggttaggatcgtttgttcggaatttgattagtgttcgttttcgtcgtggttttgggatttcgcggtggtttttttttggggacgaacggtagtgttcgaaggatgttttatttattttcgtttttagatttgttgggtttcgataatatttagtgggtgtcgcgagttttcgggcgtagagtttagcgttcggttttcgagtttaatttcgcgtttcgacggttttggcgtttttcgttgcgttaaattgtttatcgcgtataggttggaagcgaagtcgggttttttttttttggtttgtagggtttttttaggttttttttgttcgggtagagagatagttataggggcgatcggaggacgcgtgcgggagggtcgggggttcgcgcggttacggtttttcgtgatagtgtttgtaaagcgcggagggcgtttcggagaaggcggcgtatttgttagggtagggttttagggcggcgtttgcggagaaggggtatatagtggtttggtcgaagggcgttaagggcgcggcgtttacgggcgcggttaggttttggttttggttgaggaaggttattaggcgtcgtatttcgtttagggtttgcgtttgtatgaggatatagtttttggcgagtagtagcgtggcgattttggagagtttgcgtatcgacgggttgtgcgcgtaggggatgacggttcgtagttcgtttagcgcgtcgtttaggtcgtgtatgcgtcgtcgttcgcgcgcgttgatgttgagtcgtagagatcgttgttttcgcggtcgtcgtcgttcgttcgtcgcgttttttggttcgcgtcgtcgtcgtcgttgttcgaaggcgtcgttttcgttttcgttttgttcgtcgttgtttttcgtcgtttgagttggggcgcgaggtgtaggcgtcgcggggaggtcgtcgttcgggttcggagtgtcgtagtcgcgggtcgtttcgggttttcgcgtcgtttcgtaggcgagattcgtagtcgtcgtcgcgtagtcgtggtttagtgttaggtacgcgtttttcgatagcgatttgagttcggttatggtcgcgtcgtttgggttcgggggttcgtcgggtgggcggatgtttatgtgggtgagtagttttcgaggtcggttcgagttcgtcgttgtcgttgtcgttgcgatgaggttttcggttttgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcgcggggcggcgcggggcggcgcgcgcggttttggagcgttagtatttgtttttcgatttttcggtcgtcgttttcggtcgtttcggggatttcgttattaaacgtacgcgttttaggtgggtattcgtttcggttcgtttttgagtttgattttagcgtaagagtttttggcgatacgtaggggttagagcgggggggcgcgtcgtaatagtagtagcgttagcgttaatattttgtttcgttgaggggtcgtttcgggtcggggttagggtcgtgggcgttttggtgtagtcgcggcgtagcgtgtattcggagttcgtatattttttgttcggggcgttttgtggttaggtttgaggggtagagtgagagggagtttttagaatttgttgaaaaacgttacgagcgttgtaggtcggggagggcgggaaggtggagggtagcgcggtttggggtttttcgggggtgggaggggagttttgtgagttgtaggatcgttttttttttgttagtcgttttttgggtatttattagcgaaacgcgtgaggtttggtgggttttttcggagttttcg

SEQ ID NO: 6691 - DNA, 1460 bp, synthetic construct
  misc_feature 1..1460: note = Description of Artificial Sequence: Synthetic polynucleotide
  source 1..1460: mol_type = other DNA
acgcgtatgagagagtagagcggtagcgacgcggtcggatcggtcgcgggggttgcgggaggaagcgttgtagggattcgggcggcgtcggcggtttagtcggagatgtacgcgttgtaatagatcgcgttgttggcgttcgatagcgcggagattaggttgtttttttttgggtaggatatggcgcgcgggtttagtttggttagtgttacgtggtacgggagttcgggggcgtcgggtcgagttcggttgtagttgaggtattggtcgaattcggtgaggtttacgtcggtttatagatcggcggcgggttttagcggttcggcgttttttagcggcggggtttcgggcggcggcgatagcgggtcggggtacgggtcgggcgtgtttagggtgtcgtagtataggttagcgagcggcgtcgcggggggcgcggttttgagcgttttcgttaggggagtttcgtagtaatcgtcggggtttcgcgataattcggtgggcgcgtagggcgcgcggaagggtcgtagcgcgtagttttcgggcgtcgcgggcggtgggaagaaggtagtttcgtcgggttttaggtcgtttagaggcgagcgttcgggcgtgggtagttttaggtcgtcgaattcggcgtttagcgggggtagttcgcggaaggcgcgagtcgagttagacgtcgcggggaaaggttcgggcggtggttgcgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcgtcgggcgggtgggcgtcgagtttttcgtgcgttcgggacgtttcgcgagggtttggcgtagttttcgtatttcgcggttcgggatttttgtttttttcgttttatttcggttcgagtttttttcgtttttttttttttttttgtcgttttttcgtcgtttatttagtattttgttgagtatcgcgttgtgtaggttcgggttttgttgagttagtcgtttgcgttcgttttttgtttatattatgaaggcgtttatgggtcgtcggatgcgcgattcgtttgtcgtttggcgtttttcgcggtcggtcgggttgaggttatagcgtttcggttcggggttgcgcgggggattgcgttgcgggttgggcggcgaggcgggcgcggcgggcgcggcgagggcggcggggtcggcggcgaggtcgcgcgtgttagcggcggtttcgtgtttcggggtttatgtatagtcgcggcgggcgggcgggtcgttttgtgcgtcgtagtcgggcggcgatttttgtattttagttgggcgcg

SEQ ID NO: 6692 - DNA, 1560 bp, synthetic construct
  misc_feature 1..1560: note = Description of Artificial Sequence: Synthetic polynucleotide
  source 1..1560: mol_type = other DNA
acgttttgtagtgtcgggttttgcggcgattattgagttttttcgttttcgtttttagttttttcgttttcgttttcggttttcgtttttttagtcggtcggggttcgtcgtttacgatttcgtacgtgtcgtcgacgtcgttttgtcgatttcgtcgtaggaggtggaattgtagtggtgtcggcggttttttttttggggcggcggtggcgaggcgttcgttggcggcgggtagcggttggatgaaatacgttttttttagtaggtagaaggcgtcgcgtacgttttcgtagaggttgagggcggtagtcgagttgggatcgttatttacggtgtcggagtagaagtagtgcgttaggtcggttttcggaagcggcgtttcggattcggatttgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcgttggaagggcgcgtagagtcggttatagtcgaagttttcggagttattaaaaggaggcgttgtagttttgtcggcgcgcgggaagttttttttttagcgtaaagttggagatattgagaggtaggcgtaggtagagtggttttgttgggataagaagcgttttggggcgttttcggggttgaggtaacgcggagattggtgtttggcgttttttttcggttttcgttttggttgcgatgttgtttattttgtttagggttttttttttttcgttcggtagcgtattttggttttgtaatagtttttggttcggagtcgttttttagcgagtgtaagaatcgggtagtcgagcggtttttttatagtggattagtgaaatttttatttttattttattttttttttttggtttttttttattttaaagacgtcgttttcggtttcgttggtgttaaatcgcgtttcgcgttgcgggttcgggagggggagggggtagttttcgcgttggttttacgttattgttcgttaatttaggggcggaaggggcgttgtgattagtattttgtattgttggggtcgttttagggagaagatttttttttttatcgtttttttttttcgtcggttttttggattattttttttttttatcgttcggttgcggtaatttagttatcgcgttgggttgcggtttttaggagggagggttcggttggagaacg

SEQ ID NO: 6693 - DNA, 5118 bp, synthetic construct
  misc_feature 1..5118: note = Description of Artificial Sequence: Synthetic polynucleotide
  source 1..5118: mol_type = other DNA
tcggtgtcgggagttttgtttttcgtcgttatttttggttagttttgcgtaagaacgtcgttttgtttggtagttaggtcgagacgtagtttgaatgtgagtaggaattcggagaagggaagggagagaattagaaagaaggttcgggagggattcgggaagtagtgggaggtttgcgttttggagtttcgcgagagttcgtcggtttggtacgggtttttttcgggtcgttcggcggtttaataaaggtcggtttcgatacgtattcggttttttgtgggagagaaatataaagaagagggaaaaatacggaggaggttaatagtattaggacgcgggggttaattaggaattttcggagtcggggtttattagtttttgtaaatgagtattttattttttaggaaggggttttagttgcgcgcgttggtgggaatcgtagtgtttgggattcgtttaggtcgtttatttcgggcgtcgggcgtaggattcggataagttttggggacgtttttaggacgtattagggtaagtttgggtatcgggatttaatttttagttatttttgggacggggtggggaggtataggagatatatcgagaggtatttagtattcgattggtattagggttaagggagtttaggggcgatatagattttttcgattttttaagttatttcggcgacgggaggatgttgagggaagtttgttaggtgaagaaggggttagtagtagtatagagttttcgattttgttttttaggttttagattcgcgttatgttaagacgggtttttcgatttttatttttgatttttaattttagttattggatcgagcgcgtaaagaatttgagatcgtttgtttttatcgtcgtaagtcggtcgtaggatagatattagtgggtagtaataaaaaaagaaatcgggtttcgggatacgtgtcggcggttggattaattttagcggttgtaattaaggagcgcgtacgttgcgtttgttggtgtttattagttatattggtaggcgtataatttcgcgtttcgattggtggttttatagcgcgtattatatatggtttcgttgttgttggcggggtaggttcgaaggaggtatttataaatgttcgagttttttttgatttttattttttcgttttttgcgtcgttcgagtgatagattttattaattgaacggttatgggttatttttgtaatcgttggacgatataatattacgttttagttttttatgttttaaatatatatttaacggatggttgtagagttagttgggaaatacgcggattgaaaaataatgttttagaaggtacgagattggggcgaaggcgagagcgggttgggtttttagcggagatcgtagagggagatatattttagaattaggggtaataacgtgggtttttttttgtatttgtttattttgtaattttgttatttgaagattaattatttattatgttaatttgtttgtttgtttttaaaatcgtatttgtatagtaaaagttttttaataacggaagtaattcgacgttttttatattttttaggagattgtgtgcgtgtgtgttcgcgcgtgcgtttatagtgttaagtgttagtattcgagatttgtagaaataaatgtttgaattcgaaatgtatgggtgtgagaaatttagttcggggaagagattagggattgggggagataggtggttgtttgtattataaggaatcgttaacgttagtatttgtagtttaagtagggttgttttgtaaaggtttagtaattttttttgtaggtttgttgtatacggtttttggttttttttatttgtaaaatgggtgaatgtattcgtattttagttattttcgtgaggtgtttttttagttcgggtttaattttttatcgttaagagtttttaggttttagagttagtttgtaatcggtaaaatatgttttaacgcggtcgcgagtggttttatttcgttgtttggtttatagcgtggagaagttttgtttaggtttgaaatttttttttgtagttttagaaagtaggcgattgggacggaaggttttttgttaattttttatagcggagttttgtttggattatagatgttagcgttgtttttgttttaaggcgtgtggtgattataaagacgatattgaaaatatttattattattcggtttttttgttaataaatggaggggtgtttaattataggtacgattttgtttttgtgttagcgcggttatcgtgcggaaataattcgtttttgtatttatattatttttaatttaaaggagagttgtgaatttttttaaaatatttttttggagttcgttttttttttttttgttcgttttttattttttaagtttttgtttttagttgggggcgttatcggttgtcgtcggagttgtagttacggttattttttagacgcgcgagtagagtattaagatagtggggattttgtgtttgggtatcgtttatatttggggcgttaaatgtttacgtgttgatgaaattagtgagatgggaataggcggcgggaaattagatagaggaagagttagggaggagattttagtttcggattttgggtcgttagggtttttcgcgcgtattttaaaaggtgcggttgcgtggggtattaggttagtttgttagattttgtagagtttttaaattattttattttttaatttgattttgtggtggtcgtattttttatagaaatttgattacgtttttttttttttttggttttaagcgcgtttagttttttttttattttttttgagtcgttttttttttttttttcgttttttcgggttttttttttagtttttttttaagaatttttcggttacgggcgtttattggttgtgcgtagggaggaggcgtgtgttcggtttggcgagttttattgagcggaattagttcggatgatattagttttttagtttttcggcgggtttagtttattggcgaggtagtttttttaggatacgtatattgtttttcgttttcgttttcgttatcgttgtcgtcgtcgtcgttgttatcgggttataaaaatcggtcgagtttttaaaggtgcggatgtttattatagatcgacgcgatattagcgttcggtgttaggtttttttttgaggtttttcggagcgagttttttaaatcgtatttagagtaagtgttttcgttttatagtagtcgtagtttagattttagggatagattttttttaattcggttgtgatttagaatgtttcgatatagggggtttggatttttattttgcgggttatttttttagagcgattttgtttttttgttttttttatatttatcgttgtattttttttattaaaagcgagaagtcggagcgataatagttttttttgtttaagttttagttagttggtgagtttttcgtggtttttagatgtagtatatggattttgggtttcgcgtcggttttgggtgtatgtgcgtgtgcgtgtgtttgttgcgtggtgtcgatggagataaggtggattcgtttgaggaattaaattattagttttttatttagatttttattttttttaaagaaaggtttttattttttattcgtttattttagttcgggggtttagtttttttatatttaattgaaagttcgaagtttttagaatgttattcgtatttcgagggttattaacgttttttgaaataatttgttgtatgagagtagaggggagatagagagagtttaattataggtattcgcgtgtagttaaaaggagggttagagatagtagcgagggggacgaggagttacgggttatttgtgtcgggatttcgcgttgtggtattgcggtgtaggcgggagtagtttttttgttttttattgatttatttttttttttttttttttttttttttttttattttttttttttttttttttttttttggaagttttcgggttcgagggaaggaggattttgcgaaagttgcgacgattatttttttttggggttatggattcggacgttagtttggtgtttagtcgttcgtcgtcgttagagttcgatgatttttttttgtcggttcggagtaagggtagtagcggtagcgtttttattgggggtatcgtgttttcgtttatttcgagtgattgttcgtcggagttgagcgtcgagttgcgcggcgttatgggttttgcgggcgcgtattttggggataagttaggaggtagtggttttaagttattttcgtttagtatttcgtcgtttacgtcgtcggcggttgcgtcgtttattaagaaggataagaagtaaatgatagagtcggagttgtagtagttgcgttttaagattaatagtcgcgagcgtaagcgtatgtacgattttaatatcgttatggatggttttcgcgaggttatgtcgtacgtatacggtttttcggtgcgtaagttttttaagatcgttacgttgttgttggcgcgtaattatatttttatgtttattaattcgttggaggagatgaagcgattggtgagcgagatttacgggggttattacgttggtttttattcgtcggtttgcggcggtttggcgtatttcgcgtttttgttcgtcgttatcgcgtattcggtagtagtagcgtacgtcgtatattatttcgcggtgtattattttattttgtcgttcgtcgtcgtagcggttgttgtcgtcgttgtagtcgcggttgtgtttagcgtttttttgttcggattcgggttgtcgtcggtcggttttattcgtttatcgtacggtttatttaagttttcgtttgttgtcgcggtcgtttcgttggggggcgggggcggcggtagtggggcgagcgggggtttttagtattggggcggtatgttttgtttttgtagtatgtgttaggtgtcgtcgtcgtattattacgtgtcggttatgggcgtcggtagtttgtcgcgttttattttcgacgttaagtgagtcgattggcgtcggcgcgttttggcgataggggagttaggggtcgcggggaagcgaggattggtttgcgttgggttcgggagttttgtcgcgaggaggggcg

SEQ ID NO: 6694 - DNA, 1423 bp, synthetic construct
  misc_feature 1..1423: note = Description of Artificial Sequence: Synthetic polynucleotide
  source 1..1423: mol_type = other DNA
tcgtattcgattgtacgcgtttttttgggatttcgtattggcgagtcgtttttttcggcgttggacgttttatttgtttcggcgtcgtcggaagagttttgtagagtgagtttttagggttatttcgttgttttttttttcgttttcgtagtcgttgtagttagcgtgggagtcgggtaggtcgcgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcgagtcgggtcgtattaattttttcggcgtcgacgggtttagtttatggtgtgggcgtcgggtttagggaggtttcggttttcgttaatcgcggagtagggcggtcgtttcgacgcgcgatttgcgaattcggagtgcgcgtcgggggcggggtagggacgcgtgggcgggaatgtacgcgcgtggttaggtgcgcgtgggtgcgagcgcgcgggagttttcgagtgcgcgcgtgttcgtgtgcgcgtgggtgtgggtgtgttcgcgtgttcgtgcgcgcgttttcggggttaagagcgcgggtcgcgcgggtaggtttggatattacgcgttttgttcgggtttaggacgcggttggcggtttcgggaggaagaggaggaggaagaggaggaggcggaggaggaggaagaggaggagggaggcggaggagtagaggttgggacggtcggaggagagagttcggttttagtaggaaaggaatttagtacgcgattattggaggggcgaggagtaagggaaggattagaggggaggagagggggttaggggagggaaagtgtgggagggggagtcgcgggggtgcgcgttttttttaattcggggtcgtttttagcgagaagtgatatttttttagttttattgaaaatcgttgtaaatattgaaaatagtaaaagtgaaaacggttgcgatattaagacgtttataaaatgatcgcggattgttttcgatgttgatgagaattgggacgacgtcgcgtagagcgttcggagggagaggcgcggtgttcgggatttcggtcgtggggaggagtcggatatagtcgtcgggacgcggggatgtcgagggtatcgcggtttggtttgatcgacgtacgcggtgatagtcgtttttgggagacgacggcgtttgtaattagtagtttttaaagggtgtagttaggaggtttagtttgttcgttttcggggttcggggttaagttttttttagaagttttcgtttttacgcgaatttcgatcgtaaaatttagtttatttgagcgtcgtttttttttttttatgtttttcgggggtcgttacgatcgtttcggagcgatttttaggaatttgtttcgtagcg

SEQ ID NO: 6695 - DNA, 1384 bp, synthetic construct
  misc_feature 1..1384: note = Description of Artificial Sequence: Synthetic polynucleotide
  source 1..1384: mol_type = other DNA
gcgtcgcgtatagaaaaggaaattttatttcgtttgttaagggtagggtcgggttagtggtaggagaaggttagttgcgggcgtaggtaggagcggatttaggagtcgcgtcggggcgtagagtcggacgtttcgaggagtttgcgcgtcgcgttattcggcggaagtcgcggtttatgcggggttttttaggtttatttaacgtttcgtaggcgtggttggtaggaggggttcggtcgtgtttagcgtttttagacgtagttttttttgtcgtagtcgtcggtggtcgtgggtcgtcgcggcgttgagtattttacggggaagttgaggtcgggacggtcggtgtagatttaggcgtcgtagtataagaggtagtcgtttattatgagtagcgcggtggtcgtttagtcgatgtatagcgttgcgtttagttcgtatttttgcgatacgggtatagacgggtcgtaaaattcgcggacgataatgttggcgaattagtagagtggtacgagcgttagtagttcgtaaaataggtagagtacgtttttcgtgagggttatacgcgttttggtcgggttcggggttacgtaggtggtgtattgcgcgttcgttagggttacgaagagcgtaacgaacgttagtagtacggcgtttacggtgagcgttcgcgtcgtttgtatttcggtgtttagagttagtatcgagtcgtatattttgtattgtatgtgttcggtgttttgtattacgtacgatatttatagttttttttaggtggtttgcgtcgttacgatgttgtggtttaggaaggcggttatttgttatatgggtagttcgtacgttaggattagatttttttagtttattaggtatagtattaggtttaggatttttaacgttgcggattttatggttagaggcgagacgcgtattcgaaggttcgtagaatttttaaggtcgtgttgcgcggcgttttgggcgggttttggtgtttttgcgttcgcgttttcggtttttggttttagttcgtttgtttcgcgggtttgtcgtattttttgggtttgttagtttttgtcggggggtattttttttgaaggttcgggggcggattttgtttttcgggttcggtttttcggttcgaagtagttaattcgtgcgcgggttatcgtgtcgtagttaattatagagtttttggtagttgaagttagggaaataacggtttttgaggggtagttgagggcgcgggatcgtttttcgttcggtagtcgtttttagttttattcgtcgttgttttagtcgcggtcgagcgtattttgggttggtttagggcgcgttttttgggtcgtttttttgcgcgtttcggtttcgttattttagaaggcgttcg

SEQ ID NO: 6696 - DNA, 1361 bp, synthetic construct
  misc_feature 1..1361: note = Description of Artificial Sequence: Synthetic polynucleotide
  source 1..1361: mol_type = other DNA
gcgttttcgattttcgtcgttgggatttttcgtcgtagtttttgttttagtttgtgttgcgggtggggtcgggttgagtagttcggcgttttttatcgcgttttttatcgtatcgttttcgatttaatttcgttttcgggcgtttattggtttgtagtattttttttttagtttgtgaagtgagtagggggaggcggtggtcggtcgtttttttttagcgtttagtttggtttcgcggcggaggcggcgtttttttcgtaggacggagttaagttggattgtcgcgtcgcgcggggcgggtaaagggggcgttgcgttcggtttcgggtagggagtgacggcggcggcggcggtttcgggcgagcgtggttttcgcgtgcgtatacgtatacgtcgtcgcgtagggatatacggatttcggtcgttagtcggttatataggcgcggagattcggttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggagagcgggcgagggtcggcgttaggtaagttttttagatttgaaatgaagttttttttcgtcgttgcgttttttttgcgcgttaggttgatattttttaatttaagtgtttggcgttgcgttcggggcggtcgatcgtcgtagattgtcggggtgggggtcgatttagttattttacgttttttttgatgcggagaagggagattaggggggtaggtaagttatgcggtcggagggattcggagggatatgtttttttatttttaggtggacggacgtatttacgcggatcgggaaggtagggttggagggtttttcggggttaggtatcgtaattcgtacggggtttgaggggtgggtaagtaatgtgttaggtgggggttggggtaggggttagtgtagaatgtttttttgtggtgatatattcgggattgtttaaaagagtgtcgttttcgtttttcgtggcgcggaggggttggggttggggatgttagggttttagtggtttttagaagaaacgttttgcggggtttgtggggaaacgtatcggtttttttaggttgaagtgggttcgttgagatttttgtttgtcgttttagaggtagaagtttttgcggcggttgcggggggcggaggttatattttcggcg

SEQ ID NO: 6697 - DNA, 1175 bp, synthetic construct
  misc_feature 1..1175: note = Description of Artificial Sequence: Synthetic polynucleotide
  source 1..1175: mol_type = other DNA
acgttgtttggtcggagcgttttataattcggttaatggggagggagtcgttcgttaagcgtttgttaggtttcgattaacgggatgggtttttttcgttagagtatattgttttaatttaggagcggttgtaggatttgagttaatgagacgtaattttcgttagtcgcgcggtgttcggttaataggaggtcgttcgtgttcggtagcgtgggaggtgtggggtggcgggcggcgttgcgaagttgagggagttgcgcgcggacgagttatagtttgttatagggtgggtgcgttcgttttgtttagttcgttcgtcgtttttcggttttttttgcgcggcggtttttggatgggggttttttttcggggggttttaggcgcgggtaagtcggtcgtcgtttttttaggtttcggggtttcggtcgttgggggcgcgcgggcgggcgaggttggcggtacggagcgtttggttttttgtgggggcgtcggtttttttttggggttttgcgcgtttagggttatttcggcgcggtttaggttgcgagttttgtcgcgtacgttagcggttaatatggaggtagtttcggcgcgtttcgcgggggatcgtcggcgttcgtgggttttaagaggtcggggcgcggcgcgcgttcgggttttgggcggcgagggcgtagcgagggttgtcgttttttcgggtagtttcggggggcgcggcgttgggtcgcgggttcgggggttgtcgtgttcgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcggcggttttttgcgttcgggcgatggcgatagcgataggtttttaatttcgtttcgggttcgggtcggtcgggtttcgcgtcgggttacgcgcgcgtatagagttttttcgggtttttttacgttggacgtcgatcgttcgttgtcggaggacgcggggaggggtatcgttttttcggcggaggttggcgtggttaagggtataggggacggcgtcggcgtttcggtagggatagtggggatttcggggtttcggtttttcg

SEQ ID NO: 6698 - DNA, 1087 bp, synthetic construct
  misc_feature 1..1087: note = Description of Artificial Sequence: Synthetic polynucleotide
  source 1..1087: mol_type = other DNA
tcggtattcgcgtttttgtgtttttggtggtttcggcgttttttcggagcgcgcggtatgtttgtttttatacgtttagtatttttgtttttagagtaaatttattttttagggtatacgtagaggggtagttaggtatcgtttttattttgttttatttaggtcgcgcgtatttcggaaatttggatttcgcgattagtttttttttgttttttttcgaggattttagcggtagtgtgttttggatttatttgtagtttttaagtttttttatttttgcgttttttttaggcgtttttgagtttgtagagtttacgatttttaataggttgtttcgaagtgtttttttttatatcgttttaggaatgatttttttatattcgtttttcgtaaaaaaaagttggtttaagatttaggcgttttaaggattagtttaggtttttattcgacgcgggttagggggtgttgttttggtagtttcggagtttcggtaaagagtaatttgtagggaggcgttacgcgcggtttttattattcgttagagattcggtttatggggttaaacggaggggtttgtgtcggtcgatattttaagttttgtcgcgtttttttcgtcgtttatcgtatgggatcggcggaggagaaggcgcggtcgcgggttttttgaggtagcgtgtttcgtttcgggaggaaagtttgtgttatatagaggaggcggcgcggggaggatttgggcgtcggtgggtggaggcgtgggcggtggcgtcgcgtggtcgtgtgtttgttttttcggcgatcggtgcgtttgtttttcgtcggagttcgcggtcgtcgcgttttcgttcgttgcgtttagcgttcggcgcgtttcggttttagtttcgacgcgttttcgtcgtcgtcgtcgcgcgttcgtcggttatattttttttttttttgaatttatgtgtaaaatatgttacgttgtatttttagggaaagtttcgcggtttttgatagtagtcgttggagcggtgggttcgtttagtttttttcgcgttttttcggagtttcgttcggttatttttacgcggtcgagttgtaagcg

SEQ ID NO: 6699 - DNA, 693 bp, synthetic construct
  misc_feature 1..693: note = Description of Artificial Sequence: Synthetic polynucleotide
  source 1..693: mol_type = other DNA
tcggtagttaacgtttagttttcgttttttttttttatttcggatttcgtaatcgcgaggcgagagagtagcgtcggcgaggtattggttgggttttgattgttacgttaattttttgttgttttttttagtttttagtcgtttcgtttttttttttttatttttagtttgggtttggaggcgatttttttttattgattgagtcgattgtatttttgggtaagcggcgttttgttttttttttgtttttgtttgttttttttgtaaggttacggcgtttggagtagggtttgtagcggtcgtcgtagtaacgcgagttaagtcgtgtttcgtacggtcgttcggggtcgtattttcgttcggtggcggcgttcgaagacgttagtcgcgttacgtattgtttgcgtttcgcgttttagtcgtcgcgtattaacgtcgtcgttttcgtcgggagttaagttcgtcgggtcggttcggttttaggtgggtagttcggtttgtagttggttggaggtggcggtcgttgtagttttggtagcgggtatatttttaagtatacgtatttaacgttttttttttgagttacgaggatggagtagttatttcggttcgggattggcgtaaggtaaggtgtagtcgtttgttgtttttcgtagagcgcgggattatttttttgttcgggtatttaggtcg

SEQ ID NO: 6700 - DNA, 5065 bp, synthetic construct; identical to SEQ ID NO: 6668
  misc_feature 1..5065: note = Description of Artificial Sequence: Synthetic polynucleotide
  source 1..5065: mol_type = other DNA

SEQ ID NO: 6701 - DNA, 307 bp, synthetic construct
  misc_feature 1..307: note = Description of Artificial Sequence: Synthetic polynucleotide
  source 1..307: mol_type = other DNA
gcgcgggggtcggattatgagtcgttgagtcgggtaaattttaggttatcgagttagcggattttcggagcgtagttttgcgtcgcggagtaggttttaattaggcggcgaggcggttatacgtatcgagttagcgattttcgggcgacgcgcggggttagggagcgttacgatggaggcgttaatggttcggggcgcgtttacgggttttttgagggcgttttgttttttgggttgtttgttgagttacgtcgtcgtcgcgtcgtcgtttattattaagtttttcggcgatgtcgtttttaaaacg

SEQ ID NO: 6702 - DNA, 1563 bp, synthetic construct
  misc_feature 1..1563: note = Description of Artificial Sequence: Synthetic polynucleotide
  source 1..1563: mol_type = other DNA
tcgggtttcgaaaacggggggagggggacgacgttttagaggtttttgagtttttggtttttttcgattttaagggtttttttttttcggtttttaggcggcgacggcgggtagcgcgaagtagtaggcgtaggggcgttgggatggggatgtttttgtaggtttaaggttttttttgggagtttaaataaagattacggtagcgtcgttttttttttcgggaattcgacgtcgcgcggttatagggggtttggaggggcgggtagggtttcgtagcgtatttagtatagttcgcgcggcggagcgggtgagaagtcggcgggggcgcggatcgatcggggtgttttttaggtttcgcgtcgcggttttcgttcgttttttcgttcgtttatcgggtattttagtcgcgtagaaggcggaagttacgcgcgagggatcgcggttcgttcgggattagttttaggttcggtatcgtttcgcgggtcgagcgtttatattcgttaaatttacgcgggtacgttttcgcggcgtatcgtttttagttcggttttcgtttttgtagtcgcgggtacgcggaggggtttttggttgttcgtatttgtattcgcgcgtcggcggcgtcgaagtttcgtttttcgtttgcgcgtttgtttcgttcgtattttcgcggtgagtcggcggcgttttcgtttttgagtttagggttagtttttttcgtcgtcgcggttgttgcgcgcgttttcgtttagtttagtttagtttcgagtacgattttagttttacgtacgattttagtttcgcgagtttcgtatcgattcgttttcgttttatttcgttttcgcgggggcggcgttttttttttttcgcggttttcgtttttttttttcgttttttcggtcgcgttggggatttttagtcgtcgttcgcgattttttatcgcgacgttcggaggcggcggggtttttttgttcgggcggcgggtacgggggattattttttacggtgttatcgtatttatttcgcgtttttttttcgttttttggagtttatcgggattaggtggcggcgggtgtttttttgggggtgcgcggttatgtaattggtggatttttttaaatcgttttggaggggggagcgcggcgttgggggcgggagagcgtttttggttgtgagttgtttttgtcgtttcgtttcgcgtttttttgtcgtttcgtttcgggtttttcgcgttttttttttcggttcggtcgagcgcgttgtttcgacgtcgttatttagagtcgggtcgcgtcgggcgtcgagatgaaggtgttgggatatcggttggagttgtttataggtatcgttcgtttgtttcgtagtcggtcgttatttttcgagttggagcggatttcgggcgcggcggtcggggattggggcggttcgggtttgagtaggaaggggtgcggattttaattaagttttagttttgtgttatttgtttgtgtgcggagtttagtttcgggagaggatttgaggttgtggcgagtttttggcgttggcgttcgggttgcgggagtatcg

SEQ ID NO: 6703 - DNA, 512 bp, synthetic construct
  misc_feature 1..512: note = Description of Artificial Sequence: Synthetic polynucleotide
  source 1..512: mol_type = other DNA
tcggtttaagttagcgtatttcgtcgattttttgtttagtttaaatttcgaggttgggtaaggtattggatttacggttggatcgattcggggtagtttttgggtgaatagtagcgtgttcgtcggtagagaatcgagattagcgagtcgattatgcggttgtatagattttacgcgcggtcgagcgcggtggtttgtgggtttttgttgttttttttttagggttattatgaggttttcgcggaggggtgatagggatcgggtttagatttgttaaatgttgcggaggtagaatttgatagtgcgggagggtaggcgtttgggaggtaggagttggtggagatgatagcgtggaattcgtgagttttacgtaacgtttttttgtcgtttagggtgggtttttagaagtatagaaatggtcgggttgcgggatattatagcgaggaattagcggagtataggggttttaggagcgtcgggatatgttaggtcgggtagatagtttcgggtcg

SEQ ID NO: 6704 - DNA, 1070 bp, synthetic construct
  misc_feature 1..1070: note = Description of Artificial Sequence: Synthetic polynucleotide
  source 1..1070: mol_type = other DNA
tcgcgagaagtataaaaggggaggggcgggtcgtgtagttaagaggacggttaaacggggaggttttttttttgttttcgtagatgttggagtagcgattggttcgggagattcgtgttttggagagaagtaaggagtagttgttttcggagagtgagtttttcgcgttaggtgggcggggggagggggatgtgttcgggtttcggttttgtttttgacgttcgtttatcgatagggaggttggtgcgcgttaagttgcgggaggtggagcggcggttgtattcgtcgtttgaggtcgagggcgttatggcggtgaatgacgggtgagaggggaagggaggagtgggcgaggagggtaggggtagggcggaggggaattcgtttaggtttttcgtttcgttttcgattgtcgttttttcggtttgtgtttttttcggcgtcgtcgggttttcgcgtttcggtggtttttttttcgttttttggattttcgtttttttttttttgttttttcggtttttttttcgtaggttgaaggcggagttggagatattcggggagtaggttcggagcgttttcgaggtcggggtcggcgagggagaggtagggagttcgaggaagggaggcggggcgggtagggatcgagttaggagagagcgggcgggggttttgggagcggttttcgagagtggggtttgtggggagtagggcggtttcggggatagaggaagtcgcggtggaggtttagggtagacgcgggcggacgcgaggagcgtaggaatttggttcgtagttttatttagttttcggtaggtcggatttgagttttttcgcgttcgcgacgaggaggatttcgagtcgtcggtggttgtttttgacgttttttaggttagtaggattcgttcgttttcgattttttttcgagattcgttaagaaataaaggcgatgattttcgattatgttcgcgtttttcgcggagtttgtgttatatcgtggagcggggcggggcgtgttgggatttcgaggcggggtttttgtcggattttttttattagtcgagtttcgggcgtcg

SEQ ID NO: 6705 - DNA, 766 bp, synthetic construct
  misc_feature 1..766: note = Description of Artificial Sequence: Synthetic polynucleotide
  source 1..766: mol_type = other DNA
acgaattattatttaattcgttggcgtcgttgttgttgttattggttaaggtcgcggcgatcgacgtatagtagaggtagtatagttggagcgtttgtaagagaaaaggtgatatcgcgcgtgaggggcgcggcggggttggcgtcgggcgttttttgttattcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcgtcgtttatatcgtagcgggggcgcgttgggattttttttttttcggtcgtttgcgcgtttttttttttttcggcgcgggtttgtcgagttgtagtttgcggtattttagagggtacggggggttttttgggtcgggattggagcgtaaacggttgggagattgtcggtgtttgttcgttcgtttgtgcgtttgtttgtgtcggtgtgagcgtttgaggcgatggggaagatagcgttagttggtttttttagcgcgtcggagtcgagcgttcgtttttttatcgcgcggtgattggcgattagcggttttcgggttcgttcgagttttcgggttggtgtaagggcgtgggattttcg

SEQ ID NO: 6706 - DNA, 363 bp, synthetic construct; identical to SEQ ID NO: 6479
  misc_feature 1..363: note = Description of Artificial Sequence: Synthetic polynucleotide
  source 1..363: mol_type = other DNA

SEQ ID NO: 6707 - DNA, 2919 bp, synthetic construct
  misc_feature 1..2919: note = Description of Artificial Sequence: Synthetic polynucleotide
  source 1..2919: mol_type = other DNA
tcgagtcggattttcgcggagtatttattagggtggttagttggaatcgcgtgttagatttatatgaaaaattcgggagaggacgggttgtcgttgttcgagtcgttttttcggaagtcgttgtttattaatttttcgtatttttttttgtacgcgtttttttcgcgtattagtttggagattttttgtttgaggtggtcgatttgttgtagtagttggttttttttcgattttaggacgtgtttttgttgtatttttttgaagcggtaggattgggtatagtcgcggttttttagggttcgttttttttgttttagtcggattattttttttttgttgatttcgcgtagttgtcggtttagttcgcgtatagatatggttattagttgttcgtcggagaagcggtcgtcgaagtgtaggtcgtcggcggcgtggtgcgggtgtagggcgtttttcgttttcgtcgcgttttcgtcgttttcgtcgtcgtcgtcgtcgtcgtcgtttttagcgttggtcgggttatcgtcgttcgcgtttttagcgttatcggtcgaggcggtcgcgttgttcgcggcgtcgggcgcgtcggtcgtcgggtggtggtggtggtcggcggcgtggtggtggtggtggtggtagtgcgggttcgcgtcgttttgcgcggcggtcgcggcgattacggcggatattacggcggcggcggggtttattttttcgtcgttgtcgtttaaggaggcgtcggtatcggtttcggtcgtcgcggttagttgttgcgtttcgcgcgcgtagttatcgaagtcgttttggagttggtggttgttgttgatgagcgtttcgatcgcgttttcggggttgaagtttagcgtttcggggtttagttgttgcgggtagtcggttatttagtagtagttttttaggtgcgttttttgttcgttgttcgagttcgggttgggcgtcgagaagttgggggaagggggtatcgagttgtacggcgtgtttatgggggtggaggatagcgagttttcggcgatgagacggtcgtattggttgatgatgcggtcggtttttatcggttttttttttattttaaattttattagatcgaagttattaatatattttatggttaggggattggtgggtaggtcggagttgtttattgttagttttgatgttatttttttgtcgtcgtcgtcgtcgtcgtcgtcgtttcgttagatgggttgtaggagaggggttagcgggttgtgttgggtggttagcgggtgagttagtttgtcgggttggggcgtttttagtttgcgcggcggtggttggttcgaaattttcgagcgcgtttatatatatattttttcgttttgttcgcgtttttcgcgttcgtttttttttttttttgtttacgttaatgtgttttttcgttcgtttcggtttttttttgttcgttcgtttttttgcgcgttgagtcggcggttttaggttcgggaagatttttcgcgagttgcggtggcggcggtggtggttgcggcggcgaagttggaggagttcggttcggtgcgcggcgtttttcgttcgtcgtttcgttgcgcgttttgtataaggaagggttcgtttcgtcggttcgggttgtaggtagggcgcgcgcggcgttcgttcggggttggaggcgcggcgggcgtttgttcgggcggcgcgggttttggtacgggggagttaatattttatgtttttcgtttttttttttgtttggttttttttattatttttttttttttttttttttttttcgcgcgttttttatttttgtgtaaagtgtaaggtagaggtgtagttcgattggaggagagggaggggggagtttagtttttttttgtttttttttaaaaaagtaaaatagcgaagttttggggaaagacgaggtagagagtaaaggggggagggggaggttaagtcgataagtagttcgagttatagttagaagatgaaaaaagattttaaagtttttgatttagtaagaagagtttaaagtaattgttgagttttatagtattcgtgacgttaggtttaaatgagaaattgattggtatttcgggttaatgggaggcggcgagagcggtcgcgattagtataatagtatagaaataaggaaatttttcggagttgttaattagggtttaattagttgattgttagttgggacgggttggtttaattttttttgcgtcgttgtttattcgggagggaacgaggttcggcgtaaagtttggtgtaagaggggaaggagtttttttagaggggtttcggtaattcgggcggatttgggagggcggtttgtttttttttggagcgcgagataggttttttattcggagttttagttcgttgggggtttattcggttgggattggtttgattttttttttttgtttgttttttatttttaggattgtgaattcgttttttagtttttttttttcgtattaattttggtatttaggtgtttgtcggggattttttttttttgagtttggtcgtgttcggcgtttaaatttggttttaattttttgttcgtttttcgggcgttcgtgcggggaagggatcgggaagggagggatgtagtggggtgttcggatcggggttgcgggttgggcgtcgttcggttatgcgtttgtttagaaggttgggtattcgtggagagggaaagtttattttatttttttttttataacgaggtaaaataagttgtttagaggttattttttacggagatcggttgttcgttggcgtcgcgtgtttttggatagagcgagcgtttatgcgagataatttcggggaagtttaaagttaggttagtcgggtttagtttttcggtttttgattggtcggagtttggtttttgagatttatattgcgcgttcg

SEQ ID NO: 6708 - DNA, 2267 bp, synthetic construct
  misc_feature 1..2267: note = Description of Artificial Sequence: Synthetic polynucleotide
  source 1..2267: mol_type = other DNA
tcgaaaaatcggttttcgttttttattttcggtcgattcgttcgtcgaggtggttgttttgggaattttttgtttttcgtttaggagaggaaacgtatattcgggtcggacgtatagaagtcgtattttggttggggttataagtttgatagttatcgataagtttttatttataggagtacgcgacgtgttttttttttaagggaaaggtttttttttttgggttttggaatgggtttgaagttagtcggttttagtttatagggtgaatgaggggtgggtatagttcggtcgcggttttagtatatacgggcggacgtaggggcgggggagcgttagtttcgtagtgtgttcggagtttagcggttttgagtcgtcgttattagtttggtcgttttttgttttacgtaagtgaagttagtcgtttagggttgcgtttttagttatttgtttttttatagaggtttatattttttttttcgttgtttttatagtttggttcggggtttgtttaatatagatggacgttttttaaaggttgtgcgcgttatcgttgttattcggttgtgtcgaggttcgcggtcgttaggattttagggatcgtatgttaggtagggtttaggatttttagcgcggattatttttagtttgcggggtagcgtcggggattcgggtaggagggagaggagtaggagggagttttggatttttttttttagatcggtcgtcgttatttttgttttttttagggtcgttttcggtttttttattttcgggttttcgttacgcgggtcgcggggtttttgttaggaaaatcgggcggttttaggggagttcgcgagatttttagcgttcgggcgcgtcgtttttttcgaagtttcgtcgtagttttcgtaggttaggttttgtttacggggggttgcgtttagttcggatgggtgggcgttgggcgggttggttttattttgtcgtgggtattaattttgaaaacggttcgtgcgttcggcgcggttgcggcgtagattcgggaacggtagtcgcgggcggagtcggggtagagcggcggcggcgcgcggggcggatacggtatttacggtcggggggttcgggggattcggcgggcggcggacggcgtatattcgcgattcggttcgggagtcgttgttttttttagtttggttttcgtttttacgatttaggggcggttgcgcgttgttttttggcgtcgtatcgggtttaggcgcgcggcggggttggggcgcgcggggcggtcgtttgggttatgtcggggattcggtttcggttatttcgcgcgggaataaagcgcgtatttcgttcggggcggttttcggttttcgcggttcgcgtcgggtttagtcgtcgcgtttgtggttttaacgtcgcgcgttcgttcgagagttttacggggtttcgcggttttcgtttcgcgcgtttcgttttcgttttttgtttttcgtcgtcgtcgttgcgttatttgtttttcgttcggcgtttatggcgtttagtttcgtttcggggcgtcggtttggagaggggtttttcgtcgtcgagagtcgtttttaacgttttcgttatcggggcggcgttttaagaattggttgtgggggtcggggttgtgcggagcgtcgggagtagggagaggggagaggggcgcggggagggggcgacgggcgcgtcgttttttgcggggggcggcgcggggaggcgtaggcgggggcgagcgaagaggttgaggggtgcgggcgtcgtggagggggcgcggttttggggggcggttttcgtttgcgtttatttttttttttttcgtaggtcgcgtatatttatttcgtagtagtcggcggtcgcgggtttcgtagttttagaatcgcggtttttggcggtcgcgcgggaggttgaacgggagttggggggtgtggggggggtggggaggtggggagttgggggggaggtcgttttttcggtcgtcgttttcgttttttgtttcgcgttcgtttttagcgcggcgtttggttcggtttggggttattttcgtgcgtggtcggtaggggtcgcgtttttttcgtttagtttttcgggcgggttcgatgcgaagttttcgtttttcgcgggtttcggggttaggttatttgtatatattttgtatttatttgtatatcgtgcgttttatgtttatttgtagaaacgtttcgagtcgttgttttgtttttttcgtattttttttgtcggtaggttttttttttcgttcg

SEQ ID NO: 6709 - DNA, 265 bp, synthetic construct
  misc_feature 1..265: note = Description of Artificial Sequence: Synthetic polynucleotide
  source 1..265: mol_type = other DNA
tcgcggttcgcgtgggttttaggcgcgggatggcggcgtttagtagcgcgggttcgcgtagggcgcgtagcgttgggggtaatagcgtggggttcggtcggtagtggggcgcgggttgcgcggtaagtagtttttcggagtttagtattagttttagtattatgtagggtatttacgaggcggaggttagtaggcgtcgggttcggttaaagtcgttcgtagtttttagtattcgcgttttttgttttatcggtcgtaggttgcg

SEQ ID NO: 6710 - DNA, 374 bp, synthetic construct
  misc_feature 1..374: note = Description of Artificial Sequence: Synthetic polynucleotide
  source 1..374: mol_type = other DNA
tcggggagggtagtcgttcgtttttttcggcgttgggagttttcggttggtattgcgggaggagttttcgggtgattcgcgggttttgaaatcgtcgttcgggagttcggggtttgcgttgcgtttacggggcgagcgagggagaattgacgtttttcgttcggattttttttttttttcgagaattaggtaggtcgcgtttatttttaagttcgattgttttcgcggtaatatttgtgggaaatattacggtggattttgtgggtcgttgagttttttgattttcggtttgttttattttgttttgttagtgggttttgcgttcgcgttaataattcgaatgggtacgtttttgcgttttagaacgttgttcg

SEQ ID NO: 6711 - DNA, 1133 bp, synthetic construct
  misc_feature 1..1133: note = Description of Artificial Sequence: Synthetic polynucleotide
  source 1..1133: mol_type = other DNA
tcggcgcgggtcgttttcgtttttagttttaatgttgttgcgttttaggtcgtttcgtttttggtaggttttagtttttgatttagtttttcgtttagtttttgagagtagttttttcgcgggattggtttgtgcgcgcgcgtttgcggtatcgtcggattaggggtcgttttcgagcggggagtttaggaggacggttaggtggtttgaggtagaggcgttagggaggatggagaagggatatttagggtttaggcggggtgggggtagggagggcggcgggatagtaaggaagtgggtgtatttgggtgatttagttgcgtatgagcgggtaggggttcggggcgcgcggattttaggcgttggattgcggcgtggagtagcgttggggaaatcgcgtcgggtttagcgaggattgttgggcggggcgcgcgaggagcgaagttggtcgggggcggggtttgagtcgtgtcggggcggggtttagattcgggttggtcgtggtgggcggggtttgagtcgtgaaggggcgggttttgtaggggcggggtttcgaggggcggagtttgcggtgattagcgagggggcggggtttagagttattaagaagcgggatttagtgagggttaaacgtggggcgtcgggggcgtggcgcggggcgtaggtgtacgtaggttggtcgcgggcgcgcggggttcggcgggagtttcggggtggttttcgcgtggggtcgggggcgttcgcgcgggcggggcgaggtcggggagggtagttgttcgtttttttcggtattgggagttttcggttggtattgcgggaggagttttcgggtgattcgcgggttttgaaatcgtcgttcgggagttcggggtttgcgcggcgtttacggggcgagcgagggagaattgacgtttttcgttcggattttttttttttttcgagaattaggtaggtcgcgtttatttttaagttcgattgttttcgcggtaatatttgtgagaaatattacggtggattttgtgggtcgttgagttttttgattttcggtttgttttattttgttttgttagtgggttttgcgttcgcgttaataattcgaatgggtacgtttttgagtttaagaacgttgttcg

SEQ ID NO: 6712 - DNA, 2358 bp, synthetic construct
  misc_feature 1..2358: note = Description of Artificial Sequence: Synthetic polynucleotide
  source 1..2358: mol_type = other DNA
acgatatttcggtttgttgttatggaaataggggcggattaaggttggagcgtggagcgtagggattaggtttttcggttatttgagttttcgttttagtcgttttcgtagggtcggggtagttagtcgtaggcgtcgcggttttttagttttttggtcgggttaggcgcgggggggatttcggcggggcgttatagtttgttcgggtttgggaggggagaggtagacgtagaggttggaatagttggtggcggggttcgtgggttttcggcgtgattatttgtttttttagggttcgggggacggcgtttcgcgtggtaattacgtgggggcgcggcgggattttttcggtgttcgtattaattttgtcgcgtttcgtatcgggtcgggttgttggggcgtttagttacggtggtcgcgaagttagttgtttttaagttgagttgtgtatcggtcgcgtatattggcggtacggttttcgcgttttttcgtttttagtataatgaaagtttgaggaattggatattaggcgttggtcgttttttatttttagtcgttgggtgtttagagtttatttttagcgattagagtagaattgtagagaagacgttcgcgttcgggtttcgtttggggagttagggcgcgcggggagcgttcgggtcgcgcggttattgatcgttggttgtacgggggcgtcgtgcggattcggtttttataaagcggtagaagtaagggcgtgtgttcgcgtagggaatggaggttgtaagtgtaaaattttattttagtaaagtaaaggttttaggaggtcggttttttttttattatcggtcgtttattttggttttcgattgattttttcgggtcggatttttaggtttggttattcgatttatggagaaaatttcgtgttttataattggtcgttgacgggagttgagttttagtagtagtttttcggcgggtgcgttcggtaaaatttattagttcgtcgggggttattttttagatcgggagtttcggcgtcgggcggcgttcgggttcgcggtttttttcggagcgtatttaattttaatttgtttttgcggttttaatttatttttgcgaagtatgttggttacggggtcgtcgtttcgaggtcggtttaggcgtattttttttcggggtttagatttaaatttttgggcgttagttgtagttaattcgagcgcgtcgaggcgggggtaagtcggggattcgttcgtgttcggtggttcggtttcgtaggggtatggtgagttttagtttcgcgtcgagggtatcggcgttcgtaagtaatcgtggtgttgttcggtagtttcgcgcgtttgtttagtttcggggcgagcggtttgtttcgcggagtcggcggtttgtttttgttattcggagtatttcgtaggcggttttgaggggggacgtcgttttttggtcggtcggtcgtagttttttttttttcgttttttcggattatcgtcgtcgcggttgtagtaaaagggcgttcgtacgtatcgtcgagtttcggggaaagcgttcggcgcgcgtttgtaggatcgagcgatcggcggagcggggcgttttttttttttttttcggtttttttttttttttttttttttttttttttttgttttttagttttttttttttcgtttcgtttttcgttttcgtttacggagcgttttttatataaaatttatgaaagtgtttttagttcgtagtgtcgagcgtcgttttatttttaaggtagtagcgtttagtcgcgcggcgtcgttttttaaggtgtttttattgcgttcgttttcggggaagatgttcggttcgcgttcgtttaggtatttgtttttagtttttaagtcggttttcggattattttacgttttttttcggtttcgtaggttttttggagttcgaattcgtagtttagttttcgttcgttcgtttttcgcggttggaggttatcgggagacgcggttgggacgcgaggatcgtcgtttagagtacggatcgcgagttcgttttttgtttcgttttttttttggttagcgtttttttttttagtttcgacggttttttttcgtattgaatagttttagcgaattcggttgtttcgtatttcgagttttaggatattgttttttcgtggggagaggaggggagtaagtattcggaaagggttagttgtaaattttagggagaaggaaggattcgtgcgggttcgggtgggtcgttttcgtttgggtggggtggcggcggggggtttttgattttttttggtttatatagatttcgtcggggggttcgcggaaaatggaggaggcgtcgtttggaaagcgggtttcg

SEQ ID NO: 6713 - DNA, 1050 bp, synthetic construct
  misc_feature 1..1050: note = Description of Artificial Sequence: Synthetic polynucleotide
  source 1..1050: mol_type = other DNA
gcgcgcgtttcgggagagttgtgtttttcgcgaaattcgtgcgttttagtttagggttttcgggatcggtgttcgttagtgggtataggacgtcgggtgttcgaagggttgtttggagatgtaattgattttggcgggtattagaatgacgagtggtagtagtaggagcggggtgacgaataagattacgaaggatttgaatttggagatatagtttagcgtcgaggttatcgcgcgggagggagattggcgggcgagacgagtgaggggtagttagaggcgtcgcgggtttaagaaggggttatagttttcggggattggggagggggcggtgataatttcgtttcgtacgggggcgttttttcgcggttttggggcggggttatttttcggggtttgtgggacgcgtttgtttttaattttgttattcggcggcggtgggaggcgtttttggattttaacgtttcgggttagttttttaggggtagtttgggttttagtatttcgcgttgtttaagttttttttgcgttgtcgaggtagaggtgcgtttcggggttgttaagcggggcgtgttttggttattggtgttgttcgttttggcgtaaggcgttttttcgcgttcgtatttgtttttttttgggttttgaagggtttcggatgaaattttttgtaggtttttgggttttttaggtttattttttcgattttttttttttttttatttttttattttcgttttttcggtgttttttcgagaggtgtttttttacgtttcgcgtttttcgtatcgcgggtttcgtttttcggttttttttggttttttcgttacgttcgttttattttaggtgtaggatttttttttttcgttcgtatttttcggttcggagtttttgggcgatcgtatagggaagcgaggttattgtttttttttgttttaggggttgtcgcgttttagtggacgttgtatttcgtagacgttcggcgggtagatgcggatacgcgttttggaggggttttatcgagttttagtagtcgtagttgttcgttcg

SEQ ID NO: 6714 - DNA, 1731 bp, synthetic construct
  misc_feature 1..1731: note = Description of Artificial Sequence: Synthetic polynucleotide
  source 1..1731: mol_type = other DNA
tcgggttcgtttcgtttatcggtattaggcgaggtttttgtcgtagttgcggtcgaagaagtggggttcggcgtttacggcgcgtacgtcggggtgtacgcgtaggaattttagtagcgttcgcgtgtcgtttttttttatttcgatgatgatggtttgcggtagttgtttgttgttttcgtttaggagtagcgttagggttttcggcggggtttcggttacggtgttttcggtttcggagtcgttcggattttttgataggttaggggatttttttttttaggtcgttttttcgtcgtcgtcgcggggcgcgggcggtcggcgttttcgttattgcggtagttgtaggaggcgttttttttgtgtcgtcgtcggttatatcgttagttttttcgggttttcggttaggacgtcgttattaggggttttcgttttttcgtcgtcgtcggatagttttacgacggggtcggatagggtttggtagcgttcggttaggtagtagaagacgtaaagggacgtgagtagggagtagagtattagtaagaattttcggaagatgttgcgggatagcggttcggtcgaggtggagagggtattggtcgggttcggaggggttattttagtcggaggcgacgtcgggtaacgcgtcggttatgttaggtttggatttcgataggtgttagagtattttttcggcgggttagcgcgttggacggaggttatatcgtcgtgcgtttttgtggtcgtgcgaattgtttcgggaggtagcggtcggggtttcgcggggaaacggaatttcgggggtttcgcgtaggatttttgtttttagtcgagggagcgggaaggggaacgcgggttcgtgtttaagaaattatcgttttagattcgtttaagttttgagtttggggtagttttggtttttcggtttttcgtaagagtcgtcggaatcggggttttggtagcggtgtcgaaggcgtgcgttttagtttcggtttcgagagatttttcggcgcggattttcgtttagcgattttgtattattggttcggttttcgtgagggtacgcgcggttgtcgggtttttgcgtttcgtgcgttttagatagtggcgagcgatagtgatttttagtttcggttttttttggtttttttgttcgtttgggcgcgtttttttcgttcgagtttaggtttttttagttaaggagcgaggttttttcgagtttttttgttcgagcgggagataggaggttcgtgtagagtcgtttattttttttcgtagcgtcgggttgttttaaattgtttttggattttatttgtgagtcgcgtggttgggttgggttgggttgcgcgggatttgttagcggttttcgttattttgttcgtaggcgtttatcggttgttttttgggtcgtcgttggtcgtcgttatacgtgggacgtcgagggtagtaaatttgttggtgacgttaaaggttcgggtcggattagttttcggacgagcgtagcggggcgcggattagcggttaggcggggttagacgggcggggtgggatggagaaaaggtggcgcgggtttcgtagtagtcgtttaatggtattggagagggcgggggcggtaggggcgacgttttttttttagtgttttttattttttttcgcggtttcgtttttttttagtggattcggtgtttgcggcggtttcggggttgtttgagtgatagttaaggtcggtcg

SEQ ID NO: 6715 - DNA, 3535 bp, synthetic construct
  misc_feature 1..3535: note = Description of Artificial Sequence: Synthetic polynucleotide
  source 1..3535: mol_type = other DNA
tcgtttttttgggttcgttttttgtttcgaagttaatagtaatttttgatcgttttatatcgtttagaagtttttttatattttttcgttttgggagcgggttggttgttgagttttcggagaagcgtttgtatttgtatggcgttcggggtttttggtaggtagagtagttcgttattttggaaggtcgggatcgtttattttatttcggtttatagttttttttttgcgtagttcgtttttgtagtttttgcggggaagtgtcggggttgttcgaggtttagtttttaggattgtaaggaggtagtttcggcgtgcggcggtgcgtatagtttagagtggttagggcgcgagagtgtaacgtttttttggtttcgagcgcgtcgtcgcgtttcgggagtagattttcgtttagtagttatcgtcgtttcgatttttcgttttagttgtagtttttgtcgggtaatatgttaagagtcgtcgtcgttatagttgtcgtcgttatttggggaagagtagtagtagtagcggcggtcgcgggtatacgggggtaataaatcgagttattcgggcgtttagcgtgtcggggaattttttttgcgtttattgttcggcgggatttacgttatgtgttgagttatgtttttggtcgcgttcgcgggtagcgtatggggtagcgtttgagtggcggtagattttgtttcgatgttttcggtcggtttttatcgtagtcgtcgtcgttttcgtcgtcggtgaggaggaagttcgcgttgtttttcgttatgttttgcgtttggttttatatgtttttgtattcgtgcgtcggtttttgcgtcgtcgcgtcggggttgttgtttttgggttttgggtttcgcgtcgtatacgattcgttagttttggttatagtttcggacgggacgttttttaggttgtcgtttcgggcgtcgttagttattttattggttttaggtaaggagatggtcgagggcgttgcgagttcggaggagtagagtttcgaggtgtcggattttttaagttttatttttagtttttttagtgggtttgggagtaagtagttgtcgtaggttattattatcggcgtgaagaagggcggtacgcgggcgttgttggagtttttgcgcgtgtatttcgacgtgcgcgtcgtgggcgtcgagttttattttttcgatcgtagttacgataagggtttcgtttggtatcggtgagtttttttgttaggggtagggtttttatcgtcgatttagattttgagttaagggagatatggcgtatgatagggaattggtagggttatagtttcggattattcggggtagggtagggaaattacggtagattgcgtagcgtattttgttcgggtgcggtgagggttgcgtttcgtttggttttcgttataatttatagaaagttttcgcggagtattggtgtttttgaatttattaggcgatttcgtcgtaaagaagaagggtagcgattgagatcgtttttagtaaagcgagttattttttaattatgggggtattcgattcgaatcgtattttatgattcgttttaaatttttttttttcggagttcgagacgttgggaatgttttgagtttttttggtcggttttcgtttttaaggaatttttagagtagtttttgttttttagatggggagagggggtgggggtcgcggcgtttcggcgaggtcgtagagtttgttaattttttgttatagttcgtttggttatcggaattttaagggtgttagattcgtttcgttcgcgagtcgtttgggttcgggagggtgagtcgggcgggtggttcggcgttttcgtttggcgggcgggcggcgcgcggagcgtggagttgtgttggtttttgtcgggtaaaggcgcgtattgtaatcggttggagcggcgcgaggttttgaaggcgttcgggttttcgggtatcgtcgttcgttttcgtttttttgttttcggtgttgggatagggaaagtaaggacgcgtgttttcgcggggtttttatacgttcggagtaaagaatattcggggtttattgattgagaaatgagggttgtttcgaggtcgcggttttcggaaattttgttttcgagtcgggttgcgggttaggttttaaagggatagtggtttcggggttataattattatttttgtttattgtttttcgtagttgttggtttttggggtgagttgttgggttgttcgagtttcgggtaaggcgcgagtgggtaggaggtttagatttcggttttcgataattgttttcgattaggggtttaggtaacgatttttatattttcgttggggtttttattcgtaattttagttagtacgatatttagatatttttttaggtttaattagttttatagacgtttaagatttgggaaaataaaagaggagaagataattgaatttttttttttgtgtttattttattgtcgggatttgggtgggttggagaataaaagagggttgatttcgcggattaaaacggttttttttttagtttcgttttatttttttttttttgtttttaatggttttttattattgttaggagttgtttaagtttcgaggtttagttaatcgtgatagttattttttttatcgttttcgggttgtgatttattttcgggatattggtggataagaatggggtttttggagttcgacgtttggatttacgttttggttagtcgcgtgaattttggtgtttttatttgtgtagtgggaataatgtaggttttgggtagggatgggaagagtgaatgcgttggtacggtaaggtgtttcgtaggtacgtgagggtttttttaatcgttagttattgttatcgattgtattgttatgatttttattattattattttttttttttttgggatggtgattttagggttaggcggtaggttataattagcgtttttttaggtggaattcgttagagtttcgaggtagtttaggattttttgagattagatatatttgggtcgggttgggaggaattggtaggaaaaggattgaatttttaatgttaggcggttttgaagtatttggggtaagttatggaaatttttataggaaggtttacgtagttttttaggcggttgttttttatttgttacgttttttttgattgattaaaaaacgttgaatgaagaacgaagtcgcgtggaaattttcgtcgcgcgtttgtagcggatagcgtagttcgggaggttcggttgtcgatttgcgttcgggggttgcgttgcgagcggttacgtatggcggttggattcgggcggtcgtaagggtttggttgggtcgcgggaggcgggaggtttttcgttttttcgagttatttttttgaattgataagtaggattttcgggtttagggggtatagggttcggggcggtgattcggcggatcgggttgtcggaggagtttattgtaaatgtcgtaattggttttaaatattgcgtttttggattgtattagtagtttttggcgcggtcg

SEQ ID NO: 6716 - DNA, 2896 bp, synthetic construct
  misc_feature 1..2896: note = Description of Artificial Sequence: Synthetic polynucleotide
  source 1..2896: mol_type = other DNA
gcgtgggcggtgagcggtcgggagaggggcgggttagttgagcgtttaattatagtttcggggttcggcgttcgttagttgtatttagaattttttttatcgtggttttgttttgtggcgtttaattacgtgtttttagggttttggagcggttgttgggattgtagcgaagaggggttcgcgttattttcgttaggttttacgcgtcggttttgagtgcgtttttttcggtcgtcgggaaatttagaggcgcggtttggttttaaggttttcggtttcgtttttttttgtttcggtttagttttcggttgttttcgggtcgcgatttattttttttggcggtttttgtcgtatgtttttgtgttgcgttagaattatcgagttttagttttcgttgttttttcggttagtaggcgttttttttagttggggagggttttttaaattttgtgtttttaggatcgcggggtcggtaagcggtaggatttttaagttgcgtttttgatgcggttaggggaggcgcgcgatgaaggtttttttttttttcgttttttttttacgttttatcgttattatacgtcgcgttgcgtcgcgatttcggcgttgtttgttggcgttttaagcggtttttttgtcgcggtgcgattttcgacgttaggaggattaatttttattcgttaggttttagattttacgtagatttagttatatacgtaatcgtttgtagatatttattatagttttttaagttaatttaaagtttcgtataggcgtattgtttttatatgcgtagttttacggttttatatatttattagtttattcgtaaataggtttatatggttatataattgttttttggatatttagttttacgtaggtataattttatatatatataatcgtatataggcgtaattttatttacgtagtattttacggagttatataatttttttataaataatcgtatagatatagttttacgtagcgttatattatttagttaaattgagatttagaaatatatttattagtttgtatttagatttttttttttaagtttcgtgatatttattcgtaggatagattagaaatatatagttatattgatatatatacggatttaaacgtatagttaagattttattcgtaggttcgtaagttattggaaaaatattaaagcgttttttttttttttttttttatttttgatatatatacgtttgcgcgcgcgcgtatttttatatttatatttttcgtttttaagcgcgtcggagtttcgtagcgggtgatttcgaggtttcgcggtgagagttaagggagcgttttttcggcgtttttttttttcgtttttttttcgagtttatttttcgttttttcgttcgttttttttttttttgtttttttttttttttttttttttttgagtttggggcgcgggttgcgcgtagttaagtttttttatcgcgcgttttttttcgcgcgcgtttcgcgttagtatcgcgtttatcgagtggatgcggttacggggtcgtttttaattattttttgattttcggcggtttgtgaataatggttattgagggcgttcgtaggggttgttaagaaggaaacgcggggcgcgagaggcgcggcgcgcgcgggagcgcgagggaaaggagcgagtttggggtcgttgtaagcggttggcgagagaaaggattcgtgcgagcgtttatatttgttttttttaaggattttatttggttatcgcgttttggaagaggcgagagggagagcgtgcgcgagaggagagagacggcgggggaaagggagacggcgagacgcgtagcgtcggcgttcgggagatttaggaggagttcgtaggtattgttggcggcggagttttgtgttttcggcgggttgttgtgggcgttagggtttttcgagttttcggttcgtcgtcgcgcgtagatttgttcggagttcggggttgtaggttggggtcgtcgttcgtcgcggatatttttttcgcggcgttaggattttggttggagttgcggatttgtatgtttgggggttttttacgttggttgagggaatcggttttagaagaaggaattttttttttttttttttttttttttttttttggtcgtttttggttatagtttggttgtgttggggatttttttttttttttttttttataaagtattggtgagcggttttgacgaatgtggtattggcggaaggtatggggttgagatggcggggttggtggttacggatggggaggcgagagatgttagagaaggaaggagttttgtttaagttcgtaatttgcgtttcgaagttggtcggatcggggagggcgattcgcgcgttcgattttgtttcgggtaatcgatgggaaatttttcgagagcgcggtttttttggggattcggcgtttttgacgtttttaggcgttttttcgggtcgttgcggttttttttcgtcgttcgttagcgtttaaggtcgcgttttttttattttcgtttttttttttttttcggcggttttcggatttggatagagttgtaggagtggttttaaatattttttttggagatttttttttatttttcgtacgagagtttgtttagtggtttttttgttttgcgttttagttttacgcgcggtcgagtggttaggttgataatgaaatttcgtatttttgtcggggggagtggggtggggaggaggttttttttggggttgttgattttgggtttcgggtagggggagggggtttttgggggaggggtttgttttggttagagacgtcgatttgggatggcgtcggggtagggagggggttggggggtgggcgcggcgaaggcggtaggtttgggttcgcggtcgggggtcg

SEQ ID NO: 6717 - DNA, 2567 bp, synthetic construct
  misc_feature 1..2567: note = Description of Artificial Sequence: Synthetic polynucleotide
  source 1..2567: mol_type = other DNA
ygtttttaaygygggagygtagtgtattttagtggataaattygagaatygtaygttgtttttygtttttatttttgtttttttygttygyggttttaattygggatttaaatgtaygagttyggtgaatgtttyggtaggagggygagggtttagaggtagtttgtttagtaaaaaygatagttgtgttttggtgggttttgggttattttaggtagaagttagagaagttygagaatttyggygggttggtaaagtttgtygagaagggtttttttggatatttttattaygggttttaggttygaatttttttttttatttggttttggagttttagatatagataagtttygggygygtyggygggygtatgtgygtgtgtgtttatagyggggtggtygtyggagttttttaagaattttagttttttygttttagttgttygttagttgtgagygttygtygggttyggaggttattygtaaatagttgggtyggtagttgggagtttgggaggtttttgtttagtttyggggtttygagaaaggagaagggggagyggagtggttgtttggttgtggttttttttaatttygtttgygaagttttygttgggagttyggagttttagtttttttyggtagtttyggttttygygttygtygygtttagyggtyggygtttygtttygggtttyggggaggaggygygtyggggtagtyggttaggatattgygttgttggtttttagagttgygggygygtttggtyggttttatttttygggttgttggggygggygtygttgtttygatttyggaygygyggaattttggagattyggtygtttttygttagggtygyggtgttgttttaggtttygggygggygttttttttyggttatyggtgtatttygttgttygtttgygggaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttgygaaaggttygagagaggtygtaggttaggattggatygtygggygtygtyggatggtgttgttagggtaatyggatggtaygygaagtygttygaggtttygattyggttaygggggygtttagtggattyggagagttattttggggagggggyggtttygaagaaggattgggtgggggygtatggagygggggttgygygaaaagttttttggggyggagttgagttaygygggtygygtaggagygtttgttygagggtygtttaygagggatttttttgttyggttgygygggtttttgygttgatgaagttatygygtttygggtyggagtttyggygtttttgtttygaatttagygaagttyggttttatgtttttaattatttaayggttttttatygtttagygt

SEQ ID NO: 6718 - DNA, 573 bp, synthetic construct
  misc_feature 1..573: note = Description of Artificial Sequence: Synthetic polynucleotide
  source 1..573: mol_type = other DNA
ygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgyggaagygggggttgttgyggtttttgttgtygttttttttgttgtyggtyggygygtttygggaatyggygtttaggtagttagggtttggagagygygagygttttyggaggygygtggttagggaggatttygattttttgggygt

SEQ ID NO: 6719 - DNA, 383 bp, synthetic construct
  misc_feature 1..383: note = Description of Artificial Sequence: Synthetic polynucleotide
  source 1..383: mol_type = other DNA
ygttygtyggtttttataggggygaaattaggtatttatygtgayggygagygtgatagygttyggttygattttgtttagatgtttatagaagatggagttgaygaggttgattataaagattattaattgygtaagaaattgyggaggygyggaaagtaaggygygtttatagtygtttttttttttggaagttygygtttatttttgygyggyggtygtttyggaggygtygggttgggygtgaggaygtygtatttattattgggttygygagygtygttagtttagtygttttttttygtaggttygggggtagygtatttygtaggttttataagtygttaygttattygagggttyggagtygttatgggggtygg

SEQ ID NO: 6720 - DNA, 853 bp, synthetic construct
  misc_feature 1..853: note = Description of Artificial Sequence: Synthetic polynucleotide
  source 1..853: mol_type = other DNA
yggygyggggtgaggttygggggtygttttattgttgaggttyggtyggttggggtygtygttaggygygttggttgggtagtttttgggagatgaagygaygtaggygttttaggtattggttgtagagttygatgtygttgtgttyggygttttttatttatagyggttttatygttttggggtagygttygtagagygttagttygtgygagaagtygattatttygtttttygtgtygtggatgatgagtaygggygaygtgatttaggatattttttygatgttgygggaggggygtggagygggtgagatttagygttyggttygggtttygtttygttttygttttygtttygttttygttttygtttgggtygtttatttagggaaggygtygaagtagtaggtygttttggtgttagggaaggygaygygtatgttygaggtgagyggygagtgtagtattatygyggtatattygtagygygaggttaggtttayggtgggtatygtgtygatgttttgtyggtataggatgatgttgttygggttgatgtygtatttggtagygtyggagtagggttagtygyggttttygaygygygtatattttttttattagygggygttttygggtttagtttyggatgygattttttagtttttttatttagttaagttagtgggttaggtttaggttttatattagtttygagggttatttttagtttttaatatygyggyggtgggygaagttagyggtttygtttygttttttgygttgtygtttattggygttttttagttaggatttgtagggatttygtttayggagtgtttttggggygg

SEQ ID NO: 6721 - DNA, 1062 bp, synthetic construct
  misc_feature 1..1062: note = Description of Artificial Sequence: Synthetic polynucleotide
  source 1..1062: mol_type = other DNA
ygaggaaggaaggtgggygtagaagttattttaggygtgaygygtgaygttyggggtaygggygtyggggggyggaaagygagggttyggttgggttagggatattyggggggggtygaggttttgggtttyggyggagggaggggattgggagggaggttatygtttygggttaygygggtgattyggygggggagttgggggaggggyggyggggttgggttggggttttygggtygggattggggtygggttagtttattttttygttttggtygaagygtagttygagygtygygaygygttttaygygtaggaagtygtyggggtygyggtygtatatttygaatatttygygtaggyggygtayggagygtagtagagtygygggggygttygattagttygygtygttygttattygggtyggttygtagtttagttyggatttttygttygtygygttygtygtttgttygtygtygttatygtygygygtttttyggggtygttygtttgggtttgygtygygtagttttygttyggtggyggtygyggtygattygtgttagtagyggygtygtagttttagtygttttggaggggaagggaggggaggggagggaaggagaagagtggggaggggaaggaggaggggtaatagggggyggggaggggaggggygggggtygyggygaaaatgggagggagagggggaggyggygggggyggyggyggyggggaygttgtagataaaaggagttygygttttttygagtggggyggtttaygyggggtyggtaggygtagygagttgttaayggtygygtttttygygattttagttttttttygygtttttagttttttttygygttttygagtttatttttttttttggatattyggagttatttaaaggttttgttttgtyggaggatttygyggggtygygttttttttygttattygtgttygttgtygygtttggygtttttygagygtttaggatgttttgggggttttttgtattggygygtttygtgattgtatttatttygg

SEQ ID NO: 6722 - DNA, 918 bp, synthetic construct
  misc_feature 1..918: note = Description of Artificial Sequence: Synthetic polynucleotide
  source 1..918: mol_type = other DNA
ygygaagttttygyggyggagagygttgygyggggagataaagggaagggatagggatygtagggatagggataggagyggttgtygggttttgggttttygatygttattagatatgttttygagtagtygaggtaaagggaayggatgggaaaggaaaatagaggagyggtttagaagggyggttygttgyggtggtggggygyggattygggaattyggggygggtagggtaygggygtattttttttttttttttttttygttygaggtyggtagygtttttygtttygygttatgtatatttattgtggtgatgagagttygygtttygtgttygttayggttattgtgygtttaataaaaataaatattgtygaggagtygtygygatgyggggyggaygygyggttyggaaaggggagggggttttaggaagagttatattygygagtygggtttgggttaggggygaggggagagygttaagattgtttygtygtygagggygtygatggaggtataggggttttygtggggygtttygagagatatygtgtttggtyggygggaygtgggttggttttttattygayggagagaagyggtatttttattttygggtatygggtttgggtttygagygggggtttttggaatataaggtagtgggggtagaygggtttgggtttattttaggttgggaaggggtttgagyggggygttttgattggattyggttttggyggatygaaggttttaaaagattttgtatttttaaagatttttgtagatygttatygtttaaggygttttaggttyggttttatttatgggaagggtaggaaagaaagttgggagygttttggggygyggggtagagatagyggtgttggaggygygttgtggaggyggygg

SEQ ID NO: 6723 - DNA, 865 bp, synthetic construct
  misc_feature 1..865: note = Description of Artificial Sequence: Synthetic polynucleotide
  source 1..865: mol_type = other DNA
ygagttgtgtyggttttygygttttttttattttttttttttttyggattttygttttttygyggagaggttttgtygttttaagagtygggttagygattgataagtaataaaygttgagygttyggttgygttggagtygttyggagttaggggtttttyggggygtaggtaggygtttttyggttttygggttagtttttattttaagattttygtttttttttygttttgatayggtatttaggattttatttattgggtttaaattttataggttttttttatttaggttygttttttttttgtttattygttttygtttttgggttttttttttggggtgttggttgggagaattaagtttygttgtttattgatattggttttygtttttgyggtaggggttttaaagtggttttaggtattaaggtggtgagttgtgaggggtttyggtatttgygyggttttttygggggttgtgygggttgggggtatttagaagttyggtattaygtaagaatygtgttgttagygttttygggggttggggagygagatagaggttgygttgggtttyggtggttttttggtttttttaggtagttaatattataattttttttgggagggggttygtagaagggygygygttgtttttttygttttttaagttgtagyggggygggtygggagttagggttagggtttggagatttgggaggggatyggtgttagaagygaagagttagggttagaaagttaggttaattaaggggggggyggtgyggataaagayggggtgggggttggtyggggtagttatttagtgattttatttttggttttyggygggygygtaygt

SEQ ID NO: 6724 - DNA, 408 bp, synthetic construct
  misc_feature 1..408: note = Description of Artificial Sequence: Synthetic polynucleotide
  source 1..408: mol_type = other DNA
ygaagyggggagaattyggttgggttgayggagaygttatatygygttaggggagtaggagttttttyggagygggaggyggggygtygtgtggttgygagygygttttttggatgtttyggtyggygygggggtgggtgggygttttygttttatttttggtttygggyggttagtygyggtgtgttyggagggttttgygagggttgtgggtggygggygagttttagyggygtagtagaggaggggttttygagygagygtattagggagaagggggttygtgtaaattttaggttgaygatygygtaygygtttttygggttattagttttgtygtttttggtggggtatatygaggagatygtygtggggaatyggggatyggattgtttgatagtygagygt

SEQ ID NO: 6725 - DNA, 2245 bp, synthetic construct
  misc_feature 1..2245: note = Description of Artificial Sequence: Synthetic polynucleotide
  source 1..2245: mol_type = other DNA
yggattttgyggagtttygagtttygggtgaggygatgtttagattggygygaagyggggtgtttyggtagtagygtagaggtttattygttttttyggtyggttgtagygggygygtttatattttgtaaaattaaaaygttttggaaagygtttggggttgtaagtgaygtttgataygagyggygggtyggattgtyggtttttyggtttttttttggtttatataattygygggtygtttttatygtttaygaattttagygggtagaygttggaygtgyggtttggttatttttttaaattttagygttygattygygtygtagggtyggtygygtagygyggggatygygggtgtttaggttyggagaaygagygtygygtttttagtygyggtyggggaataggaattgtygttagaggtatygttttttttttygagattgygatattgattaagggttygtaggygygggyggtatttattttttyggattygtagttygtygyggaggggaaggggtaggaygygtttttaagattagggygggggygtgyggagtyggggagttgtttgggggygttggggygaggtgggaatttygttttagagtttttagtttyggggtygaggtttgtaggaagggygtgggaggtggaatttttttttttttaggygtttgttygagagtttagagygatttttggygyggagtyggttattygggtgggyggattttttttttygttaatatttyggyggtttygttaygatttttttttttatttgagtttttttttgtttatttaattttggttttaaaggtttagagagttaggttgtttyggagtttagtttttttygatttaagtayggtttttttagygttttygtttttattatatttatagtttagtttygtttygygttygttaggggtygggggygttagygttygagggatggtyggygggttgttattttgaygagayggagttgygggtgtttttttattttygggttygttyggttatygttttgaatgttygggttttayggatattttagagggatyggygggyggttgygggttygggyggtayggggtgggyggtygggtttttyggtygttgtttggtgaggagatgttyggttyggygtttttyggtttygyggttyggttyggttyggttyggttttygttygttttttttyggggaagtttggtygtygtttttygaygtagttyggttygyggtygttttttgtyggtttygttttygttattttttttayggttygygtygtttttygtttyggtttttygttttttygtttagttygtttttttttttttttttttttttttttttttttygttttttttyggtttttttttygygtttygtttttyggtttttttttagttttttttygtttttttygttttttttttttttttyggttygttttttgtgtttygtygttaggattttttttttttgygttyggggtttgyggtagttttyggggygygttggtagtagtggyggtygtygtagttyggggagaagtygggaatgggggaagggggtygyggtaaaggattagtttttygttyggtygaggtyggggtttgggaagttttagggatttggggtgatttgggttagggtgtttaggtgaatttatgagggygaggttattgggggttagggaatagggyggtttttattgagyggagtygtygyggaatttagtgaggttgygatttgygtttgggtagttttygttttgyggttggttaggaggagtttttygtygtttttattttagtygygtygggygttgggttygatttttagtatttttggtattgatgtgtttggtgygygttgagaygygaaygttttgtaagatgagtttttatttattygtttttttttttttttatttgtttattttataaattgagtgtttggttattttggtttaggtaagaggttggatttgggaattttttggatttgggagttttaggatgaaagggagayggyggtgttttgtaggataagygggtattgaaygttgtttaggggaaagtygggygygtattgygttgtagygyggygaaygttgttaggagttygygggtagggygtggggaggatatagygttttttttyggtyggtygagttttttgggtagyggtgggttttttygttagatttyggggtygt

SEQ ID NO: 6726 - DNA, 2972 bp, synthetic construct
  misc_feature 1..2972: note = Description of Artificial Sequence: Synthetic polynucleotide
  source 1..2972: mol_type = other DNA
ygattattttygtttttttaygyggttttttagggaagaagygaggygtttgagttagattgggttggaatagtgyggtaggggttygtttttygyggagttgtttttttatttattatttatttagtttagttyggtygtttaygtaygtttatttgttgttttygttttatttttattaggygtattagttagttyggyggttttggttatagaygtttgaatgataaagtgtttttattatyggygyggttygttagtygattygtygggaygygttttggttttagtttttttttttttatygyggtttaggaagaaattyggatygygtatagttattttagatygagtagtygygygtygaggyggaggygggagtygtaggggttgtagayggtaggtttttgtyggggtatatttttttaagygtttaggttttttaygtttagtttttttttttttttgggttttygygyggggattttygtttttgtttagattyggagtttaagtygttgtttttttgggattyggtttttttttttygtttttttggtttaygttygtttattygygtttgagtagygtttttaattagyggygttagttagtagaygtgttygyggtygtttttaaattttyggaygtagttataggttttgatagttttagggaattggggttgagttttygggttggggttygtattyggatagaatttttgtttattttattygtaggttttatygtygayggattttggggatagtgttaatttttttygttttgttgggaaaygtagtygtgatttygagttgggatagyggttgttttttgaaaaggtgggggagtatygagttgggaattaggtyggggagtttagttaygattttggtttaatttgttgtgagattttggttaagtygtttaaatttttagagttttagttttygtatttgtaaagtyggaatttggggygtagtgttttgatgaaagatgttggyggggagagtgaagaygtttttttygttgttagattttttagggtattyggtttatggttataaagtaggttatatttgataatttygtyggattattyggaggattygtygatttttgtygagtyggtggttygggatatygygttatagaattygaggygttygggygttttygtttygttaggtgtttagyggtttgtatygagagttaggagaggtttagatyggatttygatttttygaggygygggagtttayggagygyggtgggygyggygttygggtygygtagttaggtggggagyggygygtagttttagattygtaggtaggtagyggyggattgtatttgtttygtttygtagygttttttgtttgtygtttttygtttgygtagttagagttgygygyggttaggaagggttttygtttagtgygtttyggygttttgtatttygagaygtagttatygttagttygggtaggggtatattygtttygtttttygygattygttgygttgttttaagtygtgagaataygygygtyggaggagttygtyggtygtgggggaatttygggagygggttygtttyggygaagtgggtattttttttttagttttagattygtagttttaatttygggattgggagaggtygygagtaggagygyggggataggygttggaaatgtttaagtttttgtttttttttttygttttattgttttttagygggtaggygggatttygattattttagggttygygtttygttttgttttttttttttttgtttttatttttttgtygttttygtygtygttttttttttgttttttttaatttattttttaatttttttttygttttttaattttttttttygaygttttttttttttattgtttggtyggtttttattgtttttgtygggttttttttgtttttagttttttygattttttttattgttttatttygtygtttygggtttttygttttagtttagttygttttttttatttttagttttygtttagttttttttttttttttygttttggttttgttttaygattttttagagatygagatgttgaggggaaagttttttygggatttyggtattygagtgttttttttygaagaatttgggtatyggagagttttatgtttttttttgaaagattttttttagtttttttatygttttttgyggtatttgaggatyggtattygtgtttyggttttgtttttatttttattttggagagtygtttttgygtttygggaattttagattttttttygtggtttyggtattagaggtttttttttattatttatttttagtatttgggattttaatgttttgttttgtttttttggtggyggygttyggtttttttyggagttttgatttygggaaagggagygggtttttttyggttaatatttatttttagaagtagtaatagtagtaggygyggttygtttatggygyggtyggtggtatttgtttttatygttygtttttygyggtagygttygatttttagttyggttygttttgyggattgatggggttgygttgygttgygttttagygttttttttgttygtyggagttggtygyggttyggttygttttggttgygggygggagaggttgggtgaagttagtgttgyggtttygttttygtttygtttagttygtttattttyggaatygygttygttygttttgtygtttyggggtgggaagtagaggtaaagggagggygtgyggtttttygtatttygttgygtttttttttgttttgttttttagagttttttatttatttygttttggtatttagttttyggttygygttattgygygttygtttyggatgttgtgggttyggggattagggygtttttattgyggtttttgttttttttyggttgyggttygt

SEQ ID NO: 6727 - DNA, 1026 bp, synthetic construct
  misc_feature 1..1026: note = Description of Artificial Sequence: Synthetic polynucleotide
  source 1..1026: mol_type = other DNA
ygatygttygggttygagtagygggggygtttttagyggyggtaggygygggtgygggggagaggagtagaaaagagagtagtttgaggggtygagggagtygygttygaggtyggygyggtggggatygygggtttattattagttaagtttagttatttaattatttgtagagttgttgtaggtataggtttaggttttygttttttattttttygygggtgatgygttttgatagyggtygygggagygggggtaaaggyggtagttggggyggyggyggyggtayggtygagtgtttyggggttgtygtygtygtygtygygtttttttttttttttttatttttaatygtygtttttttttygggtttygggttttgtttttggttttttttttttgtygyggttatygtggtygtttttttttygggtttttttatygaagtttyggtygttttagtttttattagtttaggttygggttygggttyggattygggttygggttygggttygggttygggtttyggtttyggttygtygtygtygtayggttygygaaattygtttaggaatagttttaggaagygtyggtaagttttttttttagggatgtagtyggttatygttgtttatgttttagggtagatygggaaaggggttgggggaagtttaggaagggtaaggggttgtttttgagtttagggtttyggtaagggyggttaayggtygtatyggtaygagygattagtattaggttgtttggagagggttttygtaggygtgygygtygtygagtatygaygtgygyggttygggggyggagygygtygtttttttyggatttggagggaaagttggtggygggygygygtagggtttagyggyggtttattttttatttttayggagagtttagtttaygttgtttagagattgtygttatggtaatyggttttaattaagtattgtagggtttttttygtygagttygyggagtttaaaggatattttattygttygt

SEQ ID NO: 6728 - DNA, 10207 bp, synthetic construct
  misc_feature 1..10207: note = Description of Artificial Sequence: Synthetic polynucleotide
  source 1..10207: mol_type = other DNA
ygttggtttygtygttagttttttgggttttttttttygttggygttgtygyggggttataggttttatttgagatgttagtatgtgttgggagaggtggaaygggaagggygyggyggtgtttgttgygttggtygygggatttagttygtttgygtttagtttygyggyggttttaggttygttattttygtygttgtygtygtttgttatygaggttagtaggtgatttatgtttatggyggagaaggygttagggtttatggtgaattgtttagggtgtaggaagagyggttggtyggtttttagyggtttaaagaattgttgttygtgtaagtggttggaaaaggttaggtygggtaggtgttyggygtttaggggggaygtattgtttgtttgtattattagyggygttaggttttgttttttgttttyggtygtttttttgygtttttygtttttttttygagtttyggygygttttttttttaggttttttaggtygaaygggtygttttygtygttttyggtyggttttttgtttttttygggattaygtygttttygggygygttygggttyggttaagygagtggggttggygttgtttggagtygggttgyggtttagyggygttttygtaygtttttygtttaatygtttaggtttygggtygttgttygyggygtaygatttttttttagttgyggggagagggygygyggattataggggtttgggyggaggtygaygagtaggattagggatattygggaagggttgttttyggggaggttgagtyggaggagttgttggagtygggtaaagggtagttgtaggttatttaatttaagattttagatttatagtggaaggaatttagttttggagaggaaattttatagttatagaattatayggygtttaaggggttaggttyggagttyggtyggattttttggttatyggggatygttttygtaggggagtttygggayggaaattttattttagatattygtygaygttttttttttggttttttaggttagygggtggtttagtaaaagattagtttagygatttgaggatttttygtygttatttttttgtttttttttyggttygatttttatttygggttyggtgtaggygtagyggattgggygttgygttyggggaggtgggtggttttygygyggggggagggtygtaygaygaggygtttgatttygygttatygygttygggtttgtagtgtttttygtataagygtagagayggtagygttagttgttttttggggatgagyggatgaattaggttagyggggagtttatttttttattttttttgttygttgttttygygggtattygttatagggttgttgttttyggttttttattttttttttygtyggtygttttyggtgtttyggaagtttttggtaaaygggttgttgtygatttttagttgtgtgatttgyggggattaagggggyggygttaagttaggtygtggtttttttagygtggtyggtggtatttygaggttagygggtgttggtygtagagggaagattyggggagygtttatttggtatttattygtttgggatgggaygtttygagttgaggtyggtgggagggtttygyggaaagygayggggtttgttttttaaaagttttattygaggaattatttttagataggtttagatagttttatataggtttaaagtagtgttatagtgtyggaattagtttaagtatgtatattygttygygggtttgygtaagttaaaygatttygtattygagtaggygygaatagagattgtagtttataygtaaggttgtaggtatatataaagttaaattatatttaygggttygtatataygtaagtgtgtatagatataataaaygtttayggaattaaaygaatttatatgtttttataggtatttaatatattttaaayggggtaygtatagtttagygtatattttggtttataaagttataaygatyggtayggatattygtatttttttttttattygatagtggygtataagggtataggtttagaggggtgatgttttgttttattagaataagggtggagaagtygtaagtagaaaaagttttttgattggaaggtaattttttaagygttttttaaggggtttggggtttagattgatttagagtagtagttaggagtgttttggggggttgtgttatttgttttattttttggtttttttygagagagtgaaaattgggtttygggttttgagtatyggtagagtttgggtagattgtttygggygttttttttttatttatatttttatttttgagttaagaaataaaygaataaaatgtaaaaatgttagygygggttyggagttttagttaattgttaagtaaatatttttattagaaygayggtttagttgttygttygttttaggggagtttgtgtgtgygygyggtgggattgagagggygttttgaggattttygtgagtgttgygygtatggatgygaggttyggtgttygggggygggtygtaagagygyggatttygtgtagggggtttygaggggygatgaayggayggttgggtttgtaygtgttgaggggygttagtgtaggggtttagtttatygttygtygygygtattttgttattttggtaggtagtgayggygatgaagtyggttttygggaataygtaggtgyggaaggtgttgtaaggtagttttaggatgtygttggttygtattatgtggaagygyggttggtatttgtgtatggagtttaggatggtttgyggggagggtgggggttagtyggtagttattagtttyggttygagtttttttattttttgggtatttgatttttttttttttattttttttttttttttttttttttttttttttttttttttttttatyggtttttttttttttttatttttttttgtttttgttttttttttatttttattttttttttttttattttttttttygtttttttttttttatagttttttttttttttgttattaaaaaaaattttttagttggaaatagaaatgagatagagtaaaaataaaataaaataaaaaataaaataaaaaaattaattaaaaaataatttttttttataaaagaaatttaaataaaataaaataaaatagagttttataattttatttttaatattttttttttttttggtattggtaaattttttaattttataaagaggagattttaattttygggggtttattaattgttttattttagaatgggtagttttttttattttatgaaatattattttygttygttggggttttgtttaggtataaatggagagaatttttaaattttttttttttagttgggtatttgtttgtgggaggagggaaaggttttagggaggttgggggggtgggtggggagggtggtttaatttttaaattttttagttttgggggagggttagggaygygggttttggtagaagggtgatggataagttgaggttatgggtaggttttttaagttyggtatttataggttaagagtagggtgattttygtggtttagtattgtagatttagttttggtagtatttgtttttttattgayggtataagggattttttayggtttgaggaattgagattgtgagttgttagttattgattttattattttttaggtttgtaaaggagagygttggggtttaggtttaggtttagtttaygtagattatagggtagtgattygggtaggggtattttgggggtttgtttagygtttttttttgggagattttgtygttttgtttttttgtttagttgtagtgttgggttaataagtttttgtatygtttttattttgttttaatatttaygaagtygtgtttgttagagatgttgttggttagttttagtttgtggaaggttataggtttagttatttattgttttttygtggttgggttgtttgggtggatgtatatgygtttgggtattttagggtyggttttgttygttattatttagygygagttgtggaatttatagyggtaatygttagyggttataatgtttattagtaggatatatttggtttttttgtttaggtygttgattygtattttgaagggggggaatattygtttgggagggagggaagggaggagattttattggaatyggttgttttaggttttaggattttattttttttttatttattttttttygttgygtatatygttgtygtttggttgttttttttgtggtyggttgttttgtttttttattattgttyggaygattttatttgtggttgttgtttttaggagattttatttttgtttgttagatttttttttaaatagttttttttaggttttgtgtttagatttggggattttttttttttttgatttgagatgaaagttgatgtttaggagagaagtttaggttttttagaaatattttygtttttttttaattttttygaaattygtttaggggaaatatttatttgggayggaagtttttagaaataaatttggagggtgtttgtattgggaattgggttatagagtttgataagatattttggtygtgtagttygggggaagagggtgaattygaggtttggattttyggtggttgagtygaagggtggaggggtyggggttgtggttttttttaggttttaaggtttggggyggyggatgygtttagggttyggatgttygyggtggagaaagggtttttagttyggtgaggyggagggttyggttgattyggggttygttgttaggaatygagtaattagygtggggttagttgggtttaggttttattaggggtttyggggtyggagtagagtttgagagaggttgaatttttttygagttyggagayggattyggaygtagaagagygagagygyggggyggaggagatygttagggttaagtygyggggttttttttgygttgggatttagaayggttggggttattttttagtagtatgttttygttttattttattyggaggattttagygtttttgttttaaaaaaaaatygtttyggtgttaaaygagaaaagttaatttggttgttygtgggagygaagygtggygttagggttagaatttggagtygggagtygggagtygggagtttttagttttgttttgattygtgtagtttygtgttttagttygttygttygttygygygttttttagtyggtyggtagttttatttttyggatttggtgatgattattttygtgtttagtttgtggaattggttttatagttttttggtttttagygttattttggggtygttttttatttygttttygggttttaggtttttgagggagygtagatgygyggygggygggtgygggtttagtgtygagaygtgtagtttygtttyggtygttgttgtygtygtygtygtygyggtygtygttttygttaggttygggtygggtagyggtttggttagygygtygggyggtagygygagtgtygggaagaaggagggttgygtygtygttagaaaggyggatatggggaagtyggygggtygtggygygtggaaygggtggtaagttatggygttggtygttagygtyggtttttttatygggatattyggtttaggygttygggggtyggggtyggggtygggggygygyggttyggattttyggttygggyggyggygygygyggtggayggaygattygggtggygggygtagtagttgtttttyggggtttttygttyggygtatygtaaggggtattyggttttgtgygygggggyggygggggttttgygyggggtygggttgggtygggttgagttggttygtttyggygtyggggattaygygygattggttagattttgtygtgatttttggaaaattgtgattattttatatgttttgtttagttyggattttttgygttaaygagttaggttttttttgattgttgattttaygttttttggattaattgtgggttttygggggyggggttttgatagtttaggttaagtttyggtygggagggggggtttgggagaaggtgtyggaagttttagtagtaagaaaatatgttaatagaataaaatattaattaatgaygggtygtygggtttygagatttttttttttgtttyggtttttatygttygttygygtttgyggttgtttgygtyggattggagagygyggagggtygatttgattygtygaaagggtttgaggygaggggagttygggtttyggggttttggggaaggattygtagtygtaygtyggttttaagtgtaaagtattgataygatttygagyggagagggggygttttttttttttygygtttagaggttyggtygttttggttygagttttagtttggttttygatttagtttygggtygtggygtygtttgggggtttttgygtttyggaaagagatagtaggtattggaaagygaggtyggtgggygggygagtygggaggttygggyggtygaggttygggagyggattttaggtggygggagttggtgagtggagttatggtygagttttgttggggtyggygygggygggagygggaygyggttttgygttggggaaaygyggggattttttattygygttygtttttatyggaagattyggaaggaatttggagtttttygtaggttygggtttygttttgagttttttagyggtygggaggagyggattttyggggttaggaaggtgagygtatttttygttgagtatagggyggtatygygygggyggatttyggattttttattygygatttaaygaattttygttttattyggtatyggagaygaaagtttttttttttygaaatatyggtttttttttttygttttgttaattatttttttagtttttttttatttttyggaagygtaygttttttaagttaaggagtgttgagtaaygygtgagggagttggggtgtttgygagtatttgtgattgaagtttttttttttgtgattagttttygttttttgtttttyggtagttttagttttttttttatgaagtgatggtgtgtgtgtgtgtgtgtgtgtgtgtgtgtgtgtgtgtgtgtgtgtygggtttygtgtggtgttttttgtgygtagygagagttataatttaaggtgtgtayggggagagtgaagygattaygtatttgtttttaatygggttygggygygaatatttaggttgatttttgaaggtygttttttgaaggaaaagatagagtatgtattagttaygggtgatatttttattygtataatygygtggtgggygygtatatttaatattgatttatgtaggygttygtttattgygtatatyggtygtagggtatttygttgttgaaygttgggagtagygtttgaaggtyggattttttttggtagtgyggattygggatyggyggaagtagtatggtttttgygatygttatttttatttttyggggtygattttagggtttttataattttttattatygtatatgtgagygtygtttttatagggttttttttaygatttygtttttggttaggtygtattttttttagtattttttttttggttagaaygaatttttgatttygagttgygtagtttaygtagayggggtaggatttattgtagttttttataggtaaatatttgttggttttattttaggygagatgtggtttttyggggagggattygttgtggataygtttgygtagtyggtgaggtgattagataataattagggtagttttttttagtygggaatttaggtatyggtttaggaattygtgaatatattygtaaagtygygygygygygygygygygtgtgtgtgtgtgtgtgtgtgtgtgtgtgtgtagatatatatttttgtttttgtaagagtatgtgtatatttaaatgtgtgygttttagatattagtttattttattagtttatttatagttggtttaggggttygaggtttgaagagtttgaaatatttaggtttgggttatttgatygagaaatttggyggygatagtgtagyggttgtatttggggayggygattttatttatagtggtatygattttttttttggtttttyggggttttgttygggttaggattttattattygtttygtttygyggtttygygattattttgaggttttgttgtagtygttttgaagagtttgtagygatttttagttaaattttttagttaggaatgttygaggtttatygaaagttggygttggggaggtttgggaggttttggagyggygtygtgaggttttygttgggttttttttttatttaggtyggttttttttttttttttaggaatttttttttttggyggagtttygggggtygagtgtgygtgtttttttaagaggtttyggggggygtttygygggtygttyggggttggagggggagggygygggygggggyggttggygttaggyggtygaggttttataataaagtttyggtttttgttatttygtatyggttaggtttygtagataggygggggaygygygttyggtygtttttttttttygtaggyggttttyggttagggygtygggygggtttgggttggtggygygyggtttgtgygtttygygtttttygtaatagtgaaatggggygggagyggggayggtttgggtygggtggggtygyggttttgagtttggygtggttgttttttygtttttyggtttygttatttttygtagggttaaggggtattgttgggatttttttygggttgagtttttaggtggtagggggttttygtygtttttttttttgtgtgtagggtyggggttgygtgatttygygggtagtgggtagtaggaagttygggttgtgyggtygygtggtagagyggaygayggatttgygttygagtgayggggygygggttgtagattggtttaagttttyggtggtagaygaatgtgtttaggttaagtttaggggaygtgtgtggtttygtgttatgggttygttgtgagggtgtygttaggtygtygattattgtttggaygtgaggagtgtggtggtgaaggatattttttggatagagtygttttttattayggttttttygtyggatygtatttttyggagttttggygttagttagttyggtttagyggtyggatygggttttttygyggttttaggtttggttggggtgggggtygyggtttyggtgattttagttygtagyggttyggttygtttygtttatttaaataaattgtygttgataggygygtagtttttttggagtygtygttttttygtygtttttttttygttttaattatttygygtagggtggggttaattggttgggatggggygggggaygyggggagagygggyggttygatttttttttggtygyggggtggttyggggaagygttttygtagttayggtttgtgtggtttygtttttggttttttygggggatgygagggtaaggtttagtttggtagttgtgggttttggaagggygtygttttgtatttaagggygagattaygyggtygagaattaaggtygtatttyggatggatttygggtgattttttyggagttttggggaattttttaattyggggagttgtagaygatttattggtttygggtygyggtttygygggtggtygttgtaygtttgagatatttggttygtagaagttaggtgtaygtttgtgtatygtygtgygttggatgtgtatggaggygagatygtggttatggatgtttgggattaygggagygtgaayggggygatygattgagtgatttgagagayggggtagagygtaggaaggatttttaggaygggtttatttgygaygggyggyggtgggggagtggggggtttgtyggygygtttataggttttgggttygygttyggaaaygttttygtagggagygggtygggatttttyggagtagtayggtgayggygtgttataattygggttttagttgtgtygttttygt

SEQ ID NO: 6729 - DNA, 2392 bp, synthetic construct
  misc_feature 1..2392: note = Description of Artificial Sequence: Synthetic polynucleotide
  source 1..2392: mol_type = other DNA
ygaggygtatttgtttygagtgttaggtttggggaygyggtttyggagaggggagaggggttygggaatgyggygggaggggtttygaggggtagygggtygggtygggtyggggyggaggtggygggtttyggyggggygggttttygygggyggyggtgagagttttygtatagtyggttgygagttttgggagtaggaggygyggtgygtagtttagttygggayggagtygggygtygtgygagtttygggagggtygyggggygtaggggygggtyggggttagyggattaggtygygttattygttttygttttygttttgtygygttygggtttyggygttygyggagttgagattgagygygttagtttttyggggtygaggttttgggatagatatygygagggaggyggtyggygygggttttygtygygggygtagygtttttttttttyggtaagtggygagyggygggygaggggtattaatttygtygttaatttggggttgggttttygyggygygygagtaaggayggyggagatagaggygggatattyggggggttggatttaygtaggattttyggggtttaaggagggggyggttggaggattyggatttttaagaatttggttttgggttttgattygggyggtyggagagaaggygaagaagaggtygagtagataggygygyggyggaygygagagaaggaygygggygaagygtttaagaygttygtttttagggtygtygagttttttttttttttygtttggygyggtagtatygygggattaggggagtttgggttgtygyggatttaaattgttgttgttggaagtygtyggggyggagagyggggaatagggtygggagtgggggtyggggttgggatttattagagygaggggttggaaaggagtygagaaggtgaaagggggttgtgyggttttttagtttagtgttttagtttttttaggtttgttgggtatttgttgygtattygtttyggygtttagattttttttttygtygygagtttygttttttttttttttagttttgttttattttttttgttttagtttagtttttttttttttgygatttgggagaatyggagtgggtttttagagtagtggtattttgtagatgttggttygtgttyggttttygggtttttagagygtaaagggaagggtaggtagagagggtattgggygagtaagatttggygttgggttttggttgygtattagtygtttgygtyggtttttgggggtttygtttaggattttygayggyggggaggggaagtttygagttttttgttttttgtttaygygggtagggyggggataygyggagtaaaggtattyggtaatttgaatttttaggtgygtttygygattttgtaaggagttgttgggtgagtaagaygggaattttygttaggttttgatgtttattttattygtttattyggttttttagttttggtygtttaaggggatttttggttyggttttttagttttyggatggtggygttattttagtttagtttttgatttygggttataggaaaatygaggaaagatatttatttggggagggtattatttygttggttgtattttagagttygtttaggttttggyggtgttagtgattttgagtttgtttttaaattttygaagaataagagygtgttaggggtaggtaggtaggttygggatatttgggttygtttagggttttygggygggtttgggatggtattggggtygtttgttaggttggtttggtttttttattgygggattyggggttaygatttagtttgggggagtgggggtgggggtttyggagtygyggaygtyggyggggggtagygtggggyggggggygtygggtgygtggtgtttagtttggtygttaggaggygtggygygggttttygttyggagtygtygtygtygtygtygtygtygtatygygagtgtttttgagtygygggtgayggtggttttygttgttygygtttttttttttygyggggggagtttgatgttaygttttttatgaattatttatygtyggtttaaaaatatttygaattttatagttygagtgtaagagattgttgyggaggggagggggyggggygtttyggtggttagggggagttygggyggggttygyggagaygggggtygtagttttggaggagtaagaatttygtgtttttagtagtggggtaagttagaayggyggtttttttttttggygtttgggttygggttttggttgggtaaaagggagggagggaaattygayggtaaaggaggggyggtttatyggaagggtagggggttygg

SEQ ID NO: 6730 - DNA, 564 bp, synthetic construct
  misc_feature 1..564: note = Description of Artificial Sequence: Synthetic polynucleotide
  source 1..564: mol_type = other DNA
ygtttttaaatygtttatttgygayggtttygygagygtgygtagtttagtttttttyggaygttttygttttygttygggtatatygtgtttygtatygaggtagagaggggtaygyggattttagtttttgygagtttttttgttygtygttattttatatttygtattgttttagttgtygttttagaagatgtatygtttggygygtaaagyggtgtayggtttttagttygygygtagtagtttggaggggygttagagttttygttttattttttggyggtattgttttygggtagttttttttttttttttttttttttatgtttttattttattttgggaygtttttaggatygaagaggtaggagggggatygygaggggaaggygyggagttggggaaggaggagtagygtygggygtagtagtttagggyggttygggaggttgygyggygttygyggatttaygttttaggatagaggaygtagtttygagtatygtaygtggtttttagattttttttatttttattttggygattaygagagggggtygg

SEQ ID NO: 6731 - DNA, 3277 bp, synthetic construct
  misc_feature 1..3277: note = Description of Artificial Sequence: Synthetic polynucleotide
  source 1..3277: mol_type = other DNA
ygyggtatggtggttttygygtgtgtgtgtagygtttgtaggtgtttygtttagygttttttgtataatagttgtaggttggattygagggtttttttttttggggttttatagtgtttagaggtttygttagttttagatatygttttaggtttttttttttttttgaygtygtttattttttttttttgyggaagggggataygtttttttgtgtygaggtgttaggtygttgagatttgttgttttggaggaaaagttaggtagggtttttggttttgggyggttaggaaggttttayggttgttggggatagagaygyggggttaggttaagggttttygtttygtttaaatagtttgttttgggtagggtagggtttttttttygygttygygygttttyggttgggtayggttyggttttaggtttgaygggygyggtttttttattggaygygtgygggagggyggygaggttaaagygttggggttaggagggtattygtttagyggttttttaygggagttggggtagaagaygtygygatttygygygggtaatttttttygaggygygttttagttygtggygttgtyggygtagatttygygtggggatyggygaggttaattttttttgyggttyggggtyggtagagtaygtaaggggtygygggtygygtgggtttgggygygtygtggtgggtaagyggggttagyggagygggaattygtatatttttygagyggagtygaggataggttygtgygggtygyggggtttttttggygttaggaagyggyggtygaaggagataaygagaaygtagtttyggtttagggaggtttaaaagttgagatgttgaaygtagayggygggygttygggggttggggggygggtagaggtygttattttttaaaaaggtttttatygagtyggtttttgttttygttygaggggyggaygttygatttyggtattygggattgttygtgggtttttgttggttggggatttttagttttyggttgygygtagggaaaggttgtagaaygtagagattagagaagtygggggyggyggggaggggtyggggggttayggttgtagttyggtttygtagtttyggagttttagtttttttttttgtattaygggagygtggayggagggattttygaggttttgatygttttgatagtttyggggyggggyggggyggggyggttgygttagttttggttttgagtttttagttyggygtyggaattyggatygygatttygggagtygagtttygyggtttagatgaaggygygagtgygygggtgtygggtggggtgtttgagygagagyggagttttttaggtggaygtttttagttattttygggattttttttgttggtttttgggtttgagaagtgggygyggttggatagaygggaaatagttttttaygtataggtggatattyggggatatygggygygygyggygtttggtaaggggaagttgttggagaygygggyggttgttttygyggggttttttttygaagygtygttgygaaygtttagtttyggygaygtygtttgttygygatygggtyggygtygyggataggaaaggttygattagttaggtttgttttygagaagtttttagygtttygttygtayggggtggggattgatagtttttyggggayggggtygggtttatagagttygggagttgggggaggggaggygtygggggtttygattygtgggaagtttttgtatttaggttgttyggyggttttttaatagtatayggatatttaagaaaygyggggyggttyggtgattttygttttggatttagtggygtygygaggttttatttygagtygttgattatygggtattygggtgttgaygatttgggtttttgggtatttagttyggttttaaaygatttyggtttaagggtgtttagtgtagttaggagggtygaatygaattttatttttyggaygyggtggtttttygttygtttggagtttygtyggaggttyggggatattaygtaggtggtttattttygagttyggggtyggagttygatttttttttttttgagttttyggagttttyggggtagtagygtyggtttaggygggggygggggaggagggggtygyggtagtttttagaagggygggggggaygygagyggaggtagtttyggtggygygttygtgagattttygtygygtygygggttygggtygyggataattaaagygggatttttttttygttgaygtyggyggttygaggtttttttygyggyggtataaaaggygygggtttygtagygtaggyggtagtgggggtttgatagygyggyggtgtggatygygyggtygaagagygyggygtttagagygygggtygttygyggagttatagttygagtygggttttagtyggagtygagttttagtygagtygagtygggttyggagygttyggtgttygtagttatgtyggtyggtygygtygygygtatttgtgygttgttygttttttgttttttgggygtyggggtttaggatttygggtygaygygttttatttgtatttyggtgttygtggaygtygatatgtgygtygygttygtggtygtyggyggygtygaggagtttyggagtagygtgttgtagtttygygagayggtgttgtagtagaaggagattattttgagttagaaggagattattygygagttgatygttaagttgggtygttgygagagttagagtaygttggatttyggagtyggygaggttygggygggyggyggtygtaagtagttyggttygggtaagaatattatgggygatttgtttyggatatyggtygtygagaygtttagttaattygggtaaattttgtaatygtttaaaattygtttggagaatttygaggttygygygygttttyggtttyggtttttttttyggttygttygtttttttgtttttttttatttygttttttattyggttaggtatttttygttttygttttagtygygygggtgttyggtyggtgttttttygygtttgygaggtttygyggyggttattygttttagttttttgttaggtygttttygtagtygtttagaggggatygygtygygggttttttagtayggttttygygtttygtttaayggtgtggtttttttygtttttgtatttygtagtagtatagtygt

SEQ ID NO: 6732 - DNA, 5692 bp, synthetic construct
  misc_feature 1..5692: note = Description of Artificial Sequence: Synthetic polynucleotide
  source 1..5692: mol_type = other DNA
yggaygttaattttaygaattttgttygggttgggggtttgggaygttttttttggattttaggattygtttgtayggagttatagaatatagygttatygttygttygagtttaggtattttttttttttttyggggtttgygtygtttgtaygttttttygtagattttygyggaaaygtgtatagtagggttttgaatagaatttaggttgttttgagtygaatttttttyggttyggggttgatygtgtttatttaagtygtygtttygtttttygtattttygaygyggggttatttttttttatttttttttttatttaggygtttttttygatagyggagggagagttaaaaatttataattyggyggygggattttgtyggttttagttgggygatttgggygtattygtyggygaygtagtttygggttttagygtatagaattyggtygttygtagtttttttygttagttaygttttttgggttttttattggttaagtygttygygttttygygtgattttattggtttgygtygggggtttagataaagggagtagtygyggagggyggtgattgggyggggttgggggygggtygggygggygygygggtygggygggagtygygygttggagaggyggggagtayggygttgggggaggggygyggtgtttygggttygggatygggaggygygggtgtgyggygaggttygggtgttttttttygtgggggyggggyggygggggyggggyggttttaygtgggtggggttgggygtttyggagggyggyggtygyggggygyggggygttgggatttygttygttttttygttttgtatttttttygtttyggggtttttgttyggayggyggtygtygtygtttygtttttttygagggtttygygttygttttygtagttyggtygggaatttgggaattyggaygtagaaggaygygttygagttaggattygtygyggggtttttttggtgggtygtggtyggggagaggaygygggttttggyggtygaagayggaygtagygttyggaaaggygagttaggttttyggtttttggygttttttgtgagttggttyggyggggtgygtygtyggggagggagggattggtygtggggygagtagtygggyggggagtggtttttgggggttttygttagyggagggttygygaggtygttttyggagygtygttaggtaygtgygttttttttgtttttygygtttttagagygtattttyggtagggaaygaataaaatttyggttggtgtgtaagagtttttygttgtaaaygtgtttttttgygggattyggggagtygtygaaygyggggtagatttyggtttaaagtgtttttgtagtttttattagggatttttttttatttttattttgggttyggagygggtgttagtttggaaatgtttgttttttttgtagtttygattgaattygtttaggaggaggtgygttttgtttyggttttagagttgggaggatygggttttgtttttygaagtttttttatttygtttttttggaaaatgyggattttttttagtagggatgtttagttttgagggggttgttttyggaggaagtttgggttgggaaagttygatattggttttaatttggygggtagttttttttgttttggagtagttttttttagttttyggagtttyggatttatayggttaggagaygtttatgggttttgggggtattttgyggggttygaggaggtygggtggtttgggyggggttygaggaggtygggtggtttgagyggggttygaggaggtygggtggtttgagyggggttygaggaggtygggtggtttgagygggttttttttttttttttatgtgtaygttaaataaaagaattttygaatagttttggggatagaatttttyggaatgtgagtttgtttttttygtttttttttttaggaaggataggggttttttaataaaggtaaggttgyggttggagygggttgaagggaaggagygttgttattttggggtatttgatgaaagagaaatttattttttttttttttttttaaaattagaggtagttgagttagagttttttttatttttttatttgattaatggggttttataygatgtttgtatttggggtgattgggtttgaagatttttagaagtgggaaaggattttgtttgtgtgggagattggaaagttggtttttattyggtgggggatagaatttttatggagtgaaatggattttaggttattttgyggaagattggaaatttaaggatttgaygggggggyggtgattttgtgtttttttttttttttttttttttttttttagtttagaataaagggyggaggygaaggaggtaagatgggtggtgggttyggaagtyggagtygaaagaagaatgttataaaagttttttattttttagttttygygtatttttaaatagtttattagagtttgggtggggataaagtgaatgatygtttagagtygggtttggtatttatggttyggttttyggygygggygttyggagttygggggaagtttttttagttygttttaagtygyggttggttagggygagagaggtyggggtatagygygyggttttttttgtygttttygaggatygagattyggggttygyggttttttgattgygtaagttttttygttttttttgtttttttttttttttygtygaaagaygttyggagygtatattygtttgtattaaagttagggattttattttttttaaaataaaataataagttataaaggtttttgattttagtggaaaaggygtygtagatttatggtttttttaaatttttatattttaattatttttgtttttagtttatttatgggtggtgattaataaaatgattttttattttgaattttttttttaatataaaaaatgtaagtttygttttttttttattygtttggatggatttttttygtgygggaagtaaagaaatttygtttttttyggttttatyggtttagggttgagttgttgttttyggttgagygaattyggtttgtygtagtattttttaagtattttygtttygtatatttttaattgtaatttaagggagaatatttttttygtttttttttygtttaagggtatttgtagggatttttttttagaagttttgtygtgggtttagyggttagaagggttatttygtagagygggttttygatagttttagttyggttattttttaaattgygtttttttgggtttygtattgggygygagtttggggygtttaagggtttttattgaggaggaaggttgtyggatygagttttygttatygtttggygtttttattttttatttttttttttttgttygttttttyggaygtygatttggagatggtaggaaaaaaaaaataattagatggaaattaaagattagtttgggtgygygggyggttttygtygggtygggttatgttyggttygygttttataaatttttttygygaygtgataatagtygyggtttygtttttttgggaatttaggaaygtatygatttttttygtygttygygtaagtttttttttygggagygagaayggagagtttttggtgattttgatttttggttagygtaggaygttttaggttttagttagggtattatgtataggagtggaggaaggtggaagggaaggggtttaatttttatttaagaaagygtagtaaatatttatatttygtaggttaaattaaatatattattaggggtygtattttttttttttygygtygtttgagaagggggyggaaggaaggayggagaagggtgaggggyggattaatttttttttggygatttttttgtttggttyggatattgttgagtygagtggggygtttaggagttagygaggggttttygaggyggtttyggttyggtttaggtgtgygggtygyggtggggygtaggttygtagyggagttaygagattttygygttttyggttgaygttygggygtttagggtttgyggttttaygtgygatttattygggagttgygttttagaygtttygtggagygggggagaatttgaaggaagtygtggygygtttagatattttaaaaattygaattaattgggaaaataggaagggygtttttaaaygyggagaagatatttyggggtggggaaggatgttttttaaaaattatatttttttgttgtggyggttgtttttgattttttttattattaaaagaaatgttgttaygtttaatttttgttgttatgagatatggagggggtagtttagtattttgaagtaatttgataagtttttaagtagtaaattygaaagggaggtyggyggtttaggtatagtttttttgtaatttgaatttataatgaaagtatttttttttatggatataatagattagattttataatttaatttatyggaatggtttygtttaagggagtttyggttgattttattaygttaagttaaattggatgtttgtggttttaaygaaaagygatygtgatataaaatatataatttttaaagtaaaaaattagygggttggattttgtttttttttttatttttgttttttatttttaattttttagtgtgggaaatayggataattatttgtgtgtgttggtttttatyggggagataggygttttgggtttttttttyggygggttagaggtttygtyggttagtgygtaygyggygtyggttttygattaaggtttyggttygttttgttggttygtttgaaaygtygatatttttagygtaygattyggggtttygggggtatttatggggttygaagtttttgtttgtyggyggygatyggatagttttttygggygygtagggtagaggaagygttttygaaagttttygtaygtatttaygagtyggttttgygygggtatagyggtagtygyggygggatattyggtagggttttyggygttattttgtgttaaaaattgygttttyggagattygggtatygtyggygtyggtagttagagygggatttagtttttatygygttttttattggagtttttttyggtttttyggygagtgyggttygtggggagtgggygtyggygygaggaagtttttyggttygggygatttyggtttttgagyggtttttttttaygtygtygttygttaggtygayggaggatyggggyggggaygggggttttagyggtttattttgttgttatttttgatttattttttagtaayggygygtttttttttyggttttttygygaggtttgttgaagayggatttagttttygtagagttggggaaggayggatggayggaaggtttagygyggtttatttttttttttygtygtttttyggttggtaggagtygtagygatagtttyggggagyggggtttgttttaagatttttttygyggtatygggagttaggygtggtyggaggtatygyggttgttttaygtggttttygtyggtygttatttygygyggggaggaygygtgygtgyggtgygtggtyggygggttgyggggaygygt

SEQ ID NO: 6733 - DNA, 7937 bp, synthetic construct
  misc_feature 1..7937: note = Description of Artificial Sequence: Synthetic polynucleotide
  source 1..7937: mol_type = other DNA
yggygggtttttagygtagttttgygygtttttttygaatttattygygtygtttggtgatttttagggttttaggygtggtagttgtttttattttgatttttttygatatttatattaaagttatygggaagagggttgttttggaggtttgggttygttttgttaaggattgattttttygggtagggagttagaggggatygttygagaggattygtttttgygaggtttagtayggygttttaygttttttttttggagtaaattygtttygttttttttttggagtaaattygtygtattttygtttgtatygaaattttgagygtygtttygygttatttttagttygygttygygttgttttttttttygggtygtaggttgagaggttgggtygtattttggttaygttttgttyggttttagygggatattagaggtattygttaaggtaaatgtatttttgtaaatttattttygttttgatattttaaggttttatatagaaataggatttgttygttttatattagtagtttttattaaygttygttyggygtatatattattttaattygygaggtygyggygtattttggtttttttttttygttataatagtygttttgttttygtagaaagygtttygttgttttagtttyggaaygttttagggaggtgaatgtagaatgtagaaaagaggttttygtggaatttagatttgtaggagggggygggggagggtggygaggygyggaaaggttttaattttagtyggtttyggggttgttttttygagattttygggggagggtggttagggaagggtttttttaagtygyggygaygtagtttggggggttggygggaygygyggtttygtttagygtttaggtagttatygyggtyggggtygggaaatgaaattaaagtttttttgttttygggagyggaggggtgggygttttgtttygttttygaaygttttygtttygygttygtttyggtygagtattgatttgtgtgygaagttatgggtaayggygaygggaagtattttttyggttggaagtgtgyggggggttgygyggygggtttagtyggggygagaygygyggyggtagyggygttgyggtggtttaggttttygygtttygatagtagatgyggyggyggygtaaagtygyggttatttatgtygggtttyggtttyggttygtygtygttttttyggagtagygyggtyggggttygggggyggttyggygygygggyggygtagaggyggyggygttyggggttataggyggtggtggyggyggggtyggttagtaygygggaggattgggtttttyggygggyggtygygtatygagttagyggtygttgtgygggtttatggtttgtggaggtaaaagtagaggagataygggtgattggggggttyggttygttygggggttttygtttygttygtttatttattttttttattttttattttygtyggttygagygagyggyggttaggtygggtggyggggtyggggygttyggtgttttttygtygtaygygygygtagtttagtattyggggtttygygygygtaygtatygtttyggttaygtttggttyggggtagtygggggaatttagtygtattgttygtygtttttygttttygttttygygggtttttgtagttagggygtygyggygaagaggttgttggttttgttgggtgataaaaatttaaatttgygaagttattaygtatattygtatatatatatatatatatatatatttataygtatatttttttttttttttygttgtttaaaggtgtttyggaggaaaaggtttggggtttatattagttttttttttttttttattttatgtygaggtttagtttttattgtatttygtttaatygaataattatgttaattaagygagtaattttattgattgtaatttaagagttttttttttttttaataattttttttttttttttatttttattttttttatgtatttttyggtttatttttttgaatttatygtggttttttttttttagttttagygggattagtttttgtttttagtatygygttaggattttaggtyggttttttagagtttyggaggttygtaatygttatyggtattatttgggtygttaygtygtagtgttyggtttgttgtttyggagtygggagttttttgttgaggttgtaataattatttygttttttaattaaattygtttaggatttttttttgyggattgggggtttgggggtgtgtgtggggggggtgtttttagagttagaatgtttttttttaayggtttaaatyggttttgggatttttttttttagygtttgtyggggatygygagtagaggtyggttttygtttygggtagtatygggyggtttgggtaygyggggtttgyggygtttagttyggttttttagtyggggaaggtgggttyggtttagtataattttttgttagtagattttgttyggatttyggttatttaaaataatttttatttttatttttttttatttttatttaaygyggagtatttatttaggygaaattggggataattttagattttgggtgyggagggtyggagttagtgatagaagttgygtgtattatygtgtttttaggygttttttygaaggygttttttggaygtattttatatattattttttattttttaaataygtattgttttaatgtttattatttttaataaaagggagatggataggtttgatatttttaattaggaattttgyggaaaattttgtgtttttgtagttattttattatgataataaagygattaagatgttttttatttattgaatatttttttaaattgygatattttatggttygggttttaaaaygttttatttgtagattattttgtgtttgatttaatttataatygaaaatataatgtattaagtgaatatatatttgtttagttgataagtttttttaatatttattyggagagtttttgtattgtaaataaatgggtttatataaagagttttttttgtttggtaattatatataaaggygtttggggtttttttttttttggggatygttagtttttttttygggtttaataaatagttyggtttttaagtttygatttyggtttgtaaagygagygttyggtygttagggttyggagagtgttttggygagggggttgygagygtaggggttaggggaggggttgttygggttggattagggaygtgggggtttttagtttyggtyggygtttttygagtttyggagggygtygggygggataaagggaaagaaggaaagggagggaggttagaaatttgtagttttaaaggygtygaaggtyggagaggggtygggggttgygtaygygggggtgttaggttttttggyggtttttagggagtygtgtgtgttgtgtttttgttttgtggttgtttttttttttttttttttttttaataagaaattttaaagttgagaaagygygagttgtyggygattttygggaygygggttyggttaygaagtaataattttaattttttattttttgygggyggatygtaggttygattgttttttttttattagtttgttygattttttaagtaaataggaggtggattattgtygtttgtttgygtygttayggttttgatyggattggagagagtttttttttgtgtttttttttttyggggagaggtygygtygygttttygygtttgttygygtygggtttygggggtttggggagtttgaggyggttaggaagtggggygaggaagggyggttatayggttygagttgggagttttatagtttygtagyggygaygtygttattygtygagtgtygaggttyggggtttatttttagtttagttttaggagaggtygygtyggaggatygygaggayggygtygtagygttaggtygggttgaggtaagggaggaaatggagygaaaagtggyggygggtagagggtttygggygggyggagaatygttgaygagggtatttyggaaggaattgaatttaggagtatagggttttttttygggaaggtagggygtgattttggagtygtyggttttttttgtygyggttttaggygtggttggygygttttaggatttggagtttttataagtttgttttgttttttgtttttgtatttaaaaattygtttttttttygttygtttgtyggagattaggattttggttygtttgttttttttyggygtygttttygggagygygggygyggtggggtttgtaggtygggttgggattaggygygttttggggygygagtggttyggtygtygtygtagaattygttttttgygaaatagtygtattygttttttgggagagttatgagaattggggtygygtttgattttygygttygaagaaaattagttygyggatttygttataygggtygtgattygagtttygygygtygtttygaaygygygyggtgaaaaygtttygttgygtyggttttgttyggttttttttttttatttttattttttyggaaaaaaaaaattttgaattgggaaygaagattygaaaaattygttatgattattttttttttyggtttttagtttyggttyggaaggttttttagggtagyggtygtgggtattaygattyggttagtttttttygtygyggatygatygggtagggttaatttaggattgtttyggggaggggagtagggtaggggagygaatgttggggttygttygtgggttatttagaattgggygtaygttggyggygttyggatttygtttattgttygttyggtgttattygygyggttygygttagaygtagtttggyggtttttgttttgttttygagtatttgtttttaatgttgggtgtygatygagataataagygtttagagtaaagtaaggatgtattaygggggtaattttaaatygatygataagattttttagagaaaaaaaaatygtttatagtttatattttttaagaaaaaaaaaagttttaatattttaayggattttgttaaaagggaagatatatattttttaatattataattttgaattttttttgttaaaaaaaatgtaaaattttaaagttagaataaaaaataaaataataataaaaatataaaaataaaaaaaaaatgaaagtaattttagttatttattggaggttgttttttggatataattgaatgtaatataattaaattagtaaatgtgattttgttttgtatttttattggtatttttaatgtgttgattgttgtattgtaaatgtatygtttttataataaygattttagygagtttatttagagyggtttttaaatttgtagtttggygyggygagttaygggttttgtatattaataagttygtgttatttagttyggaatagttagygygttgattggtygygtagttttttayggtygggagttygtgttatttattyggygtaaataggttttttaataggttggygtygggttagggaattgttaattaggaagtagyggggttattattaagttygatggygtttaatttaagttyggygattgygtagtttttttgygtagattattgttgttgaatgggaatgtggtggygtagggygggagagggagttggagygagygagtgygygtgtttyggyggagggggaggygtagatatagatatagatatatatatatatatatatgtttaatttagtaggtttaaygtttggtttttgtygtatagaaggttaagggaagaaatattattattttttaaaagtagttgttttttttttttggaatttgtttggtaggtggtaggtaggttagatttttaagtttagaggtttttttaggttgtttggtttatttatygttttgaagttgttgtttgttyggattygagttygyggatgtaygtaygtaygttygttgtttgggtagtaaaagttttgaatagttygttyggtttttttttttttatgatttggggattagattttgggaagtgagttttgagtttttagtygtttatattattggtttttaattttatttttttttgttatattttgtaatagagtagttattaaaatgaaaattagggatttattgagaagataaggattgttttttttttatttatatttagatttagaaaatatttttagtttggtaatgggggaagygggtatggtgtggtaaattatgtatagtattttttaatgttgttttttgtttgtttatttgttaaatttttattttaattaaagtaagttattgaataatttttatygtaattagatgtaaattatttttaaaatatttygtaaataaatatttttgttagaatttggttttttatttaaatgttatttatttttagggagtygaggtgatgttttagtggygatggatatatttatttttgtttttttttttttatgtgaatttttgtttttttttttgggggaaaaaaggatatttaaattaggagttaattgatagatttataygtattygaaattttttatygttttatttyggtagggataygaaagagttaaatttaaagtttgttgtttttttgttttttygtttttattttygttttygygggatygttgggattggttggtatttygttagtggattgtttattatygagtgtaaataaggygttgattggttgttgtttagttygtattgggttttttgaaaaaagtaattattggtttygyggttttaaggyggtttaaggtygtttgatgaaaggagataagttggggatygtttttaggattttygygggtygatyggggtagttygggagtygaggtgyggyggagagttygyggattaaaggaatttggagagaaaggggaagygggyggtyggtttyggtyggttttttttttygtaggttaygtygatttggggtggggggttgygggtygygggyggggatttygggatttttygtttgtttgagtyggggtttaygtyggygttygtttygggyggttyggttyggaggggagtttyggagagttyggggttygtaggtaagtatyggygtttygygggtygggtyggggaygtaggataaggygyggggtttatttyggttggttygggagtggyggtygygygggttyggttttygttttyggygtttttyggtttyggyggtygggatttttygyggtygagtttttggttaggttttaggtyggygttttyggaagygaygtttggygggtygyggggtaygagggggagagtygggaagygtaaattttygaagygygyggagattygattagygygyggttatttattaggttgggggygattgaattaggtttttgggygyggtygtyggttgggggtgtgtggygtygattttygggtttttgtygtggtttygggaggttggagtagygagtagyggttttagygagtgtgtyggggaagygggtgttttygggtttyggtttygygggtgtaggyggaggttgttygtttttygygtatatygaggayggtyggttyggtttyggagaaatggygtttgagaaaggaggggaggggaaggttttyggattttgggtagggattygtygtyggggattygyggagtttttyggggatggaggaggygygagttggaagyggygygygagttygagygyggggttaatatygtggggtttagttttttttggttygggtaagtggaygygtttygaggtttygggtttaygtagggygtttttygtagayggygt

SEQ ID NO: 6734 - DNA, 1408 bp, synthetic construct
  misc_feature 1..1408: note = Description of Artificial Sequence: Synthetic polynucleotide
  source 1..1408: mol_type = other DNA
ygygygyggtagtttygaggtagtagagygyggagtygggagygyggggagygygggtyggyggyggygagggaggaygggggygtagayggtyggygygyggygyggttattatgggygtgyggtgagtagtygttygggaygattttttyggttgygyggygttygygyggagtttttyggtyggyggtgygtttttayggttattatgaaaggtagggyggyggtagtttygyggggttttgggyggggggaaygggtttyggggygygygggaggttayggaggtgtttttygygygaatttttttttgggttgygggttyggggagtyggggttgttagggygtygggttygtgygyggatattgggggygtattyggttttygggttaggygyggttggagatttygaggttggggttttgaagygygtaagtatttttttttttatygygtttttgtaagtagtttgaagttttaagtygttgtttayggattttygtttttaattttttaattgaaaaaatttgtygaggagagtggaggtatygttatttttttyggtygtttttttaygtygtagygttttttaygttygtttagtttttttttttttygtttttagtygtttttyggttygagyggttttygygttggyggtygggtgtttttttygggattggggatgtttttygtgygttttygttatatttggtaatgattaggtgttygaggagtttagttggttygggaagtgtatttggtatttttttttattagatttatygattggaaaatagttgttttyggtttygygttttttttaygtgttygttttggggtgtgtttattggtgttttggggtgatatattttagttggttagtygttttttgygyggtgttttttgtaggtyggtttatggaagtgttagatgttatygtattttagaaagaagtaygagaaggattgtagggtagttttttgtttagtggaaatayggagatttgttagyggaattttgatttatgtatgagataagtaatygtagyggaggtattaaagagtygtttaggaatgggttygygtggtgtttatataaggtttygtgtgagagttgttggttttgtgttaggataatatagttttgygtgggtgygaaatgttatttgatygyggttatttygtttttagtygttatagatttggygatgtaatygttttgatttttagggttgtygttygagggaggygttygggaagttttaaggygtttggaaagtaatttttggttttggaaagttttttttttgaagggtagttttygyggaattaatyggagygatgatattttattaatttattttttttttaagggygttaggtgtttaygtygggagatttygg

SEQ ID NO: 6735 - DNA, 208 bp, synthetic construct
  misc_feature 1..208: note = Description of Artificial Sequence: Synthetic polynucleotide
  source 1..208: mol_type = other DNA
ygttttyggggtygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttygtyggatttttttttttttttttttaygttygt

SEQ ID NO: 6736 - DNA, 805 bp, synthetic construct
  misc_feature 1..805: note = Description of Artificial Sequence: Synthetic polynucleotide
  source 1..805: mol_type = other DNA
ygtygttygyggagtttgattttgygttaggayggaggaggttgtgtttatgtaattgttttgaagtattgyggtggttttttttttygyggttgggagggtaggtaggaygaggttggtttttttygtayggtttttgggygtgggttttygtygtagtttygyggagtttyggtgttttttgtaatagggggyggggggaatagyggygagtagttttgggttgyggttttttttttaygttygagttttttgygtatygtygtygaggaygygygttygagtttagtttttaygtygyggygygttygggttttttgttgattttaggtaattttttygtttttyggagtgggggattgygagggggtttyggttttaygaggtgyggaggaagagttygaggtttggggygaggygygygggatagtggggttgaygygtggtttyggygtygygyggtttttygaatttygagtttygygttyggygyggtyggggtttttaatygttttttygttygtygggatttttatygggtygagtttgygygtygygtttttygttygtttygttygttgyggygtagtagtggttgggtyggygygtagagtttgagtttyggttttyggtttgggggtttttttgggatttttggtygaaggggygattyggttttygygtttttttttygttaatttgtataaatttttygttyggggygttatgttttaagttgtttttygggttgggggygagygygggtyggtttttttttyggggaggtgygggggatagggggyga

SEQ ID NO: 6737 - DNA, 2462 bp, synthetic construct
  misc_feature 1..2462: note = Description of Artificial Sequence: Synthetic polynucleotide
  source 1..2462: mol_type = other DNA
ygagygygyggttgggaggygggtttagggyggggtagagygyggggatygttygggtatygggygtagttaaygagyggayggggagggygggttygygagggttgagyggygygggttgttataggygttygaagygygttgtaggtggtaatttggaggtgtygttatygtagttgygggaggagttygggtttggyggttttttttagtttttaggagttttttttygtygtygagttygagattggatttyggagaattygaaggaaagagtttttgyggagggatttgtgagtagttttatttttttttgtttttgygttattttttttttttaaggaaggttgtgtttgygggttgygaataagtttygggaggggttttaaaggaaggtttyggtgatttaggtgagygtttttttttttttggtagtygggygtaggtygggagygtygtttagtttygtgggtaggggygygggtgygggtygtttgtttttggttygaggtygatgggggagaaagygaggaaggggygaggttggttygatygggggttgtttggtygggttygttyggaggygatagggatttttagaygggtatttggagattagggaygagtagagaggtgttttgagggggatagagggtttgygttyggtttaagttgatygggatygatygtttgygygttgtgttggagttgtygyggaagtygggygyggygtttttgygaattttagagttagtgygyggggttyggygagygtattagttttyggtttttyggagtttaaggttttggaggaygttattttttttygttygggtaatttttttttygtttttttttgtttttattttttygygtyggtygtttagtttatttygagattttgtgtttttgttagygygygttagttgttgttgttattttttttttygttttygtyggagttggagygatttggggtttggtttttyggtttyggtagtttagttgtgggttggaygygagtggggttggttagttttttgygaggagggtaggagtgagygygggttttttttttagtgtttttttygaattygttttygtttttttgtagttygaatygttagtttagagagyggagttttagaagttagattttgttygttttggggaaaygygggggaggggggggtttttygggaaggtgygaatttygtagatgaggttagagttttygtttttattttagygttttagtttttgtttttttgtttttaagtggatagtggttttgattttygtatttyggtttgtggygtggggggygttagyggtagtgtgtgtgtgtgtgtgtgtgtgtgtgtgtgtgtggtgtgtaaggatgagygagtgygatttttygggaggtagaggygtaggagttagtttttttagttyggyggagtygtagggatygttttttttygtygttagttgygygtagttgtatttyggtaatttygygttgtyggttttttttttttagttttagttttyggtatttttaygattaaygyggaattttaggattaaaattatttggttaaagggtgygggtgggggatygaggygttttygaggygaatgaggttgttttttaaaattygggaggygtttttygttyggygttgtattttttygtggttyggttgtaaggatttgyggtggaggtttggyggaggygggttygygttttagagagagygttaygttattygagaaggygaygttgggggttgttgagttttttaattttttttggygygttttgtttagaagtyggggagtttttggtyggyggttggyggggaagygyggygygggaggtggggtggtttggttggtgttgygggagggygtttygggygygttaggggttgygtgtygyggttggagggygygtygggagttgyggygggttyggggtattygagtggygttggaagttgagtyggggttygtagggttyggtgatygttttggygtygtygttgyggattygggagtagtaattaygyggygygttyggtygttttttyggttygtyggtygygtttttygttttttttttgtagaagtgaagtygtygtttgggttygttygggttggygatttttgygttagaaaagtttgaggtgttggaggygaaattttttygggagygaagggyggygtttataagataaggaaagggaagaygtygggttttggygggtagygtagtagygggagggyggygttgagygttaaggatttyggaggygaggygaggttaggyggatttaatttagttaggaggtgttgttttygtttttggggtttttttataggtatttggtgttagttatagattttygttttygttagttygtaattttttygtaattttttttgaagtgygatggattaagattgggtygyga

SEQ ID NO: 6738 - DNA, 990 bp, synthetic construct
  misc_feature 1..990: note = Description of Artificial Sequence: Synthetic polynucleotide
  source 1..990: mol_type = other DNA
ygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygttaaygtygtygtygttattgagttttyggygtattttagtttygggygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyggygggygggyggtttttggygtttatatattygygygygtatatatatattaygt

SEQ ID NO: 6739 - DNA, 2274 bp, synthetic construct
  misc_feature 1..2274: note = Description of Artificial Sequence: Synthetic polynucleotide
  source 1..2274: mol_type = other DNA
ygtgtygggttygtttttaygtyggattttygatttygatttatagatttttttygtgaggggtttttttgggtttagaaygttttygygygygygtgtaggtatataygygtatatatttataygtttgttygtatatygttagtgttttttttttttatttgggattttygggtagtygggttggatgaataagttgtagttggtygyggygtttygttagggggaygagggtggggagggggagtttagyggggygtagggtygtggttagggtttggggatttgttygttttttttygyggtygttaagttttatygttgggatyggygaggaattttttttagttttttygtagaygttgtaygatygyggggatttttyggggtygttagtygygtygggtagggggygatagggagggtagggtatygggagatygtygtygtyggagyggtygttagttttyggygatygttgygggygtagtygaatattagyggtttgggttyggtygttgttyggggtyggyggggatygygtagygtttaygttaggyggttyggyggttgtaattgggaattttaagtaaagttttttgttgttttttttgtagtyggttagggatttaagagtgtaagtygtttaattttgagtattagtttaggtygyggaaggayggyggtygagttggtagtttyggttggggagttygttttyggggttygttygtttygttygttygaggattgggtgtttgttagttttayggtttttygtttagygttyggtttataggtagaagyggtgttyggttygtygygtttttygttyggtttygaygttagttttagggttttattattagggagttgtyggygtttygggygtttygygtyggttygygygtttygggggyggtagaggyggtttygtttatttgagaaygtttygttygtygtagttagtaaaagttyggttaaagtygttaggtaagttttaagtttttttatggtgttgagtgygggtygggtygtttttyggyggyggtgggtgggygygygagggyggagggggtygggagttttggtttygaggtagygaggagagaygggtaaatagtagagygttaagttaagtttttaaagtgttaatagttgtagaagttygaattttagyggttttaggggygygggtatagggttttgggttttttttttttgtttttggttttattyggygtttggygtygttggtagagggagyggagggygagttygyggagttaaaattttttttyggtttyggttgttgagttygtygttttttttttttttttgttygggattygggattygagttgttggtygtggtygtggyggtggtygtggtygtggtygygygygtttygttygtygtttttttataggtagttttaagtttagtttygggyggyggygygtygatgatygagttygygtyggttgygygyggggtttttgtttttygattgattggyggtgtttygtaggtyggttgaagggagygtttaygttayggtygttyggygtygtygyggttygttagagggygtgagygttygtgtttygtyggttygygttygagygttttygggagttyggttgggggyggtttygyggttatagttattatygtygtygaagygggygttagtygygyggggaggagyggttatygggtttttttygtttattttttygtttyggtygygttttttattttggtagttggttttggggagggtgattgtggaagaggttgygtygtygttagaagtttgtttygggttaygagtygygagtagtttgtgagygyggtygggygggattagyggtttgygatttygygggygyggttaggyggtttygagtttggygtyggayggygatgttatygtatagggttagttgtattyggagtygtygggtttgygttgttyggyggttgygggaaaagygagttaggagatygttgaggtttyggagggttgygagtttttttaygtygygggyggagygaagttggygggygtygggagatggygygggagtygggagygtygagtttygygatygttagttygttttyggtygggttygtygggtataygtygttggtttygagtattggygttygggaagtagggygygtttttgttgttttgygtttttattatgtttyggtgtttygtgtgggttygaagygagtygtaggtagtatayggaaggygg

SEQ ID NO: 6740 - DNA, 882 bp, synthetic construct
  misc_feature 1..882: note = Description of Artificial Sequence: Synthetic polynucleotide
  source 1..882: mol_type = other DNA
ygaaggttgtggtygygttttygtyggttagtttttagtagtagtttatygtttttgtttygygttttygttttaggttygtayggttttagtttygyggggattagtattgagtyggtttygtygtygttttagtgaygggttgttgttgygggaagttaatygtttagygtttggaggagggygaygaggtttttygygygagygagtattagaaagtagtygggttttttygttttatgttggttyggttggygtagttygatygyggtyggtgtttgaggttgggggaygttttgattygygtyggtygtttttyggtggttttgggygygtttygtgtagtygggaggttggaggygttgyggtyggaggagttgggggagttggygggyggtttggtgtgtttyggtttgygygaayggttattgttggygaggaagtygggyggygagtttaaggttagggagggtyggttttggygttyggygygtttygygatttgtttggttgttyggggttgttgtataagtyggtgatattgttttgygggtttayggtttgtgagygttgygtggagttggggttygygyggttaygggygygggygygggygygggygygtgaaygtagtgttgagtygtttgttggagaggtttttttyggtygagtgttygttgygtaggttggagggttaggygyggagtttgtagygttagtagtagttygaggtygygttgtttaggtgygattaggttttggagttgtgatttggttgtggggtyggttygtttttttgatttttgttaagtttagyggttggagttaattygygggtttgggttttygagygttttgtttaggygtagggggttatttygt

SEQ ID NO: 6741 - DNA, 4359 bp, synthetic construct
  misc_feature 1..4359: note = Description of Artificial Sequence: Synthetic polynucleotide
  source 1..4359: mol_type = other DNA
yggagygtttaatttagtatatygttttyggtaaattgygagtaatttaaagtagttygtttagtagggaggggagttggtgggaggggggtggatttygtygttygtagaggtggggagatttggggggyggtttygtttttaggttgtagygtgggtttggttttttgttaagttaggagygtagttyggagttagygyggttttygggtttttgygtttatggygagggtygygggggaatagtttttggtaggtaatttgtygggtatttatttgagtttttygtatygyggttygaaaatttgggagygttttaggataaagggttagttttttggaattagtygtgtgtgattagtgtgtgttagttygtatgtgggggttttagtgtgtaattaatttagttgtttatygtagtttyggagaaaygagtaygtttttttgtaygtgtttagggygggtgyggygggtagtgtattgtgaataaagtyggttatttttygygtygtatttyggggaygattttyggayggtttttygyggagagtygggyggatgagagygtggtgtgtgtgtgtgtgtgtgtgtgtgtgtgtgtgtgtgtgtttgtgtgttttgtgtttttttaaggagtyggaggyggttygygaggtagggatttgttttaatttgttttatatttggygyggttttttygaagttygggtggygtttagggtygggtaggtaygyggaggattagtagygttygttgtagaaaaagatatygttaatttttatttagaagtttatattgttttgagatttggttttttatttttttttaaaaaaaaaaaatgtaaattgatggatgggttttaattgatgygtaaaatgttttttttgagagtaagataggagggttagggaagggggaaataggtagttgatataatttttatagtttaattgtygagaattyggatttggaggtaaattygaggaygtattygaggagtaggygaggttgttttttagtaggayggtttggtatyggggygtattgttggggatttgattttttygtgtttttttattttagggattygtagttggttygygygttagggtatataygggttgygggagaaggtgaaagttaggatgtagtaygagtttygagagtggtttgggttgtgttttttaagagaatagtygaggttttyggyggttttgggaagttgtttttgggtygggagagygggaggyggygaygtaaggaygygttyggagtttgggygygtygggggygggygtttggttggaagtggggtagtgttttttatgggaaagygagattyggygagttttttggttgtttttttagttttygaggtgttygttttygygygtttgaggtagygtagttyggagggygaaygaatggyggttggtaaattttgagtgagagtgygtttyggattygaattgtygaattgtggttgyggtagggtyggtygagatataagttygtttttttygtttgttygatgggttttagggagattttagttttagtttggtggagygtttygttygagggagttgtgttattttgtttaggggtagggagggyggygttttgggygggtggggaagggtttttgtggtttttggggttttaagygttttttttttygtttttttttttatyggttttttttagttttttttgtttygttttttttyggggttggttggatyggygyggatttgttttagatttayggggagygttttaggtttttaatgatagtttaaatgtggttgttggaaaagtygaaagggatgtggttgaygtggggygtgtttygtttttttgtaagagtyggaaagggagttgggagtygygyggttggttttaggttttygygtttygtygttagtaagtaggtgggggagtygtygtygtygttagttttatttygtttttaagtttygttygttgygttttggtygygggygtygagagggtgyggggtttygtygtgttttttttattttgtttattaatttgtttgtttygtttygtttygggyggttttagataygggtttttygyggtagtattygyggttygttyggygtagtygtygtttygatttttyggtttyggggggtaatgagggggtagtggaaggggtattgtttttygggtattatttagagaaaygagatygtttygttttttygtyggttttttttttttttygttygggttygygtaatttttygttagagggtaagttgggagtgtttygtttttatygatagtttttttttttttttttttttttttttttttaaagtttttttagaagtgggagtygggtgggggaggaagaaggtttggttagttttygttttttattttattttttyggtttaatttgtttttttttttttttttttttttattttttgygygtygttgttttttyggagttgygttygggaatgataattggagygyggtttttttaagagttyggttttgtttttyggtagttgaaggttattaaatataaaagtttttagygttgyggtttaatatagygtatgygttttgttygaggattggtagagagayggtaatatggygagaatgtttggtagyggggattgtaatattagygygggyggtagygttagygttgtygtygtygtygtygagaataatggggagyggggygagggygagygyggygyggggggtygyggtygtygttatagtygttygtattattgtagygygggtgaggaggaggaggaagaggaggaggaggaygagatttaggaggtgtagataaygggggaygaggaggaggaggaggayggaggtggggggttggaggaggaygaggaggaggaggaagaggaggagatggggttggattgggaygagtttttggagttygaggattyggtyggggaggagttggagttygagtyggtttatatgattaatatggattagagygtygygttggagttygaggygtygtygygattgttggygtttygggttygyggtgggtygttyggggayggtttygagttggatttygaygtgttgtagygtttygagygggttyggttgagygagaatattyggttggttattygttaygtygtgygtatttttygggagtatttgagygagaaggygtagagttyggatttygagattatggataagggggygttgtgtygygtgttgygttttttttatgtygaggttygttttaaaagyggttagttttatagtaagtygtygtttattagtattygtagtttttttaatygttattttaatgagttttygtattgtygtaygttygattttattaaggatttygagttgygtagygttaatttgaygttggtygyggttattygtaagttygaggagtagggygtygggtyggtggtgtagaagtaagttattaygygygtygatttgygtaagttgtatatttttagygtttttagtattaataygtttttygggttgtttaataaggtttggttygagaygtgtatgtatttttgtattygyggtygygagaattagygtgagttggaggaggatttttttgggttggttatggaygaggayggtygtaagttygtttattttaagtttttygggttttattataagtygygttygtygtygtggagtaagaagygygtygagagtagygaygaggagaatttgtttygtatgtatgagaygggtatygagttttgtttttaygttagtttygttaagtatttgtygaaaygtaattttttttgtaaggygtttttttagyggtttygggattattgtagygagggygatgtgatttggtaygagaataaagttatyggtaagaatttgttaggtattyggatgtagatgttttttaaggyggttaagttttttaagatttatattaattattgtatyggygtygtttttatygttaygtttaatagtatygygggtattggtattaagttgggttygttygtttygtagggttgttaygtygaggttttgaayggggyggtayggtattatttttattatttttttatttattttttttattattatygtttttagtygttttygttggggaatatttatattttttttaaagatagttaggtygggttygaygtgaaattygaggttgygtttaagygygttttgtaygagtttgtgttygggtygggggaaatttgyggttttattttttttaaaagattttgtattygtttttyggagtttgtggatgyggtggtggtggttttygtgaaatayga

SEQ ID NO: 6742 - DNA, 2762 bp, synthetic construct
  misc_feature 1..2762: note = Description of Artificial Sequence: Synthetic polynucleotide
  source 1..2762: mol_type = other DNA
yggggyggtgttyggygtattttaggttttttttyggygatttttygygggttgtagtaaaatayggggygtttyggyggggygggggygggyggttgtygyggattyggtyggttatagtygtagtttggtggttttygattggttaygaygygggyggggaggtttggyggaggagggaggygggggygagggyggyggyggyggygggaggaataggagaggggagygggtygygtagttaggtagygygtggggygagygyggggagagyggyggyggttygtttaggtygygtagyggaggtygagyggggtgygyggtyggygayggagggyggygygygygagtgagyggygtagggygaggatyggygggygggtgtyggtgygygggtagtaggggyggttgyggtagtagttgygygggayggagtygyggygggagagatygygtyggtttttygttttatttttttgyggtygaggtyggagaatagtttttaattygtygggggatyggaaagaggagtygagaagygtttttyggtttttaygtagyggaggygyggagtggygggattgttgttttttgtgggtgtagtaygtaygattyggagygtttttttygyggygttgttttyggygttttygtygygtygagyggttttggagyggggattyggaggaagtaaaattaygagttygaaatttygygtggyggagtttttggggagygttattygttttatttttatttttatattttttatyggttaaggttttygtygttgtatttttygyggttttygttgygtttygggtyggagtygagtygtttgygttgttatagtagtygtttttatatattygtagaygtttataygttttttttttttgttttttygttttttttttagttttttgatttttgggtttgttttattatttttggtgygagtttygyggatttygyggttygttatttgttattagttygttttttattggyggggagyggagagtagygaagaagggggtggggaggggaggggaagggaagggggtggaaattgtttggagtygttttttygygtygttgttggtgttgtygttgtttttttttttttygtygtygtygtygtygtygtygtttttttyggtttttygttyggttttttttygtttttatgtgtyggatagygggagygttgyggattttgttgtygttgttggyggttttgttttaggtaygyggyggttttygygggtygggttaygggyggggtggggygggyggygtygggtttttttgtttttygygtygttgyggggtygggttgygtattygggaagggaggtgttaygtygygtygygtygygtygygtggtyggtagttgygtaggtatygggtttygttygggygtyggggtagggttgtyggggttagtaggtttttygygttttttttggyggggttttaggggttggattgygggttttttttgtttttttttyggggtygagtaagttygyggggggtgtttttaggtagtaggagggtgaggtaggataatttttaggttttgtagttttttgtgtttttygtttttygtatagtattttgttttaatttttttgtttatttttgtagggatgggtygygagtttatagtaggaatttttattttggtgttttagttaygggatttgtttttattttattttattttgtattygtgygtttttyggtgtttaagggttttattgttttattgtttttattttagtttggagttgttttttttttttttttttttgtttttataatattttgtgttygttttatttggaaagaaaatttggtttttttgttyggaggagtttttgtyggttagygtttgtttgtagaaygagtttggttttttaygtttagtatttttttygggygagaagtttygttaygyggttgtttttttttttgttyggttgtttgtgttttatatgygtttygggggygtttttgtttggagtttttygtattttttatattttygggagagagttagygagtttttttatttaatttttattaagaggttttttygyggtaggaagtatttgttttagttygggygtaggttttttygttattgtaygttgygggtttttagttygggggtagtttaatttttygtygtttttaattygaggatgtttttaggtttttttygattagttagtttaggtttggaggttattttatatagtttyggtygggattttttagttgggygggtgtagtgttttggttttaagtyggttttygtttgtygtggggtttttygaaggttgygggaaaggggygtgtttattttygtygyggggtaggaaaatttayggagggtttttttgtttgtygttttyggggtaaggggagaggtgttttattgttagttggtagtttygaaaagtgyggaygtagttyggaagtgtttgtttygggggtggagataggtggtgtggattatttygtttygtggtttttaygggttagggtttggygygtttyggttygtyggggggtgagtgttgttggggygggggtaggggttggayggggttggttttygtagtttttygygttttttttygtaatttttagayggtygtgggtygtygtygygyggagttttgtttatggtgygttatggtgyggtaygtttgtttttgttyggttttaygtttttttttygggtygt

SEQ ID NO: 6743 - DNA, 338 bp, synthetic construct
  misc_feature 1..338: note = Description of Artificial Sequence: Synthetic polynucleotide
  source 1..338: mol_type = other DNA
yggagygggggyggtttggagygttgatygggygtygaaaygtygggagtygggggttaagggttygagttaggaggtttyggagtagtagtygttygttttttaygtygtygtygtygttttygyggttgtttggataygggataatygatttggggtttygatygtagtagagtyggaggggtgggtaggygygggttygggagaygygyggggaaaygygyggagtyggtgagtygggggygtttgtgtttyggygygggygtttgtgtttyggygyggggygttgtygggyggygtttattttttttggtygttygtttgygygattttygygg

SEQ ID NO: 6744 - DNA, 1435 bp, synthetic construct
  misc_feature 1..1435: note = Description of Artificial Sequence: Synthetic polynucleotide
  source 1..1435: mol_type = other DNA
ygggattygtgtgtttttyggggtttaaaggygttgggygggyggttgttttygggagaggygtagtttttatttttggattayggggttagtggttggggaagtttttggggygygygyggggaggyggygttgygttttatttgtttagtttyggaygtagttygggggygaggygtttagggattattttaatttaatattgggatttttaataaattaaggaatgggattttaattattgaaaatttagtttttttgggttagaatggtgttgggatggttttggttataaaatattaaagagatygatygttaagggaataggaaaaaygttygagatagtygttgtaattaygaatggattagatttggtagtayggggtattgattgttggtgtttaatyggattttttttttttttttttatttttttttttatttaaagtaggttttygttgyggtygggatttygtatttttgtaaygtggtyggggttgtattttttatgagtttagggtgaataggtgygaagtgygttgggagtattyggttagyggtygagygyggggaatatggagagygagygygatatgtatygttagttttaggattggtgttttaggatttayggggatttaggtaagattaagayggtgattygtaaaaaataygaayggatygtttagttttttaatggtttygagtygagttttayggataaygttaaatttaaattttgggttaaatygaagggtttttagttgggttagtyggaygaggttygygggggaggyggyggygttaagtaagtgttttaygtgtttgttaagattayggtgagtgattygtttttttttgttatttgtttgtyggagtagttyggyggggagggaggaaggagagaggygggagagagggggagtygtgagtygtygttggttygtgtgttttttattttttttaattttttttttaagtygtttttattygtattagttaggygygttttttttattgtatagtttttgtggttttttattttaaagyggtagygtatttttagagttggttttttttttygtttygggttttyggatyggttgtaggagttttttttttygggtygggyggyggygtttggygttttygggttgggttattgttttatgtttttttttgggygtttggygygtgttttatygtygttatygygtttaaaggttaggttggaagttyggtygtaygttttgagagtagaygagtttgatygatagtttatagtgtttttttattggtataaagttygaatgtagygttagyggtggatgtggggttttttttaggatattgttaggttttatygttagatygttgttygggaggtayggggtagttygaatgtttygattatttttagagatygttgtygyga

SEQ ID NO: 6745 - DNA, 510 bp, synthetic construct
  misc_feature 1..510: note = Description of Artificial Sequence: Synthetic polynucleotide
  source 1..510: mol_type = other DNA
ygagygtgagttagygttgaaggtttagagygygttgtaygagtagaagattttgttyggggtaagtggygttygtygtggygtaagyggtygaygygtygatagggggygatttygggaggtygggyggyggygyggygygyggggagaggayggtagggygttygtygtttygtttgagttygggagttygygygtttttttaaatttttgggttttyggtygttygggtttaaygggattygggataggggttttatttggtygtggtygtgaagtttttgygygggtagtttggggygggggagyggygygtttygggttttyggagygggagttgttttygtygggttygygggtygygtgygygatygagttygtttatygagtygaygygggtygttttagtgggggaggagggggtyggygtgggagggggygtygtaagtgagattatygyggtttatttaaggagttagttttygtttttgataaattatygygtttygg

SEQ ID NO: 6746 - DNA, 2722 bp, synthetic construct
  misc_feature 1..2722: note = Description of Artificial Sequence: Synthetic polynucleotide
  source 1..2722: mol_type = other DNA
ygaaagtggttagtygagggtyggygggggttaggttagtygtttagtttygtygttttagttttttagtttygtagttygygggggagygggygygttattttaatttgttaggtttttgaagygaagaggttgttttgaaaaagtaaatatgagagaggayggggtgtaggtaaatattattaaygtgaaaatttgttattttagttaagtttattattagtatttatttttataggyggggtygttyggattttgttttyggtttygygtttgttattttttttttygygtagtygagatgttagttttagtgggtttggyggggagttyggyggggttyggatygggyggttygattttyggtttttayggtaggaaygatttagtttygtatttygggagttgtaggtgtygaaaaygaaattygygggggtagygtaygtygygygagtttyggttyggyggtaatttagatagygatttaggggttttatttttttgatggtgattaaaaaaatatattttatttgaattygtaaagtagaygagggtaaattaagttatttttygygttggtttatyggttatygygtttagygttttttttttttttyggygggygagygggtaggggygttygatttttatttttttttygttagttatygggggattagtygygtttttyggggygggggaggtygttygggayggggatttttatttttygttttyggaagygggttggggygggggtyggatttygagtttttatttttygtttttttgtttttyggygyggttygatagtttttagttttattttggtaggtggtttgggtggyggtagatgtygggygggaggaagatgtggggttgttttggtaggttgggggtgtgaggaggaaaaaaaaatagagaaagatatatatagagagatagggagagagygygygygagagagtttttgtttatagatttatttatataatatatatttatgtagttttttttttttygatattgatgaatgygygttyggattttygggyggattttttttaagtyggttygtttttttagtttaaataaataaataaagttagatggaagaaaaaagygtttattttattttygtygtygtttygttygttatttttgtttttgtttygttygtttggygttttaatagagtatagtttggtggataaagtttttttatatatttataygaaaataaaaattattatttttaaaatataaaaagttgtatttgttgttattataaaaagaatttttaaaaggtaaagagaggaggtyggttgttyggttttttayggatattygtttttygyggtygtygggttyggaattttagygtttttygaagagttatgygtttggygttatttatagtygggggtygtttyggattgtattatygttayggygyggggtygtygaygggggaggygyggtggtygtygttttaygtygttttgttttyggtygtygttygtygtggygygggtttttatagygygtttattttyggtttttygygttttttttygygygygtatattygttatttttatttttggtttggttgggaatttgaatyggtttagtttgtttaaayggaaaggatagagattttgtttgtttaatgtaaaaaaaaaaaaaaaaaaaaaaaaaagaaaaaaagaaaaaaaaaattagattagattgagagagagaggagagagggagagagagagggagagagagagggagagagagaggagagggagggagggagagagagaggggggagagtagagagagagygygagygygagygagygagagaagaggagaaagagagagagtagagagygagyggagagygaggtgtagagaaatygagggggagagaattygagtgtgtgtatgygtgtgygtgtgtgagygygagygagygagagagaggagygagagagtgtgagygagaaagaataaaaggaaagaagattttttttatgtatataaagatggttaygttagtaaayggataggttgataaygtaagttttagtattaaygggttyggtagtagttygggtagtgtygggtatatgaayggattaagttatagttyggggaattygtygattatttttatgaaggattaygatgttattaagttgtttattgggtagatttttygtaatttggatgagaaggattttaagttttttttygaggagtttggtaaaatttaygagtttayggttttgaaggataggtttataggtatgtataaaggtgagtatattttttttttttaattttgtyggggagtaggagygggttggygggtygatyggtyggtyggygattgaygagyggyggattaagygagaggaagtttygggygggygyggtggagggaggygttygggtagyggagattagagttggggtgygtggggagttgttygttggggtaagattgggttttgggygaggtgttgataggaaygatgttatggagagagtagygggygtygatgaagagaaagagagaggggatygaggagayggggtttggatttttgggtatagygatttgaaagatggggatggggaaggttgtatyggtygagtttaggaygttgagyggayggattygygggtttttggtyggtygaggatygagggtgttgtttatygtygt

SEQ ID NO: 6747 - DNA, 1133 bp, synthetic construct
  misc_feature 1..1133: note = Description of Artificial Sequence: Synthetic polynucleotide
  source 1..1133: mol_type = other DNA
ygagggyggtygtttttattttygggggtttttttaaaatggggtggggggaagttatygttygttttgygttttygygggtgtgttttgagttttyggtygttygyggygttygttttygtttyggtgtttgyggygatttaygtttygaagtagatttygaaaggaaaaagygatatttttgtttygtatagagttaaatattggaagtaygagatagtygaygtggattaggattattttggtttttygtgyggyggyggyggyggyggttgygygygggttttttgtggygyggttttggggygygggygygggyggyggyggggttgygggagtygtyggggygggaggyggagygyggggygygggyggyggtggggyggyggttggyggggagatagatggtttatggaaaggtttttttttyggtttttttygatatttaaaggygttggggtygtagttgtygttatataaaggygygygtagttaatgggagyggagygtagygyggygyggtttygtyggaatygygggggatagyggggatygygggygygygggtggyggagggagggaggggtgayggttggaagggggtyggyggttaatygttgyggttygttgyggggygygagggaggggttagttttaygggaagygtggagtttagygygggtttttggtygttygygggtyggagagggygygygtgaagygtttttgtatagatatgggyggygtgaatayggaaygtgtatatatggagagggaygtgtatttagatatgtggaggtgygttttttagtgtagagagaygggtaygagygtttttagtgtataygattttgaggtttttgtatatygygtaygggttattyggggaygtgygttyggaggttggygtaygtgtagagtttgattgygggtataagggaagttggaatgygaataagtagtygtaaataggatttaggtattgttatatagatatgtatatattaaaygttttgttaaygtaggaygygtgttaagaaygtatttttagagatatatagagggaatataygatgtagatataggtaagataygtatattttttaggttttttgtttggygtatygygtygt

SEQ ID NO: 6748 - DNA, 2401 bp, synthetic construct
  misc_feature 1..2401: note = Description of Artificial Sequence: Synthetic polynucleotide
  source 1..2401: mol_type = other DNA
yggtttgatyggggygtttygtygtttttttagtgtattttatygttttyggttgggggygtagtattttggagagaggygtttggtttygygtttgggttgggggygttttattttgygttttgggggttaggggygtttgtygggtygttgtygaggggttttgtttatttttgtttagttyggagtttaggygagttagygyggygagtttttttttttttygtttgggtygttttgagttygygttygttttagttgttgtagttgttgttgttggyggttgyggggagygyggggygygygtygaagaggtttgggyggygaggayggggaygaggaggagtyggaggyggtaaggaggaagagygagyggaggtygaggggtttagyggygtggygataggattagggggtttygagaatatgggttagtaggyggttaygggtyggyggtyggaygyggtgaatttgtygyggtygggygygtattggygyggygagtyggagtygagygtagtygggggaggagggttggygtaggggygttygggyggagggggtygattatttattattaaygagttattatttaataagyggagagyggttygttagtygygygggaggygttyggggaagggggttatyggtygagygtagygtatattygtggygtayggygggyggygyggygtygaggatattygggatygygygyggagtyggggygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggttttttttatggtgatttttttygggggtttttttattattttgttttggyggaygtttaagtatttgtggatygtgtgttgttattgygggggtaagaygaaggtaaygygygtttygggygttygttttttgygttagttttatygtttttyggygttttttgtagtttattttttygtttygygtygygtygtgtttttttttattttygtttgtttttttttygtygtttttttttttttyggttttttyggtgttttyggatyggggtagygggyggygygtygggggtgaggagttgtttttagttagtgygtttygggaygyggaygtttaattttgtttttttgtttattgtagggttgttggyggttgyggttggggtyggggtyggggatttataggttygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataattttgtataagggaatttygggggaggagtatggttygagataatagggggatttygaggggygagagaagttggggagatttattttattattgggggtagtttayggggttgttatttttggaatgtgtygaggtygtatatttgatgtaattttttatttygttttttaggtgttttagtggaatatattttaagtttttyggtttttgtttttttgtttttaggttatttattttgggttttyggaaatgttattagtagygyggagttggagygggagttygtttgaggtygyggttttaygyggagygttttttttggygttygaggtggttagatgtygtyggttttagttatttttggtgtagaygtttatyggtattgaggttggygatattttyga

SEQ ID NO: 6749 - DNA, 769 bp, synthetic construct
  misc_feature 1..769: note = Description of Artificial Sequence: Synthetic polynucleotide
  source 1..769: mol_type = other DNA
ygttgagtygtagggaagttgyggggttagttgagtagtyggyggtttgttgggtttttagtgtygygygatagtaygattygagataaggtatttggggttggtgttaggtagaggtttygygttgygtggtyggyggtaatagygtttggyggtyggtttygggyggggttgtaggygtygggttttygyggtygygaggyggggttggagggygttgygggttgygyggaggttgygggaagygyggggagtaygyggagttygattagtagggagatygygtygygtygggtataggtaygggattygygttttaggagggygtagygagaggygtattgygtatttaggggttgyggtttyggtygtygtgyggtgataagttgatttttygtygtygtttagttaagttygygyggggtgttggyggagatgtygtatgggaggtttttttaaygaggtgtaaatttaagttatttygtttgagtgaatgaagggayggygyggggygygggtggggtttatygtgataaaagtttagtatttggtttaaattttttttttttttttgttygtaggattagaatattygatattaaaatgttttagtgtagtagaattttttagygatttyggtggygggagagtagtattttttaggtatagttgtgygtatttttygggttttatygatygtattatttgatygygggaaaygaaatttgagtttaggaatttgaattgttttaygtaygttygttttygg

SEQ ID NO: 6750 - DNA, 1169 bp, synthetic construct
  misc_feature 1..1169: note = Description of Artificial Sequence: Synthetic polynucleotide
  source 1..1169: mol_type = other DNA
ygggagttaggygygygggygggggttttatyggttatttygaaatygtagaatgttttagggttttygggatttgtgggtttaggggaaygttygggaygyggagygggtttagtttatttgtyggaygtttttttygtttattygaattygggagtttygtaggagggatttttttygtttttagtgattatagttyggattygggttgygttyggygggtaaggttgggagtttttygggtyggaggayggggygtatgggtttygggtttgtagaattygyggttgygggagttgggtttttttttttttaattygggtygygtttyggttggtyggaggaggtagagtaggggtgyggtygtgtgttygagygggagtggggygtttattttyggggagaagggggatygggaaaggygtagygygtygagtattygtttatatttygttygtttttygygygagtygggtgygtttttaatygaatyggggygggygtygggagagtygggttttttygagattygygtttttttttygttttyggtttattygggttttygtaggattagygygaatagayggggygattygyggtygagatttttatttaygygygyggygyggttagatyggygagygttttyggttygaygtttttttygattttyggattttgggygttgagygggagggggaggtattagtttygttyggtttygagtygttttygtttttttggttygaatagggggattttaaggtttttttygattttttygygttygygygtatygygtattyggagaagaagttgygygyggaattattagataggagttygygtttttygttttatygtttattgyggtttyggttttttygtygyggattttttattttyggttttayggygygtttaattttatttgyggtttagatttygygagtttygggtttygtttattyggtyggyggttttttyggggyggagygyggygtttttggagtyggtatttyggatttyggygtygtttygygtatygttttygttttagtttttagtggygyggygttttttygygatattygygggtttttaggagygagtygattttyggttgggtttggagtyggggttaagtttattyggagggagtaygg

SEQ ID NO: 6751 - DNA, 6036 bp, synthetic construct
  misc_feature 1..6036: note = Description of Artificial Sequence: Synthetic polynucleotide
  source 1..6036: mol_type = other DNA
yggtgyggttttgggtattgattaygtttatatgtgatggttttygtaaygtgtaggtttygttggggagaggttagygygggttttaggttttagggtttygggtttattgtygggattttttttagttttttttttattggtttygttygtygyggttgygtygggtygatattgattttagygatttttggggtygttttagttggtagttagtattttttttgggatggggtttaaatgttagtyggttyggygtttgtattagggttttatygtaygtagttygttgttttttygtttttygttaaggggtgygataggtagggggattygttggtttttgttttttttatttttatttttttgggtttygtyggagygtttgggtttygggttttttgaatatygtttgggyggggttttttgtyggggttyggttatatttttattygtatttttatagttggggttgagaatgaaaataatttttgtaaagtttttattagygaattatyggyggttgtagtgattataggtttygtttttgygygtygtaaaggtttttagttggtaggttygtygyggygtygtttttttttagtttygttttatttgyggygggygtygttatttttttagygttgtttttgygaagtagyggatttagatttagattyggattyggaggttatygtttttttygttyggggttaagtaayggttttygataggggaagggtygygygtttagggttgggttaggaygtttttgttagygttttayggtygggatttgaggtttagyggtygtttygtttttttttggattttygyggtatagaggtaaggtttttyggtgaggygygaggtygtygtgygttgggygggggttttgagagtggtggggttygggtgggtagaggttttggggygatttatgggggaygtttatagygtaggtttatggggtagttagatygygtygtagggtygggagagaaygttttagaaggtyggtttaggttattattttaggagggtggyggaggtagtggtyggggtttttttygyggtygagtyggtggtggttgygattattatggggttgggtatatagttgaaggggggtattygggtygagyggttgggggagtygtgtyggttggyggggaagttttttayggygatttttaggttttygtgtaygaagggtgyggagatgggagttttggygaggttgggatygtttaygtygttgtygaggagggagagttggtygtyggygggggtttyggggggttttttggtttttaggttyggggaygtgttggagttggttttgggggyggygattttttyggtttggattayggygtygttggttttgygyggygggggttyggtyggggygttttygggygtggagtttygtagtggtagggtygtggygggaagygtgttgygtaggatgtggggtaygtttttatttyggatgygtygttaggtygtgttyggygyggttattttggggagyggtyggggtttttygtygttgttgyggygygyggygtyggttgaggtaggggtygyggggayggygtygtygggtttgygggttaygttgatgtgyggtagygaygygtagygtttgatagttttyggtygggyggygggygygygtataggtaggygggaygggttttyggaggtggtgtgtygggtagggygttygttagggttgggtygggtygyggggggtygttgtygggtyggggtygggttttgtyggggtgtygttyggagtttttygtagygygaggagtagaggaagayggygggtagygygggtyggtygyggyggggygaggygttttggggggtagaggtygyggattyggtygaggatagttyggagyggyggygtygtaagttyggygattttttgatgaaggttagttgtygtyggaagttygagyggtyggaggattygttgtygttggagagggttgaggttataygtattaggtttaggyggttttygygygttttygggttygtttyggttttygttyggtttttggggttyggtttygggattgttygagttagyggtggyggtttaygtygggtyggtttttgtatgaaygggattygtaygggygatttttgygttttgtgttgtttygttagaagggtgygygtyggygttttgggtatyggggaggtttyggggtygggtagggttttagtagtttgggtgatyggggggygttttttgggtaggggttgggaggygggygaggtttgggaggagttggaggagggggttttggygaggygggygggyggtgtggygtttttggggggttggtttagygtygttagtttygaggttttggtaggtyggtgtaggtttygygatygttgttgttyggggttygggattttggttggagtygygggttgtgttaggtaagggggygttatttttygyggtgtggygygggggtygggggtttttttgggttgggtayggggtgtygggttggggaygtagattattgttygttttyggagtatagttggtatttygggygtggttttttgtgtgttaygtggtttttyggggtttgtaggggaaygggggttttygttggttttgattgaggttgygttttttttttttggtygtygggtattgtttattttttttttygtttgtygtttttttttgtgtttggggggttgtagggtggattttattgatagttyggataygaaggataggatggagtyggattyggaygaggtttttygygtggtagttgttgtttggtgtagttaygtgataattgaattggygtttttttggatggygygttattttaygttatttaggtyggaggttyggttygagttygttgttttttygtygygttttygggatttttttgygggtygtttatttagtygggtggttyggggtttgyggygtygtaggttagatayggggggtyggygtttgggtagggtygagttgatgtatygttgtagaagttttttygyggttygygggttgggygagttgtygygttygttttttgggttygggtttttggtgatygygggttttyggtttygtggatggayggtyggyggtttygagggttygggttygttgagggagttggyggaggagtttagggagtagtagggyggggtttygttagtaatgaggttgggttgggttygggygggyggyggggtagttggtgtagttttggayggggtaggggttttttttyggttttgyggaygttttygygtaaaagygygagggatggtygatgtgygtyggtgggttggygtgggygyggtygtygggggtttttygttygagtygttgtygtagaagtagtatayggtttttttagtgggygtygtgaggtatagygattggagygtttygttttygygggttyggtygggttttgagtygtttttgtttgygggggygttygggggtyggtttaggggtagttttagttttgttttgtttttgttygygtttygagattgtttygygttgyggtyggygtttttygttttgtgtyggtgttttatggtttgtttggtagaggtggggyggtyggtgggtttttgtttgttygttggtttttygggttggtttttggggggtttttgtagygtttygtygttgagygaggyggygttagagaagttgatyggygtgtttttygyggagttagtgtaggagtygtttttttgggtyggggtyggggygggtattaatatgtagaygggtayggggagtgygyggygatttggtattagygyggaggttattttgygtagtygggtaggtayggyggtttttaggtattttygtagtagttttagtttttggttygyggygtygygagggygagaattygtgggygtyggttttttttttygtygtyggtgttttgtaaagtggaggtyggygttttyggygttttygtygygttyggggtaggtygagggtagtagtygtagttttaygttttgttgtaygtagtgttygtgtaaggttagygygttgaggttggaggygtaygagaagttttygtttggtttttttayggtaaagygtaygttgtttgygtttagtttagatggtagtyggtagygttttyggtagtyggygatgtttaggaagygttttaygtagtttttttattgtaggttgaattgggtggtttyggggggattttgtggygygggygttagyggtggygttttgtttyggttgggaggtatggtttgttyggggttgtygggtagttygttagggttgatggtgtygttgttttgttygttgtaaggtttattggggatggagttggygatggaygggttttygaagttgtttagygagtttatagagttgtagyggtttagtataagyggtgttttttgtaygtagtttttygaygagttggayggygtggygttttttatttttaggtttyggtttyggttaygtyggggagtyggaatggttaygggtagygaggtggtttygggygttygttaygtgttgtttagtttagtttygttggggtyggttttttttagtttttttagggaggagttattgttatttaggttattattttygttggggtttgggyggtyggtygaggatagygaggaaagggagttgtatygggatagygagagtggttttttttgygtygttagtttttgtagtgttttgttggttatagatagyggggtagtygttagtttttygggaattttgtttaggtggtttgtyggtagttaggtttgttttygggtttttggagagattttaggtttygygaggggttttgtattygtttttgaggtatttttaagtagtggtaygtgttgataggtaggygatagtttgatggtgygtaygygggygtyggyggaggtggtttygygggtygggggttyggtttggtagtygggtaggttaaggttaagtyggttgggtygaggttgtttatatttggggttttygyggygygaagttagtgyggttagygggtagggtagtatatgttygygtgggtagtattygtygttggtattgtygttgttgaggttgtygttggagaggttggygtgggtygttttgagtygtagtagygggtgygttyggttttttgtttttygtygttygtttttygggtygyggtatggygagtaggattgggygyggttttttygtggygttttttgtttygggtttttagagttgaggttgaagttatygtyggaygaggtgtgtagggyggagatgttttttattagttggtygatgygygttattgtaagygttagtttggttttggttttggtygttayggttgtttttttattggtgtttttttttgtttttttgtygtttyggygggtgggyggggtgygagttagygtttgtttttgtaggaaggggttgtttaggaagagggatagygyggtagggttggttggtttttyggtggtygyggtygtagttagggatgayggtgtatygtygtygttaaagtagttygaatyggaagtatagttttgggttaggtygtttaggtgtygtaggggyggtagyggttttttagtggyggtttyggttgtyggygggttttgtttttttaggtgttttagygtttgygygaggtgtygtgygtttagttyggtttttagygttygttgtttgygtaygtataggttgggtaygtagttgtttggggatayggyggtggyggtygtttggtgtttggygggtygatgggttagtaggttgygtagggyggyggygttgtttatggygattattttgtgtttggagtgtattagattaygtagtatgtttayggygtttaggttttatagtagtttttggttaygggygttgygggtygataggttttagagygtgtygtaygygttgtttaygatggttaggttgtgyga

SEQ ID NO: 6752 - DNA, 3400 bp, synthetic construct
  misc_feature 1..3400: note = Description of Artificial Sequence: Synthetic polynucleotide
  source 1..3400: mol_type = other DNA
ygtgtagttgyggggtattyggggttgggtttatttgygttyggggtygtataggtaggtagagagagtygggtttagggtataggtttgttttttgttttttgygttyggggaagggggyggtatagagttagtgattatagygtagygygtatttgttttygtaggttttyggagygttttygygygtaagaaggygtagatygygtygtttttgtagtygtygtygtygttttyggttttgagygaggagttgttttggggagatttgtygtttaataagtgtttggtgttygtttygttggtggygttgttgggttyggttttttagttgtgtygyggtgagygtaggttttttagaggtggggygaggttggggtttatttgtgygtttatttttttaaggaaaggygttgtgtygttagggtggggtttgggagttttttttttagggttgggttttgtaygtttttaaagttggtttgtgtatttttttttaagtgaygggttttgygygttttttttattyggtgtggattttttgyggggtttatttttttygtygygagtaggttttggttttyggatgaattttgtgtaattttttttgtttygtagygttttgtygttttttttttgygttttttttggggatygtttagttygtgagygtttttygggggtatttttgygattttttttttgttaggggttttttatagttygtggtyggggggaagaatgattaattgaaagagygaggttyggagaaggggygtygyggtagyggagtttyggagtttttttttayggttygggggtatttttagttttagtygtatygggggagttttattttaattgtttagggaggggggttttaggggtgagggagggatggatagtgtggatygtgtttyggtttagttgattygggtttygattttgtygttgtagaygtygtttttggggaggtagtattttaagtaygtgtgttygagttttgggtttygttaagtttagtttygagggagttatygtygtttttggtaagagtttttttttattgatygygggtattgggatttttatttttaaggaaagaaggagttygggtyggggggaaggtgggygtttattttaggattttattttgttttgtagtttaagttygaggtttaggygtttttattagygtygtttgygtttygggtygaggtagaggttagatttaagattttygggagtygggaggttgtagagaaygaygaagaggagttyggygaggttatyggagaggtygttygggaggatygtgtgattttygtagatyggggatttaaggagaggtttyggagagaggggaagtygyggaaggagaagtygyggaaggaggagagatttaagaaagagaggtygyggaaagaggagaggttaygggtygttagggagtttygggaagttttattttagygttgggagttaygygaagggggttatyggtygtgggtaygggattttagggaygtygagtttaggaagaagtaggtttgggtgttttygaggygtttygaygaggagtagyggtttgggagtygttagaagtttygygtaggtaaggggygggattgagtyggtttygygtyggagtttaggggttttttttggaygtttygygattttggygaaataaagygagtgttgyggtygtagagttatttgtttttttaygtttggattyggtattaagttyggggtttgaaagayggtggtggggygttttaggtaggggagagatagygagygttatagggyggattygggtygtgygygaggagagayggtaagggaggttttaygggttttttaataygtayggatattttagtyggttgtttgttggtttttattggggygatgtttggggttygaataaatatgggaaggggygygagttggggygygttyggattttyggggtaggagttygygyggygtaggggttatyggtagttatattyggtggttattatgttgggtaygtggtgygygttgatgygttttttygataggttgatgagtagtttgttygygtaggyggtgggtaygtagtagggtgggygygttagggyggttttayggatttgtatttttagtagtagtattaygtggttgtygtagygygggttgyggtyggattgaggttagtygtataygttttggtaattgttggtttggtaggtttyggggatgagtayggagygttyggygyggaggtttaygttgagttygygtagygygtayggttygtyggyggyggtggttttygygttgygttgtgttygattyggttygygyggatttygttygygttattttaygygtaggttttgtagygtttttaggagtagtagygttygtaggggatygtygaggtygtyggggttatttgggtagagygygagtaggygygttagtagyggggttgtggtyggaggtagattygggaggtttygtagttyggtagtygtygtttgtagtttagtagttaygyggygygttagggtygtggtttayggygtygaygtggggtygtgtaggggygtaggattttyggtggtggtygtagtgggttttagtagtagtagtagyggtttttygtygtygagtaggygttttagygtygyggggttygataggttgattaggttttgygggaagtyggttagygygttyggatttagggttaggygyggygyggaggttygggtyggggggattygtagygttygtattaggygygtgagygtttttaggaaggggtttgygttgggtggygatttttygagtttygyggatggtttggaattygtaattggaggagttgagagyggttaygaggttaygtygttttygttygtttttgtttygtgtttyggtgtttgygygtatttgggyggygggaagggtayggtgtttagttggtygtgygtaggtagyggygygggttyggatygyggtagtaggagtagggtyggggttattygtgtgaagtagyggtggtygtygtygaatagtagtgtttgtagtygggyggtatttagtygggagtttgyggtgggtgggtaygyggttggtttaggggttgggggttygggggtagtygattyggtttttygtttttttttaygyggatttatttttttygyggggttgtagggttaaggttagttyggagtygygttaggttttygtagggyggtttatygttaatattaggtagygggtgtttygggaggggtagaggttttgyggagattagggtttagttyggttggatggaggtttatttagtttygttttatyggtttttttttttttatygttattggttttaygt

SEQ ID NO: 6753 - DNA, 1143 bp, synthetic construct
  misc_feature 1..1143: note = Description of Artificial Sequence: Synthetic polynucleotide
  source 1..1143: mol_type = other DNA
ygggtttggygttttgtttattttttyggaygggtagtttatttttttttattttyggttttygtygygygtattggyggygttygttttaygttttaagaatttygttttttagggtgggtggggggtgtaygttygatagggttaggttagggttaggygtggagttygygtgygtttygggatttygttyggggygygygggaggygtygggggtygyggaggyggggyggggaggggtyggyggyggyggyggygygyggaggagatygtagtgyggtyggygttaggattygygggggttttttaggtygyggygtttttygtttttttttatttttygattttttttygtttttaaaatgaggaaayggagtaattygttttaagttgtgtagtygggatygtttyggggtgtgtagtyggttygyggaggtttttttgggggygggygyggggygyggttygggggygttttttgagtaggtgagtaygtyggyggggagaygtggagagatttygaggtyggggtggggggaaatttygagggttttaggygggggtgggttygggaygtgygtaggaagggtyggtgtgtgygygagtgtgygygtttygggygygtagygggtgygyggttggggyggagggtgtttagaggygatyggatttygygtggtggtggttggggttttttgggtgygggtgtgygyggttaygagtttygggygtgtgtattygygygtttaygtggagggttgtgygygtgtggtygaaaagygtgtgygyggttttgygtagygttttgygtgttygagtggttyggygttggygtttaggtgttttagtgtggggyggttgtgtgtgtgtygggggygggggataggtgygtaygtttttaggtgtggagygtttgtgygygyggatgygyggggaygtgtgygtatatttgtttttaygtggaygtggttttttgtttgtttgygygtagttgtgttygagttttgtgtgtttttgtgygtgtgtatgtattygtatgygtgtgagtataygtgggattggaggattttatgggaggygtattttggaggggtygagatttattttttagtatygtttattttttagttattagyggtygg

SEQ ID NO: 6754 - DNA, 220 bp, synthetic construct
  misc_feature 1..220: note = Description of Artificial Sequence: Synthetic polynucleotide
  source 1..220: mol_type = other DNA
ygtggtaaattygggtttygaygatagaggtagygtagaagttygtttttaaatgagataattttattaaaattataattttttgtatttttatagygtttttttagtggyggagattttaggtgttttaygttagggtttattagagaatyggggygatygtaagtttagtygygggataggygaggttygttagttttaygaagygttatyggtaygt

SEQ ID NO: 6755 - DNA, 1860 bp, synthetic construct
  misc_feature 1..1860: note = Description of Artificial Sequence: Synthetic polynucleotide
  source 1..1860: mol_type = other DNA
ygtayggaagtttttgtttagttgttagygygygtygttaggggttgtattgaagttgtggattygggatggggaggaggttggyggttttygaagtagggtttatagygggggagggttagygtygtttggyggtggttgygygtggttagtgyggatttaggttyggttyggtyggygttgtttgygtgtggttygggyggagygagggtttttggagttyggttygttttgggttttaggaagttyggygtgtagygttagaggtygygtgtgttgggggagggaggagtatagattgtgtttgggggtatttaggaygaatttatagaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttgtgtaatagaaattygttygygtttagtagygttyggggtygtttgygtyggattygtagtttagtatttttygygttttggatttygaggaggttaggtagagagyggttygygyggttttygtttgygtttttagtttygygttgggtagygggatatgtttggtttyggygtygttatttyggttttygtttgtttttgagtgyggagttyggagtttttttygyggtgygttgggttttagagggttagaggttattagggggtyggtatyggygggagtttagtygggygygttttyggtttttttttatttaygtttttygyggtygttygggtttaggggygtagyggggaggagatttyggttagggtyggggagygygagggyggggyggggttyggyggggaggggygygggygggyggggatyggggygggggtygggttygggggyggyggyggygygggygggaggaggaggagtttttygygyggggtaggggyggagygagyggtygygtygyggagttaagtgagttygtttyggagtygygtygtygtyggtttagtatttygggygttygtygttttygtygtygtygttagygyggggatgtaggatgtaggygggygttaggttttagyggyggyggyggtagttgtagtagtagtagtttyggyggyggtagttttttttttggtygatggaygtagagtygtygtygtygtygttttgggtttggatggtgtygggttyggtygggttgtttyggtttagygygggggtygtggttttttyggtgttgttygtttyggtttygtygttygyggtttygttgtttttyggttttttyggttggtyggtttygagygagtyggtgttttygttgttgtygttgttttttgygttagatttygtygtygtygtygtygygtatttttttttygygttttaygggtaggtaaygtgttttygtttygtttyggttygggtygtygttttttttgtttttgggygygttttgttyggttyggttttggttttyggttygygygttttttttttyggyggttttygtygttttaaatttttaggayggagttyggtagtygtgtttyggygagaaagttygtgtttggaygttyggtygtttattttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygygg

SEQ ID NO: 6756 - DNA, 441 bp, synthetic construct
  misc_feature 1..441: note = Description of Artificial Sequence: Synthetic polynucleotide
  source 1..441: mol_type = other DNA
ygtyggggtttyggttgttagygyggtygttatygtatggttgaaggggattgaggtygagttgggtaagaattttgggygtagattgtgaagttgattgyggggaggtttgggtttygttatagtygttttttatyggttttaattagtttygttttttttttygggatgtyggatyggtatttttattatttttaggtttttagggggttttggygttttagttgtggattttttaatattygtaggtygtagggttatataggttgggtttttaygtgtagaggatataaagtagatagaygaaaattggagtttyggyggtagygagaaataaaggtygygttaaatttyggaagtygttttgtttgttttagttgygggtttgattggayggtttttygtttagtgttttygattggataaygtttaaggtttygt

SEQ ID NO: 6757 - DNA, 5587 bp, synthetic construct
  misc_feature 1..5587: note = Description of Artificial Sequence: Synthetic polynucleotide
  source 1..5587: mol_type = other DNA
ygygggaagaaggttttggggggggygttttygatttaattaggaaggagtatgtatatgtaaatgygtttagggggygggttttgggttyggagtttttyggggygtttyggygtagttttagttttgygttattttygygygtgygtttttttttygygattttttattygagtygtgtttttggygtagtaggatygtttgtttygatggyggygaygttgaygaggtagtagtagttgtygygattgtggtggtgggygtgtgggtygtygaggttgtygyggtttyggggattgygggatygatggyggygggagggttttygggyggygggtttttgtygtygyggtygggttyggaggtggtayggttygyggygttygygttgttggygttggyggygttggttgggtygtggygaygygggtygttgttttggatgtgggatayggtttyggyggtttgtatgttgggyggygygaagygygagagtaygygtagtatygtttgggttttgtgtttttgygtgtygtygtygttgtagttygataygyggtattygtataygttttygttttgtagtygtayggtagatagtygaagtyggtgtgagatgttattgttttggaygygtayggtttgtaagagagtagggttagaggtygggttgggtagtttttaaatttatttttttggttattttggtygtygygtttttttattygygtattttaatatttttyggattttggtttgtttattattaygattyggttttttttttattygygtttatttagtggtatagggtttttaattttgygtggaygttaggtagttagttttttggattgtgtttttaygtttttattaygttaattaaaygtttattttgtatttgtttygtttatataaattaatattgtttgttttttygtagttggygttttagaagggtagagtttatttttttttttttttttttgtatttttaggaaattttaggttggattttttgttttttaatttttttaygtttttttygtttygaygygttttaatygatagtttygttttagtyggttttttttatttttyggagtayggagggtttgttygaatygttttttaaggaaagttattttgttatyggatttygttttttatagttaatattgtgtttttttaagaaggtaagtaaygttgaggttgttgtttggttttttggttatttgttattaattygttttttygygggatttttagaagttttttagygaagtgttttttttttgygtttyggtggggatttygggaagtattgttttayggtttttaataaatatttagggagtttttatttttgaatygagtttaygaggaggtttygttatttttaggtttttttaygttttaggtgggaagtttgggygtatttttttttagagttagtaattttatgattygggtttttygtagtttggtataattattttttatttygttttttgtaagtttgtaatatttygtatttagattygtaatttaggyggaggataaagggttgtagyggagggygtagagtagatgtttagggyggggtagagggggygggaagttggygttayggtygyggygagggygagtagtygygygttttyggtgttaggaggaatgttygtagagyggaggttggtaggygygagaggttttaagygygtagttygattaaggggagttttataggttagygtygagtygaattaggggatttaagttttggatttttgatttatataaaagagaattygattttgtaatyggygatagatggygttyggataygtygagtagttatygatgtaaggttgygatygttgttttatttgygyggttttatatgygyggtygtygyggtttgttaagggagggagttgygggattygaggyggttagaaggggtttttygyggttygygttgggttttatatttaygttgattttagttgtatttttatttgttatttaaaatgtaaagagggagagagagaygtgaggttygyggttttttggttaggggaattyggattygtttttaggtaagggtattttttttyggtaggttaggatygaaatygttygggggatgggggttgagggtataaaggaygttyggttttttaagagttttttaggaggaagygggttttggagttagtatggtgtttgattaaygggtggttgttttggtgtatatttgtyggttgaattggggagattggatggatattagggtgggaaggaaagtttttttttttttttttgggtatttttaggttttgtygygtggtttaaaatttttttttagtttattgggagtygtgaagaattggagggagggtygttgtgtttggatagtatttagygggaggtttagtgggagtaattttgggtgggattttgggagaatgtaggtgtgtgtaggtgtaggtgtgtgtgtaggtgtgtgtgtaygygagtatattagagtgtgtaagagagtgtgggttttgaggtagataggtagygtgggtttgttttyggttatagagaagtggtttttttgtgtttttgagggttggaggttttgtyggtttttyggtattyggttttttggtggtttttggaaygtagtygtgggagttttggggtttttaaagtggtagagggyggggagagtttgatgggattaagggggttttttttattatttagtatttattagagggtygtagttagygagtaygagtaagygattaggttgaggtgtggttttttaggggttgggygtgaatggagttttgggaggtggtgggaatagygatgttgttaaaataattgataggtttgggggtaattattgttgattttgaagatgttttgggatgygaaggtggaagatgggttgygttatagggyggygttttgygygagtgaagttygttgtttttttttttgggttagttttygtygtttygggygygagtygggygygygtyggtatygygtgggyggygggttattttgtttygggygttyggtaygttgagygttagttygtgtagtagttttyggggtggttttttgaggtattattattgaatttttagygaataygaggtggtttygttggttyggaaygygtagggtatttygatgtygtttttttttygtattgttatatttttggggatttttgtgaatgtagttgggggtggggagagagagagaggygtgattagttgtaggtygggggtttggggtaatttaaagygaggtagtyggtttttggttggttggttttgtgttttttatttygtagttgttttttggygtayggtyggaggggttagtaaagttyggggaagyggttgtagggtygaggtagggatyggttatyggttgtttattgttttttttyggatggggyggggyggtaggggygattygtgtttttttttygtttttggtygtatygttagagtttggttggggygygtttattttygtttttygtaggtatttttttygtagtyggggtttyggygggattgggaaygattygggygyggygttgttgttgyggygatttttygtygttygtttttttttattttttygggtttaggttgtatagygggattgttggagatygygaagtttttyggttygtttttttttttttttttttyggtggyggttttagtaaagattttttygagtttatagyggtagtaaagttttygygtttatygtyggttaygaagagtagtagggtatgtagtagtagaggyggtaggtattygagggtatygagtyggtttygttgttttatttttygyggggggygyggtggyggygggggttygggagyggagaggyggyggtygygtgggttyggatyggtttyggttygggttaggaygttttygagtttgttatggtttygygyggygtttttttttttggtygtyggyggtygttaattagtttygttttttygtyggtttgttyggtgyggtttyggyggggggygttgygyggggtgtgtaggagaygyggttttatygggaggttgttggygatyggttagtgtttttttttgttyggtygtttataggayggtggggattygyggtttagtttttgttyggygggtygggtaggggttgggtygygtygggatttatttttggtygagggagtgygtgttayggagtygygagtttttgtttttttgtttttttttggttttgttttygattgttatttttttyggttttygtagtygttttygtyggttttttygyggtttttttygtagggygagtgggygtttagtygyggygygtagatttggygttygatttagygtagygyggggagagygggttyggygtggyggattyggagtyggagagaggyggggagagggggaggggaggggaagggagggggyggttagtggttgggygttaagtygtttttatygttgtatygttttygttttttttttttttgttatagttygtttygttttygttttagagygtttttttttttttttygggggtygttyggagggattatygtttttttggttggagtatagtttygtttygtattygtttgggttgggagtttttttatttaaattttttttggtttttttttagtttgtayggttygagayggtygtttatttttgtttttygtgtgtttttyggttttttttgtagtttttagtttttaattttttattttagtttgggtaattagttgtttygttgtttggtttaggtttgggttatgayggatgggtgggygttyggggtygygagaagggyggaaygttgtgtttagtyggagattaygttgggtggyggyggtagygtygggagtttgtagtgygygagggagaagtgagygtatagygtttagygagtaggtgtttgyggygyggagagygtataygttagttagttygtagyggtygtgagtgayggtaggggyggygggggtggggtggggtggggagygtygggtaygatttagggttygggaggttttygggagggggyggggtttttgtttttggatygygggtttttgtgtttttaygygtttttygtyggtygtggttttttttttgttyggtgtaaagygagatgtygaggyggtaggaagtyggaatttatttttygtttgttttggygtattyggtatttyggtattttttttagtttttattyggagtttgttttttttttagttatttgagggagygyggtttggttttygaaggtaaatgyggggtggatatgtggttyggaygtagygygtagttatagttataggggygagttttaaggttygttttgggttttttttatttttttttttygggagtttttagttagtgygtttyggtatttttgtttttatttyggtttttaygttttagttttgattttaggttggggtggggtagttyggtggatttaygtgtttgttttttyggttattagtttttyggaggtatygt

SEQ ID NO: 6758 - DNA, 3643 bp, synthetic construct
  misc_feature 1..3643: note = Description of Artificial Sequence: Synthetic polynucleotide
  source 1..3643: mol_type = other DNA
yggygyggygygattagtagtyggtttygttygttygtagttttgtttttagyggyggttattgggatygattgttygttttygatttaggtaagatgtttaattgygatygygygttttttaagatygtttttygagtttygttataggtataygygtggtttaaatattttatttggttygaaaagttagtagaygggggaaaaaaaaaaagttgtgygagtagttagtygggtagtttyggagttygyggaggtygttttttygtygtttagtygtttagtygtttataygygaggtyggttyggggyggygygtagttygyggtatttygttttyggttttgygygtttatttyggggygygtygaggttatygtagggtatttatttggtatttgtttttgagtgtgtagatygtygyggtttttatttgggtttttaaataagttttagggagaaagaaggaggtaaaaaaaaaaaatttaattatgtaaatggatttyggattgggaggygygggatggatttgaygtygttattgtaygagttttyggagtagtttygggtygggtagatttatgggggygygttayggttaygttaggtttygtygtyggagtatttygaagttaattaaagyggtaatgtttatttttttggygatttttygtgygtgggtttattattttattattaaattygatttyggygggggygggggttttgtttttaygttttttttttttttttttggtygtttttttttttttttttttttygttttttattttttttttttttttttygtttttttaagtygtttgttttttatttagtgaataatgaataaagatgtgagtgatgggaaaagatygtttttttttttaattttagtagagagtaaagtyggttttaaagtaaaaatttagttgttagtattaaattgggaaagaaaatagygygtttttagttttattattttttttatatatatataygtaygtatatatataygtaygtaygtatattttattttaagtttatttaagttttggttggagattggggygttaaggttagggygygyggggttgtttaattygtyggggatattagggttggggaayggygygtgttttggttaggygtgtttttygygtttattttygtyggtttttttygtyggtttttttygygtttttatatyggtygattaggttyggyggttygttygggttgttyggtygtyggatgygtttagtaaaygyggtttttgtyggatttttgttaaattgtatagyggyggyggyggyggyggyggttgtygggagaaggygtaggaggaatyggagggtygtatygygygttygtttatttygtttttttygttygtttttygtttyggtttygtyggtygtyggtttttattygygtataygatttagtttttaggaygtatygggtgttygagtttygtaggtygggatatttygtagttgtygtattttttgttaaagtgaaaaygaaggyggttgataaattaygttttyggygaggtattygttagatataataatatttggtaaataaaattyggtygtygttgttattygtaygyggggttgagatttygttttgttttttttyggtttttagtttttggttattgygtttttaattttaaygtttttygttttttaatattttaattttttatttaattygggaayggtggatatgttttttaataggtatatagtaggaattatttataatatagaagtgaaaagggggggatttaattttttatttgtttttaaagaaagttttgtyggagtttatttygtagagtgaagagtgagtaatataggtttttttttgtttagttttttttttttttttttttttaattttttygygtttygatttttttttattttatatatattygtttatatggagatatttatattttaaattatttgtaaaattgtaatagatgggygygtygagatttggatatttttttatttattaaaggaaagtttttttttaattttaatttttttttttttgtttaaaatatatttygagtttygtttaygattgttttttttaatttattttygaaaaataatgttttgaagtaaatagaaaaaggtttattagtaaagattatttttattttagttatgtatttgygttggggggaygggaggygtttttttagattgtattttttttagaygtygygtaagttttgttttttttttgttttttagagtttttaygttygtattttttygttttgattggttttatttttttagtttgggattggtyggtttttttttttttataatttgttatttatttatttatttattttttttttggttttyggttgggtttttaggtygaggttyggttggggtaggtgttgygggygtygtttgygtttgtaggygttayggttttttttggggtygygggttyggattttggtattttagttttgaaattaatttttyggttttagtttggttaggttttyggggtataggaggtygatgtaattataaaatggtagattttagyggttttyggygttygtaagtttgatatattgtaagtattagttaattttaattgaaaaaaaaaaaaggttgtaaattattttttttttaygggyggaggggtyggaatttygtagtgagygyggattagagaaagagygtaaggygaattttygttttaggtagaggagaaaatggggaaagttatttgagtagaagttttygyggttttagtttatttttttttttttttattttttttattttttagatttttttgaaagtttttyggggtttgagagtggttygygggtygttygygggtggggggygtyggtygggttttyggagttggaygyggggtttygatygygygtygggygttaggtttygggatttttttttaaagtaayggtttygggatygygggyggggaggyggyggtttaggygtaggtttygttygtygtygaagttttttagygttataygatgttyggtygtagtygtyggttyggttttttttttttttttttttattttttattygttgatagtttttttygttaaygttatagttayggatatttaattagatygtattttttaatygygatggggygagaaggaatygggyggtaggtttygtygagatggggagggggaggggaygggggggtygygttaagagtttaaatttattttgttatttttyggaygtygaagttgtttttttattygtygtygttttttygygtygygtttttygtatygygtygygtttygtgattttttttttatttttgttttttttattttaaatattgaaaygygggygttaggagtaaattygggtaygtaaayggagygttgtaaaagattgtgtttaatgaataatgaaatatgtttataygattgatttgattatttttyggggttgaggggggaygggygttttgttygygygttttattygtttattyggtagagttttgygaattgtttttagtttagtyggggtagggygggttygatttttattagtttttttttagaatygtttygt

SEQ ID NO: 6759 - DNA, 808 bp, synthetic construct
  misc_feature 1..808: note = Description of Artificial Sequence: Synthetic polynucleotide
  source 1..808: mol_type = other DNA
ygggattttttatatttygggtygtagygtattgtgygagtggagggggtgagttttttagtagaggygtaaggagggtgtagggtgygyggtgtggttgtgggttgyggataggggtygggggygygttygggtyggtgtygygtggtgggagtagtaggygygtaggtagyggggagttttygygtatttagttygygggtgattattatgyggyggtagttgttttyggygyggtgayggygtttttaattgattttattatttttttttygtaaggtgaagtgyggtygttygyggggttygggygygggtagggtyggttggtagtygygggtyggygggggtagygttyggtttyggggtggtattatygtygggygtygygttaaygaaygtaggyggygggaggttyggyggyggggttygygtttttgtatygygatygygttagaaaatatttyggggttgggyggygtttyggagaygtatttttttgttatttttatygtttttggtaaygattattaatgttattatgttttatttttttttattttttttygtttttagagtygygttygygygttygatttttaggygtttygttttttttggaattaataataatgatttttaattaattttttgttagggttgtttgttygtgaatggggygttttttyggttygygggyggtaggygttttagttygggyggggggttagttttygttttttyggtyggattygygggggttygtaattygttygggygtyggttgggggtggtttygtagttttttygg

SEQ ID NO: 6760 - DNA, 3415 bp, synthetic construct
  misc_feature 1..3415: note = Description of Artificial Sequence: Synthetic polynucleotide
  source 1..3415: mol_type = other DNA
ygggggtttttttgygtgtttygatatggtagtatggttgttgygtgtatttygtatagttygtgttgtgygtggygggttgtygttgtaatgtgtagtttattgatattgatggatgygttaatggttggayggatagatgttagggyggatygtatagygttyggygtttgagygggggagggttaggtagygatttagyggyggyggtyggttaygyggagattygagtttaggtygyggttygtagtgggagggggtygaaggaatagaggtttgtaagaatagygaggggatggaaaggaggagaaaagygygattagggagaattataygttttygtgtgyggygtttygygttgtgtataygtygtatygggygygtttaagtgggagtttygaaggtgagttgggagtyggygggagttgatttygtgyggygtaattygtttttaggygataggagtttagygyggttattagaatggtgaggtygtyggyggtgtyggttaatttatygttttttygtttgtaagaagygttttaygttttayggtygygttttttyggtttggaggagtagyggttttggtttttgyggtygygggtatttaaygygtayggygttttagttttygagttygttagttygagagtttygtygtagttygtttyggattttttgtttygtttggggttygtattttataatttygagygtttttgygygyggaaaggygttggaggyggttttatagtyggggaggttagyggyggygtatttgtattttgggagaygtttggatttagtttaagttygtaggttgggygagyggagatttttgattttatygtgtgggtgagattattgtttttyggtttaaaagaaaagaaagtatgttgtgaatttttgaaataaatttgtaaaaatagtygtagagaaaaaataaaaaggatatagggtagaaaaagagggagaaagagattaaaaaaagaaaaagataaggggagggggaaggaaggaaggagagaaggaggaagaagtttggggtttgttgttttaggagygtttaggtagtyggtgttggagygyggggygttygttttygtygggattgtyggtttyggggtttgygagagygttagagttttagtyggygygttygggygtagggtygtttyggggatagtgggttyggaggtygttttygygttttagtagtygtygttyggtagygttyggagtyggtttyggygyggtygttttattttyggtttgagagttggtttagggagaygtaatygagttygtagygtatygatgygtygtygttygygtygttygggtttyggttttygtttagtygtygtygttygggggtygttygtatgagtttyggtttattygygtttttatygtygttygtaagtgagttygygtygtttygtygtttaygtygtttagttagtttttttttgtygyggttagtyggtygggtyggttyggagttttagygatttygattattaattaataattaatttttttagtttagtagtttyggtaggtygggygygggatayggygyggyggttttttaggttttyggggggagtttttggygggggatgggtaggggagttyggtttttttttttygttttygtttygttttaggatyggttygygtygtggatggggggygyggttyggttttygggggygaggggyggggtggagggattttgattattttaaagttaggagaggaaatttgaaggaatttttttttatatygattttygggaygggtttaggaaagtttgttyggggaaaaaaaattgggggaagtggttayggygggttttgggggaggagttgggtggygyggggtttgagggttgtttttattygtttyggttygygttygttttttttttggagggggtttgttygtgggttttggttttttygggggaygttagtttyggttyggggattaygttgggggtttyggagtyggygggtggagaggagtgygagtygggtggggtagttggggggtggttggggaygaaygttgggtgggaataggggtggggggtaaygagygtttygggaygggttyggyggggttggygtygygttttygygtgtgygtayggggyggaggyggaggggyggtatttttttygttggyggggygggggttttaygygggtttggggtygggggygggggygyggygttttygygggygggygattgataygattattttttttttttttaagtttgtttgttgtygaygtygtygttttagtygygttaygggtagaagattggatygtygagtttygggtygyggyggyggttgygygttttttyggatgtygtgattttyggtttaggggygggggtyggggtagtatyggttygggtygttttygygtttttttttttatygttttgttygtttttttttygttttttagtttygaatttygygtatttygtttggggayggggygggggggggtagggtygtygttttttttygttttttttttttttggtttttggagygatttgttaaattttttatttygtyggtagygyggttttttttttttttttttattttttttttttttgtttttttttttttttygtgttttttttttttygagtttttttygttygttttttttttttttttygtaygttyggggttygyggyggagygyggygygggggggaygyggagagtttgggygtagtagtattttgygggyggtygtttttygggggggaggttgagagtaggttygtttygttttttygygggttygtygttttttttttttttgtttttagttyggtagyggyggyggyggyggtagtggtagtygtyggagaagtattatgtygaggaggaagtagtaggygtttyggygygtagtaggtaygagtygtttttttttttttttgtttttttttttttttttttttgttygtttygygtttttagygggygygatttygtttttygtttygtttttttgttygtattgagtaatttygggygtygtttttttgtttgggtgygtgygttygtttygggtatygggygtttttyggaygtttygtygygttttgtttttttttttttygtatttatttggggagtygttygyggagygygttgagtygygttaggtttttatttttttagtttttyggttgtagagggaatgggaagtaatttyggtttggttttttttgtgggtggygggyggggttatttgagtttttygggatatttttygygtttttygagyggtygatygtygggggattgtttggtgttygtygagttagggagygygaaygagtgagygagtyggttttttygg

SEQ ID NO: 6761 - DNA, 3415 bp, synthetic construct; identical to SEQ ID NO: 6760
  misc_feature 1..3415: note = Description of Artificial Sequence: Synthetic polynucleotide
  source 1..3415: mol_type = other DNA

SEQ ID NO: 6762 - DNA, 1592 bp, synthetic construct
  misc_feature 1..1592: note = Description of Artificial Sequence: Synthetic polynucleotide
  source 1..1592: mol_type = other DNA
ygtgttttttttygttgattyggtygtttattygaggtagtttyggaatttyggattttagttatgygygtagggaattgtygggtygagygagtttatygaagtagtttygygtygtgygygtttygagygttygttttagttttygggtgagygtttttagtygtygttyggtygygtttgggtygttttttyggttagggggtagygggagtgtaggtagygggaagggagtyggtttygtaggtttyggggagygagygggygyggggtaggygtygggygggaggaagttagygtaggygtyggtygagtttygggagtygaggttggaaaygttggagygggygttgtttatygaaggyggttygggatygggaygygggttygagygatyggagygygggttgtygtggygttggtygtagtttaggttgatgtygttggatygggygttgtygttatygtygtygtygtyggatttygttaggttggttygtgggttgttygtaggttgygygttgagtttyggaatygtygygygtyggggatttygtttttygyggtttagttygttygtttyggtttyggggtygtygttgtttttttttttgyggtttagygygggygtygtttygtttttaggtttaggtygyggttttygtygttttygatygggagagtygtattygggttttagttttygtagggttagttyggttaggagtagggtygtttygttygygttygttttggagygttgtatggttyggttygtyggttttggygygttattttygttttygtttttygtygtygtttyggtygggtygtygtatygttygttygaagttyggagttygtttygggatttttgggygyggggyggggyggggtyggygtygggtyggggtygtttyggyggttaygygygggtygggggaygyggygttttgttyggyggygygygyggyggaggaatgtaagtttttaggygtygggtygygtttttttttygtygyggtttygygyggggyggagggatttttttgygggggtaggaatgygaggaaggagayggygttgyggtttttggaatgtggggggagtggyggyggtygygttgygtygggatttyggaggggygtggaggtygggttaggaygtaggggygggyggyggaggtatygyggggagagtttagggtttgyggggygttygggtygtygggtygttgggaagagttyggattttygtaggttgagttggaggtagttggygttattygggtyggagagatttaagtagtygatagttttttttatatttygttttattttttttttttgygtygttttgtttttyggygttgtagggtygatttagtttagtttggaatttayggygtttygttygtttygygtttaggaatattgtgygtttagygtagatgygtttttaygattttttgtttggttyggggttatgtggtygygtatyggtttttgaagtttttatttgattgttggggaaggygtttagaattaggagygggttggttggggattggttttygygttgggtygtttygt

SEQ ID NO: 6763 - DNA, 903 bp, synthetic construct
  misc_feature 1..903: note = Description of Artificial Sequence: Synthetic polynucleotide
  source 1..903: mol_type = other DNA
ygggttyggttggtttttagtaggtttgtyggggtttttgtattttgtgttygggatttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttyggggtttggggagggggttgggtaggggyggaagygagttggagtygtgtttgtygyggygttgyggagtggaatagatggttggggaggggagagggtgygtggyggggaggaggaggggtgygggggtyggaggatagggaaygaggaatttygaagtttggagttttttaggagaagttttttttttygtttttttttagaaaggggggtatatatgygtttgtttttttttyggagagttttggtttttgttttgtggtagattttgtygygtaattttttgttttagggygygttttttatttttaaattttygtygygggayggggtggyggggttaggatygttaggagyggttygggtygygagggttaatggggtygtttttttaggggygaggaggyggygggaaaygggttyggggtggggaaygagttttgggatygt

SEQ ID NO: 6764 - DNA, 1592 bp, synthetic construct; identical to SEQ ID NO: 6762
  misc_feature 1..1592: note = Description of Artificial Sequence: Synthetic polynucleotide
  source 1..1592: mol_type = other DNA

SEQ ID NO: 6765 - DNA, 382 bp, synthetic construct
  misc_feature 1..382: note = Description of Artificial Sequence: Synthetic polynucleotide
  source 1..382: mol_type = other DNA
ygttttttatttttaatygygagataataygggttagaggttaggaaattatgttagtattaatgygggygtttaygagtgyggtggatygatgtggaagggtygggaygtagttygagttttagttttygtygtagygatggtygattttttagtygyggaygttgaaagygaggattttaygtygatgatttttyggygtattatgttyggygggygtttggttaaatagtttaagattgyggaattatattygttattgtgtatttggaygttatttgtagatttagygtttgyggggatttyggaaaygggagagygggttttyggaaayggtgattaatgggaaaygtgattagatgttattaggygaatagttygt

SEQ ID NO: 6766 - DNA, 665 bp, synthetic construct
  misc_feature 1..665: note = Description of Artificial Sequence: Synthetic polynucleotide
  source 1..665: mol_type = other DNA
yggggaagtagggtygygaaggtttttgggaaatgtagttyggygtaggaagtagyggaaygattygattttttttagtattaagttgygtttttaattttttagagttgggttygygggaggtygttygtgtaaaatttaggttgagtttttttgygyggagttgtgagttttggaatatygtggtttgttttttaggaygygtaaatagtgaagttagtttygttygggtgagtygygggggtttttgggaagygtygtttttggtgtaayggatygagatttgtggygtttttagttatygatagygtyggttttagtgtygtttttgttttagttygygtyggttttgttattttggtagygttaagtgtggaatyggggtttgtgttygygggtttggtggtgagttttygggaaatygttagttttgagygtyggattttttgtgttgggtgggagtgggggttygyggttttggtgttttaatttttggaggaggaygtygggyggggygatgtttgtgtttgtggttttttgaggtagtgggagtggygtgtgaaggattgtgagagtttggygtgaagtgattgttatttgttagatattygtttggttgagtgtggtttygggatygtgttygtaagyggatttygtggaggygt

SEQ ID NO: 6767 - DNA, 764 bp, synthetic construct
  misc_feature 1..764: note = Description of Artificial Sequence: Synthetic polynucleotide
  source 1..764: mol_type = other DNA
ygygggtatyggtttaataaggtgtagygaatagtygttygttttygttttaatttatagttttatattttayggtgttattgattttttygtatttagttatataggaygtggataggtatayggggtgatagtttygtattgaayggtattaatttttattygtatyggagttatatagatggtttgygaygagttttyggagatttataygttattttttagtttattttygatttgtagaatagaattggtggaagattttttttttgtttygaaggttyggggaatttgtattygggttttatygttatttttagttggatggaatttagtttttaygggttyggaaagaagygttttagttgttttygttttyggaggatataaaggggtygtyggtttaattttygyggggttygttgggaaaygtagttyggagtagaaaaggtygyggygtygtagtgtttggtagtagyggtgtagtttygygtagggtttgtaatayggttttttttttattaggtttttttatattggttttttttyggttttttagagagttygaaagttyggattttttgtagtttygagtttggttyggttatagggayggggtttagygttatattataygggttggtgtggaagtgygtaggtataagygttttgygygttttttttagtaattagggyggggagttgagaatygtaggttggtygtagggaaaaggtttgtgygtgggaaygygttagtggygygt

SEQ ID NO: 6768 - DNA, 1394 bp, synthetic construct
  misc_feature 1..1394: note = Description of Artificial Sequence: Synthetic polynucleotide
  source 1..1394: mol_type = other DNA
ygatgttaggtaygttataaaygtagatataaatygtaaagattttagagattygttatagttagygttagagttaggtattatygygtagttttttttgyggtattattttaatttttygttagagaayggtataygygtaygtagtagtttygtgtayggaaatattatttygttagyggttaggtattyggtttaggtaygygggggygyggyggtygttatttagtaaatattataggtagtaygygtygygttttggtttaggttygygatattggggttttttttatttaatttaygttagggttayggttataggtttagatttgaatattttatttttatygggattttgtagttaatttttatttttttttaaatttttygatttttyggtaggtgyggttttatattttttttttgttttttgaagggttttagygttygtttttygygygtttgygtattygaggtagaagtygatttttaaaggtttyggtgaggygtygttgggggyggggyggggttygtagttttygtttgttttygagtygagaattaaatgaaaaataaaaaggyggaatattgtttttttaaattttggatygtagtgtttataggggagtaggtttggattatttttaatggtattggttagttayggggyggttattataggtagaggtttgaggygagggatattgyggtttttttggtttygttttttyggttygattattttygtygagattyggttttaygygtttttttyggttyggagtagttgygggatttgttttygttttttygygygttagygtattygygayggagataggygttttttygtattttggygtygttgatttttagggttgggttattttttgagtygggtgaggttggggttgggagtygggygttattgtggtygttgtttttttgagggaaaagagygyggagtgggttaggttttgtaggtygggttaaggtggagaaaaggtttttgtggagttttaggtyggtgtgttttttttttygggattgagtttttgtagttttgaggtttggaggttygggyggtagtaattgtgtyggattaggttygtgggtgyggtttgtggtgtagttggagatygaggtttygygtattttygttygygttttagttatttaggttyggtygtagygaaaaggtttaagagggaagttagaggtgaaygttttaggatgaaggttttttgtaaaaygttgggatttagatttggggtgggtgtttggggtttaggaggataygttggatagtttygaaaagatatagtgggtggtttygggygtgggtaatygggtgyggaattatagygtattyggagttgygaatttagaygygg

SEQ ID NO: 6769 - DNA, 949 bp, synthetic construct
  misc_feature 1..949: note = Description of Artificial Sequence: Synthetic polynucleotide
  source 1..949: mol_type = other DNA
ygttttagygttttygagttatatttgtgyggtttatttaaygygatgtttggaygtagtttttagagaggaggtygggattggaataygtagtyggggaatggttgtaggtggtttagttttygttttygtttygttttygtttgggtttygtgyggtttygggtgygtaggtgaaagttyggttttagyggtttyggttttgttatggatttygygttyggygttttagattttygygtygygtygttygygtttttgggtatttygtaagtygaggtgttggaggaygtgttgygggagtagttygggtygttgttttagttggtygttgtttgtyggtttaagyggttgttttygggyggttattygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttygaggttttttaygtttttagtttgttaggagaatggtagtggttttttttttttgtattttygtgtagttgttygttggyggtygttgyggtggtygtttygttygttaattttttaggatttgtgtaggattygggtttgggaggggatagaggaggggttttgataattttaaaaatgtttttttgggtaggtgttttaaaagtttygygtttagggggtgygtttttattttatatygtaggygttggtgggtgtttgggaygygtagggatttttttygttttttttttttgttttttgtatttyggtttygaagtatataygagggtgaggagaaaggggggtttgayggaagtgattttttttttttaaagtaaygaaataygaygt

SEQ ID NO: 6770 - DNA, 1365 bp, synthetic construct
  misc_feature 1..1365: note = Description of Artificial Sequence: Synthetic polynucleotide
  source 1..1365: mol_type = other DNA
ygtttaatagtatygttyggagygtttatttttttttatttygtaaaaaaaaaaaatagggttattggttygggtygagagtygttttgggaagygtttttgttattaagygttatttyggggtgtgygagggagttaagggaygyggagatygggagtagggttgggtttttttgtagttttagygttggttttttgtttatygtatttaggygttgygtygtttttatatttatttttttttattttagtagygtgygggggaagtttygygtyggggttttttttagtaagattgtygyggttttyggttttaattgtaaggtaaayggtggtagagtttttttttattttagtygtgtgtgatttttatatttagtgtttttttttgtattggggygtyggtagtggygatttaggttttttagttttygtttagtttttygygtgygggygtygggatygtagtatttgtgaygtygaagtttagtaggtygtagaygggagttaygygyggttttggtatagggtaaaaatttaygtttaggtaggygggtagttaygatgtygggtaagtttagggtagattttyggtggygtatagggaagtagyggtttagaaggtygggtggaygtaggyggagttygayggttgggaggtygtyggygygtaggggtygggtttygttaggatggtttygatygagaaaggggattygaagygttygggagygyggggygtgttygggttagtaggggatttgggygtyggagagyggttagagygyggaggtyggattygagagttygagggagygggtggygggttgtttygyggtttggggttaggtatgaygyggtygttgttyggayggaygtaaggaagggagttygggagaagtgagaagattttgtaaaaggtagygagtaagatyggttgtttgggaattttttggygttyggygaaggtttttaaatttggyggggyggggtatggggyggtttttttttattgyggttygggyggggtttttaaagtttgtgagygttygttttgtgygaggtaaggtgggtatagtattaaagagtgtgtttttttttttttttygtttttaaaaatgtttattttggggyggtygtggggaggattttgagttygttggtgattttgggygaaatatttagttatygggtttygttttttttttttgtttattgaagaagggatgttygttttttyggggttttgtagaggyggagttgtgatttggagagyggtagggtagtgtttgyggttttggttttagttgattygygtygtttttgaygtagaagtttyggttagatttatttaggatygygygg

SEQ ID NO: 6771 - DNA, 2638 bp, synthetic construct
  misc_feature 1..2638: note = Description of Artificial Sequence: Synthetic polynucleotide
  source 1..2638: mol_type = other DNA
ygtygatagygaagtggtaggtaatgggaatttgggygggaagtaaagaattattaygatttatatygygtttaagtagtagtaygygggaatttggtatatagtaggtaggygtttatttaatatttgttatyggatttagtatttgggtagggagtttaggggtggagtggyggtttgggggatataaaggtttygttagtttttagttgygtttttygtaaygyggggggygggagtttagagttagagagagggggygaaggaattygtttttatttgtaygtygtttggggttyggttaatttgtttaattatygttttaaatgttagygggtagtatataataygygtttattaataggtttaaagtgtygtagygttygttttaaatgagaaaagtaggygataaaagggggaaaaagttaagttttttaatttgaagaatgttttgggtygtttygaaattatttaygygagtttaaaattyggagttagtttygtagaaaagttgaggtttyggtgygagggttgggggtgggaaygggggttgtgaataattygttaygaaaattgggttttttaggaattagtttgtagtygtttagtgaattyggagtyggaggataaygtygttaatttagttttttaggttttttgttttattgttagagaaagttgatygatttttaagaaggaaagygagatttttttaaagygggtataaatttaagtttttttyggtgtaggygaagaattttggaggttaaggaagattttagaggtggattttaaaattttaattygtaagaggggaaaagttaaagtaattttatttttatttaggtattggttagygtagtttygygttyggtygttagagagtagtttaatttygtaaataagttttgtttgggatyggygtagaaggttttattttttattttatggttaagttygggggygtattttgygggtygyggttttttatttttttyggygygttygaygggtatttayggtgygygttttttygggagataggggttygttggagaggtaygggttgtttaggttygggattattaggaaggggtatttagggtaygggggttttttaaagaaygygttgttttgaggtttttttattgygaataagattaaggygaggtgaggtttaggttttygggattgatagygtygyggtagggggttygaggygggagttggggattttagygttttttaygygygttttaygggggttgtygttaataaaggyggagggtaagggtgygtttatttaagtaagggggayggtgggtygttygggttgagtagyggagygtagygggaatygagagtggggggttgttttagygggtatatattttyggygaaatagtttygyggtttttggaaagtgtttyggaygggttgygggygttttttygtttgyggaggagatataaaggtaagagygggtgagyggaygtagggtygggatttttygggggtggtygyggtgtttttttattttygagttygagttgttgttttggtttttygattygttgattagggaygatttgatttygtttaggtttygttgygtygaggygttatygttgttyggtttttgtttttygtttttttygttttggaaggggattagttygtygttygtttygaggtygtttttttygtyggtygtttyggygttggagtygtygtttttttygttgtygtygtygtygtygtygttttygtygtygagttggggtatggtggggtygygggtyggggtygtygttttyggagtttttagtygttygygttttgttyggttyggttyggygtttttttygttygtttgygggttygttgygttagtygtygtaataaagtttgatagggygtggtttygygggaagygggttyggygttgttyggtyggggygtaggyggttyggttygggttttttyggtagygtygagtttagggttttttaattygttatygtygtygtttgtttygtyggggygttttagtttttggttygtyggggaggggygagyggggagggagggaggagggatygtygggttgggtaggggggtyggagggaggagtttyggttgtaagttgatattygygygtttygyggaattyggagagttgyggtgygygygtatatatatatatatataygtatttatatttatatgtttatattygtattttttaggggttgygtttttttgtaaygtgtatygtttttaatttttttttgygttttatattgtattttyggyggttttttttayggtttttttggagttttggaagttttgygtttattttttygtattttttaatttttttttaaagaatttttagaatttygygtaggtttttatttttttttatygtatyggygygygggygggyggtattgttttttgygggaaagtttyggaygtatatattggtygyggggttttttttttgtttagagttttttygagtgygygagttgatgtayggattaggatattggggatatttatggaatttyggaaaatgttyggyggtttttygygttttttttttgtggggttttaaygygattttygg

SEQ ID NO: 6772 - DNA, 1531 bp, synthetic construct
  misc_feature 1..1531: note = Description of Artificial Sequence: Synthetic polynucleotide
  source 1..1531: mol_type = other DNA
ygaaagttygtataaatygtatagaaaaygaataaatgtttttygaatgtgagygaatttatagtttggttagaaaaatttaatattgattttygtttttttaattatagaattttygaggagaaggggataygttaagygggtttgttaataatttttatygtatattttaaagygttgtaaattatatygattattttygattggaagtygatyggttgagattggaygtgaatttygygattygattataaaaggttaggaggaaagaggtagaaaagttaaaaggatgattaggtaggtggttygagyggttattttaagttaattttttagaaattattygtattgttygggttattttttttttaatattygtggttttatttattatgatgttaagaaaygtgggttaggaatggggtgttgttttttgttygaaatttggaggygtyggttttttagaygttttygggttygggtagaggggyggtaggggyggggygggygggtttygggtttgggygygygggtaggtggggygtggygggggygtggagagtttaggttygyggttatygtttygtttygggtyggtttaggaggagtygygtygggttyggttataagaggtyggttagtaggygtttygttagtattygttygatttyggttyggagtatygggygtttagygygggtgaaggyggagtygtagggttggtttttaaagggatgttttygttygagyggygagattagtttygttygtttttygtygyggtygygtygtagtygtttayggtygtygatatggttttttattgyggygataatttyggagtgtattygtagttyggtttgttttygttygtygttatygtygtygtttygggygttttttyggtagttagggygttttaygggttggtygattaygtygygtygtyggtygtygtygttaatttttatttgtggtttaaygggttyggygtgggaggttygtttttygtygtygtygtagtygtygtygygtatttgggygtttygtygtygtygtygtttttyggggtygyggtygggttttttttgtagttatygtttgtygtyggtatttyggttgtttttagyggtttttygygtagttygygttygtygygttygtttygttygtygygttygyggggttyggggagttgggttggttgtttatggttagtygygaggatttgatgaagatggtgyggtygttttattygtattyggygtttatygttatggttatttagagygygttygagygtaaatttatttttagttatatttattagttygtygtygatagtttttttttttattagygtagtaaggtyggttggtagaattttattygttataatttgtygtttaaygattgttttaagaaggtgtttygygaygaggaygatttaggtgagggtygttggtaggtgttttttagtyggggagggyggaygygggtygtaagggtyggygtaggggtyggtgtgygg

SEQ ID NO: 6773 - DNA, 2045 bp, synthetic construct
  misc_feature 1..2045: note = Description of Artificial Sequence: Synthetic polynucleotide
  source 1..2045: mol_type = other DNA
yggygttttygttttgtttgtatttttttttattgtttttttaygtttggaatgttttygtttttgtagtttgtagatagyggaaatygygggtgtaaatgtgtaggggtygttgatatgatyggttgtagaagtttatttagggttattygaataggttagygttygggattgtataagaggttaggygatgttgtgggtttttaaatttgtatagttgygatattttgygaygtgttattttatttttagtggggtggggtgggggatttttttygtagttygttgaaagygaggtaggaattattgtaatttttttgtttaggttgaggtygttatygtttygyggatgtaygygttgtaggggygtttttygtygygggtayggygygggaagggatggggtttggtgggagtgggtaggtggygggagaggygygtgttygtgtattagaggttttygtgygtgatataggtygatgagtttttgygggttgtatttaygyggagttatagatygaaaaggttagtyggtggtyggtgtgttaatatatatagagagaygttygttaggygygttgtaggttgggaygaggttaggagggtttaggttggaggagggttgaggagggttgygggggygggtttyggygtagggygttyggagyggagggggygggttygaggyggggygggtygyggygttgaygggttgtygtygttgtattygtttttagttygyggtgtygagygtaggyggaggtatatggtttygaygggaggygygyggygagtattyggagttyggttttttgtttgagtayggtagtygygttttygttygygygttttygttttttyggtyggtagttygyggatatgatygtgtagtttttttttgggttgggatttgtttgaagattttttttatggaagygatgtttttttagtaggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagttagggtyggygatgtttgttygggagyggtagtyggygttgaagaaggtaggtagyggggttgyggygttggtgggttyggtttttttatttgttygtygaggygyggttgttttatagtagttttyggggggtagatatggggagtattgttttttatattagggttttggatgatttygggttttttaggtgggggttatagtttgaggggygattgtggatgataaygttygatattayggggatatgtaggttyggttgggtttagaatygagtagggtgggggygggtgggttgtggttgggggttttgagggttgaggtgggggattttttttttgtattggtttttggtttttgggattttggtygggttggatagggattygggtgtyggtgtgggygtgggggtagygygtgttttttgttaaagttgggagagggatgtaggtgataatttgtagygttttatttygataaatayggtygttgtgttgygggaggatttygattygggttaggtttygttggaayggttttttgagtaagtgtaygtgggtygygggttgtyggtttttgtygtttygt

SEQ ID NO: 6774 - DNA, 476 bp, synthetic construct
  misc_feature 1..476: note = Description of Artificial Sequence: Synthetic polynucleotide
  source 1..476: mol_type = other DNA
ygggygataygttttgggagggygggttggyggtttttttagttyggagygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatygaggttgagaggttaygtygtgttgttggggtttttygtygattatatttttgggygttagttygggtagagatygyggggattggttaggtygggttaggtygggtygggggagggtygygttttygggtttttgattttyggyggygagaggaagyggtatttgggttatatttttttygygygggtyga

SEQ ID NO: 6775 - DNA, 455 bp, synthetic construct
  misc_feature 1..455: note = Description of Artificial Sequence: Synthetic polynucleotide
  source 1..455: mol_type = other DNA
ygtttttgtttagygaggatygtgtagaagygggaatygggtattggagggygygygyggtaygygtatttyggttggtattttttggtttygyggggtyggaaagaatttygaatattyggttttaaaaggtttttagttatttygttttttttattttttatagtatagatggggaaattgaggtttggagaataagygtggtatatttagggttatyggaagagtaatgagttgaattagagaggaggaaygggaagygagatttttaagtaatgyggggtggttttygggttatyggaggaggtatggtygggtaygtttttaagtttyggtattygtggtggttgtgttagtygatatgagtttttttttttttaggaaggygtaggattyggggaagttttygyggttaggtygtttgtttattygtagatttygggygtygttygygt

SEQ ID NO: 6776 - DNA, 749 bp, synthetic construct
  misc_feature 1..749: note = Description of Artificial Sequence: Synthetic polynucleotide
  source 1..749: mol_type = other DNA
yggggattygagttttygggttgaggatygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygygagagtggygttggtaygtttaaatttyggggtttttggttaggttaggggggygggygtgyggyggggtygggtygggtygggtgygtttagygggtttygggtataygttttttatttgggygaggttyggtgygtaggygtttagygygggggtagyggtygggygtttaagttyggygygggtaagagttggatagtttaggggtygygtygggtygagttgtygttygygttatttttatygtygtygttgttatygttatygttatygtttgggttgtagtagatygygggagaaygtttgygygaagtttyggtgtagttttggygggatygtagtaattatyggagygtgagtaatagtttttyggttggaggagttattgttttaygygttygyggttygygygtygaggtaagttttgggygtttagtttagatyggygttttyggattgggygttttttgtttgttyggttttygttttttttygtagagygagtttgtatttgggygygtygttyga

SEQ ID NO: 6777 - DNA, 1134 bp, synthetic construct
  misc_feature 1..1134: note = Description of Artificial Sequence: Synthetic polynucleotide
  source 1..1134: mol_type = other DNA
ygaggagggyggggygttyggtttttagtygygyggttatygtttgtttagtttggttggatttgagttyggttygtygatygttggtygaggygtagttgaagtagttttttagtygyggygtttttattttttaattttayggtttttgyggygygggygygatgtagttggttyggggtgaaggtaaggygyggggygyggggygyggggtattgggagygaggtattggygygggatgttyggygtaaggtgtagggygygggtygtttttttttygygtttttttatttygttaaagtttttttaygatggtttttatttyggttgggttagtttygtaattttygtttgttttttgttttttttttttttttygagtygyggggttttyggggygygyggattttygttaggggtygtgtaggygyggagttttagtyggtttgttttgggttygaagaaagttgtggtttggagttagttttttttttaygatttttgggggygtttttttttttttttgagttygygatgggaaggygtttttattttattttyggggtttttgagattttttggygaggtggggyggygyggtaggtgtagggttggggagggtttgatagttttggagagtgttygattttagttygtygtygttttttaggyggattttttagaggtaggttttagttttyggygyggggaggyggygygttttagaggggygtagggtgygygggggtygttggtttttygggtattttttttttgyggttttttygttttttttyggagttggtgtttgaggtygttgggattttagtttggygttttttttygtttygagygaggtaggtgtygtgggyggtttyggttatttttgtatttygagygtttattttgtatttagttttaagtyggagagttttggggatagtygagagtgttagtggttttatagggagattgagggttttgttttatttygggygtygtgtgggtttgggttgtttatagtatttttgygttttagtgataggagaagttaagygygaggttttttaatagttgygtgtattttattttttaggtatttggaatttyggygtttagaaygtgtttttygg

SEQ ID NO: 6778 - DNA, 1645 bp, synthetic construct
  misc_feature 1..1645: note = Description of Artificial Sequence: Synthetic polynucleotide
  source 1..1645: mol_type = other DNA
yggygtttttttttyggaaaggaygttggatttagggygygttagtaygygtagtagyggttygygagtyggtaggtgggtagtttyggygygggaggaaggggaagttatttttttttyggaagagggygttggtttttttattttgtttttataataaggttatyggaggagaggaagtagttagttgtygtttgygttttgtaaagtatgtagttaggggagtagtttttggtgagtttagtgaatttgtttggygygtatttttattygttggagagtgygygaggyggtagyggygggagygttggttatttttttagygyggttttttttttttagaagttggatttagataaagygtttaagaagtttttyggtagttttttttgygaggyggtgagyggggagttygtagtygttagygtaggggttttygyggttatgtttagtgatatygaygtyggggaygtatttgttagygttgyggtagtggttaagtyggggttttyggayggtygtaagggttttttttgyggggaggaggagttgtttttygtygttgtagtygtygtygtygtygtygtygyggttgyggttattgtgygttattttatggatagtttgagtttygagyggtattatttttagtttttyggtttttaggggtyggagttggttgygttttgtttatttttttygtattaggyggyggttggggygttttayggatttgtgtattyggtttttaayggggygygttatttttayggttttatgttgtttttyggyggttttttygyggttgtgtgtttattygggagggygtagttyggtttaggagtyggtgygggtagtggygygggyggtagtagyggygggggyggyggttygggtatttattagtatagttagggggtttygttttaygggtygtattttggagtygtagyggygggattttgyggaggattggggggtttgggggttttaggttttggttttygtgtttaygtttatttgtgtaatyggtttttgtggtttaaattttatygttattaaattgagatgattattaygaaatagggtaggtgagygtagygtggaggggtttttgggttyggggataaagggtgaygtgtggttttggggaaggttygggatgagggagttgaatttagttgtttygygyggtgtttagagtgttttatygygygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyggyggtatgtttgtgtatgtttgtatgtyggtaaggagttayggatagggaaggtttaagagttggttatttgagygtagtagatgggttttygtagttttaggygttagggtttttayggggygttttygggaggtgggtatgaaggttagagygtyggtttyggaagttyggtyggagtaggtggttagatttgttttggagttagatttggttygggttyggtgygyga

SEQ ID NO: 6779 - DNA, 4698 bp, synthetic construct
  misc_feature 1..4698: note = Description of Artificial Sequence: Synthetic polynucleotide
  source 1..4698: mol_type = other DNA
ygtayggattygygttygtattygaagattttataygtttttygtattgtttttatagtattttaygttygyggtgtaygtttatttgtyggtagaygagttataygtttyggyggtttagattttygtgtygattttygtgggygagtttaygygttgggtgttyggygygtttttaggagtggttgggatygygggttggygtygggtagggyggtgggaygtttggagtyggygggaggagtaygtttaggygggttygygtygagttygagygagygggygagtygggygggaggggttatttgtaatygagtagaygttattatygttttttattygyggggggygggggygggyggttaggtgayggyggtttatttttygtygtygagtygggtggtttttgttygggaggagttttttggygygttttgattggaattttygtygtagtggygggggaggggggataygtgatygttyggttaggyggttyggygygttttattygygatgggtattttattttttttttggaaaagtygggggatatagagaaggyggaggagtaygyggggtgtaggagagtttattagtttttttagtygtagtgttggtgatttyggtygttgaattyggagaggaaaggtttttaygyggttagtyggttttgattgttttttygttttgtttttggtygtagtatttttttttyggttgtagtaatygttttttatatttttaggtaagggtaygtttagtgtagattattgttattttatagatgttagtgttatttaagagtggtgttgggtttttttttttttttttttttttttttgtatattagtatattgtattygagagaaatttayggyggtgtattgtagatatygtttagttttagggttygaagatttttygattaggtttygggatgtttgaggttttttaggttattaygtggaggaatttaggtttgttttttgygtaggaggaggaggygtygygggagttgtagttttygattttttttaggaagtyggtygggtggaaggggagagggtygttatygtggtgygaatttaattygtagtttttgggagtaygttgttaataaaggttaaattaaaataattaagtggtgtyggtagggaygygtygtatggttaggagaagttyggttattaattatttataaggagtattgtttttttggtgtgggagaatggggttgtgygatagtttttyggagttgygttttgttttgaattttaagtttttttagagtaagtggattgygtagtttattattttatttttttayggtttttttttggggyggtattattttagatggtaggaattyggagaaaatgyggtgttaygttygtygttatgttygtataygygtttgygttaattttagtaataygtggggatygtgaatttgggygtttgttttttatttaggtggttatgtgggtatatttatatgattattgattaaaattaaattggayggagaagtttgtttttatattggatttttttaaatttttgtttaagggagttttgygttygatttgggyggggaygtagtttttagttaagatygtygtagygtttagtagagttyggggatyggtggtggtggtggygggatggggaggaatagaggtttttgattttttggtattttattttttttttttatttagattagtygggtaataygtttttygtttaagatggtttttttaattggaaygtgatttagataatgtggaagttaggggtttttgatttatygtatttgggtttygttgggtataggataagggttgggtaggtttatttggaaagggagtttattygtaaagtttygggtataaaygttagatagygaaattttgaggaagtttaaagtttatttattgtaaattggtggggggtgggggagtattttatgtaaaaaggaayggttttattaaattagtaagtattttattttygtagtggaygttttgttgtttttggttttttttttttttattttatttttttaaattattaaggttggagaaattttataaataaagtataagttygtggggggggggggggggggttatttggtgttttaaaaaaataataataataaaygatttttgtaataagaaaggtgggtaygtttttatttttaggttttaattttaaygttayggttaygttaaaattgaagttgattgagataagagaattttagagtatagtaygtagatagataattttataattaaaaaatatgtattttttttttttygttttygttattttttttttttttygttattatttattttygtttggattaggggttgggagaggaggaggatgtagttttttygagtgtataagggaggyggyggggttatttgttgttgtatygttagaagagttaatttygagyggatttggtagggagttaaaattttttttttggatgygaygttttagagatygaggtagayggygagaatagatttagygtttygagatgtgttttttaatttgaattttggattatttttgtttgaaatgttttgttttgtaygtttgggaattattttgtgygattaaaygygtgatatatataygtataygyggggtygtttygtaggggggagggtgygtggtataggagtttyggatttttaggggttttgtatttggggagtggtgygagggggatygtttyggtgtggttgttgaygtgagataggtaattyggaaaggttttttttyggttgttttggtaatgggaagttgtgggtaaaggtgtaggggyggtttyggagygtatayggygtagttygtagtgaagggtagtggtgtggtggggtagagagattagataagggtaggygggttttgtygatttygagtttattygtttayggggttaygttttgttgagaaaatgygygatattyggtagggagagagtgatattgattaagtgtttttggagggtygagtygtttgttttygggagggggtygygaggttygttagtattyggttttygyggaagttgtgttagygyggtagtttygtyggygtttggttttattagtttttgtttttagygtttttyggtggtatygttygagatttgyggagtagaagtygaggataygagtaattygttgtgggtttgaagtgattaygttttagggttgtgaaaagttgtttygtggtgatttgggtaygaggaggttaataaagtgtagaattagttttgatttttatttaaaatgaagttggtagtattgagygtttaaatgatttygttaggattttggaggttgtgggagyggggtgggagagggtaaatgttaggtttaggataatataggatatgtttaatttaaggaagttttttttttygggttaygttttttgtagttttatttaattggaatygtttttgtattyggggttattttyggtattatgatatttagygttgttttttaaattttaagttttygyggttatattttttygtgtttgttggtattagtaagagtttttgtttgtttttttttttttatatggatttttttttttttatttttagatygtagtgygattggtaggtattttttygtttttttygygtttygygtygayggtgggaatagtagygatagygygatygtagttttttagtgttttygttttttttttygyggttatattttatttattttattygttaaatttygtatttygtygtygttttttttttgygygttttyggygttaatttagttagaagygggtggaagttygggtttatgtgtaggtgtttttgtgygggagtaggggagtttataggttagygattygygattttattttgtttttagttyggggtttatttaygtggaattygtyggttttygygggtatttaatattagtttttygggttyggttgtygttttttygaagttttagggygtttttaygggttaatgattattttagtttttttttaagttagggtttggttagttgggaaattttttygttttttgtttatattttttggtattttyggataaagttattyggtttttygtttyggtatygggaaagatgygygtggagagygtttttaggygttgggttayggtttyggtttttggtygtgtttgttgtgtgyggagttggggyggygggtatygtttgygyggggtaggtattttattygtygtttttttagtaygggtattygatygtygyggygttgtaggaaggaggtttygtygygtyggtttttttatatttaygtgtttttygtgtgygygttttyggtttgtagatgttataaggttggygtygtttggattttygggyggttttatttttygyggtygttaygtttygttttttgtatttagtttttttggygttttygttgtagtatttaagattaggygtygtttttgttagtygtgttgtttagtaygtttgagggtygttgtyggtaggttttatttttygttygggttttttatttatttttttttttggayggtggggtttaagttttgtattggggttgttaagttatygtttaygattttttgtagggtgtagygggagggygttttygaggygt

SEQ ID NO: 6780 - DNA, 462 bp, synthetic construct
  misc_feature 1..462: note = Description of Artificial Sequence: Synthetic polynucleotide
  source 1..462: mol_type = other DNA
yggttygtaaattgattatgaaatataygatgttaattyggagttgtattttttagttgggtattttygygygttggttttyggggtttygttttttattttttgtttttttttttygygttttgtttttattttttatttttygygttggttatttygtttttttggtagtttttggyggtagygygttttattygttttygtgtttttttygtttatggaattaattttggttttatttgttgttyggtttaggttggggagaggayggagggtggtygtagygggtttttgagtgaattatttaggagggattgagtatagtattaattagaggggggttagggggtgygggattygagygagtaggaaggaggtagygtttggtattagggttttgatttaatagaattgagataygtttgtaatygttggygtgtttygygtataggattttagyga

SEQ ID NO: 6781 - DNA, 300 bp, synthetic construct
  misc_feature 1..300: note = Description of Artificial Sequence: Synthetic polynucleotide
  source 1..300: mol_type = other DNA
ygttgtaaaatagtygtygggtgtagtgggtygggygttyggttattttggttgygattatygtagttttttaaaggatgygggtagatgtagayggttttggtttatttgtttttaaaggtttgggattgtgtttgygtgtttygggagggtattygaaatttgggagtttttyggygtttttagtttygggtatttggggttttttgttttttaatagtattaattttgagaataaygygtatygaaggyggaggtttttgtgttttggataagttygttaygggtaagttagttyga

SEQ ID NO: 6782 - DNA, 554 bp, synthetic construct
  misc_feature 1..554: note = Description of Artificial Sequence: Synthetic polynucleotide
  source 1..554: mol_type = other DNA
ygtyggggyggggattattttgtagtaggagttygtagatattgtagaagyggagaayggygttgygtttttaaattatggttttttttttaaagggttggggaaggaaygagggggtaagtagatgttggtgagyggggtaygagagtgtagggtttygttggtgtttttttttyggygttygtyggatttatygtttttatygttgyggtgttygaattygyggattyggatyggyggtagtagaagyggtagyggtaaagtattygtagaatggggtatygygaaatagttttttttttttttttttttgttggtggtgtagtygygatagttygttttttaggtaggggtttggagtttgtttttttttyggygygtatagtaagttttagagttygtyggggttgttygagtaggtggtgtagggatgtyggggtgttggagaaggtgygggygagggttgtaaggagtgggtaggttayggaggggaagggttgggggagaggaggagtaagtaagtagtattgtygttygygttyggggtgtttygg

SEQ ID NO: 6783 - DNA, 1153 bp, synthetic construct
  misc_feature 1..1153: note = Description of Artificial Sequence: Synthetic polynucleotide
  source 1..1153: mol_type = other DNA
yggygtatataagttgaggattgtygaggygttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyggtatagyggttttttygtttygyggttttygttygtygagaygtggttttaagaagtggtgtygtagtyggggtagaggyggaggaagtygagtygggtaagtygggaaggttgyggagaygttttgtyggggtaggtgttgtagttttagttagyggtttttayggagggggygg

SEQ ID NO: 6784 - DNA, 1603 bp, synthetic construct
  misc_feature 1..1603: note = Description of Artificial Sequence: Synthetic polynucleotide
  source 1..1603: mol_type = other DNA
yggttygtagggggtgtttyggggygttttttgygygaggtttygggaatagggtaygagggtttaggttgtttagttgtaggtgtagttgtttyggaggaggaygttgtttgyggygtyggggagtttttygyggttggaggygaggggaattgtatttattatagtgtttygtttgygygaggattatttatttgggtyggagagagygygygygygtaagagygagttygggttgtggtttgggggaggggagygagggggyggggagygttttatygygaggaygggggyggggayggattgttaggtggggygggtagttggggyggttygaggatttttttygatttaagtgggtatttgyggagttaaaagtaggggaggygttgtagttgtgaagaggygtgggggtygygggaatttttttttggtyggtgygatgaaagtygggyggaygaggtggtttaayggggttgagagtggttyggtygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygygygggtygtttaaatttgattagtagagygagyggtttagygtagtagtygttttygyggtttttagttgtagaaaagtaaagygtygggaggaagtagtagagggggggttatatgaggttggaaagtggygggtgtayggygttygggatygtygaggtttttgygtygttttgyggaggtgatttygyggtggaggttaygagtatygtygtagttttgaygttgggatttaggggttttygagygtttayggygtggtggygtygggtygygtttttttagtagtttaagggtygagtggygygtggttatatttatagtagygtaggggygtygtgggttgayggtttttttygygygagtygttttttygyggtatttatttttttttygygttygggtttttyggaagtygaggygygggttatttggtgggatttygyggttttygttttagggtyggggtaaygyggygtgttgattgggaggattttyggygttygyggtttttattatttygtttygyggyggaggygggygtttagggtagggayggagttyggagygttgtagagttyggttaagtttagttttttttyggtttggtagtygyggttyggatgtygttagttyggygttagagggggttagtygataataaaaatgtttgtatygttygtaggtggaggyggtttattaggttaggaatygaaaggagggagggatgttgttaggttaaatttaaygttttggttaagggygygttaaggaaatygtatygt

SEQ ID NO: 6785 - DNA, 1411 bp, synthetic construct
  misc_feature 1..1411: note = Description of Artificial Sequence: Synthetic polynucleotide
  source 1..1411: mol_type = other DNA
yggttttygttattygggtggattttgtttatygygagyggggaggyggttgtttttygtgtaggattttygttgagggtttataataagyggttttaagygggggtatatttttygttattttygyggttttttaaataaataaagaagttaaagtyggttgttttaagattaatgtaagygtttaggaagttttgaggygtttgagggygaggtaggttgtygtgggtaggtgtgaatattttagttttygyggygggtttggagtygtttagygtaggaagagggtagaagtgggttygygtttatgygggtattygaaatgaaaaagagttgtaaayggtataaaagttygggggttaggygtaggaaaatagagtaagggagttgttttagtttttaaatattgtatatggatgggtgtttygyggaagattattttagattttgtgaaagaagtttttattgggygtyggttayggtattggggtgygygtttgttttgygagaagggttttttaggtygygygggggaaygtaggagaygtttgttttygggggaattagyggaggattgttttattttaaagtgaaaatttgtaggttttgggaaaygatatttaaaaaagtatataatttttatatgtygtttaatggaggatttttataatttatagyggtagataaggttagagggtgtaataaaaaatttgaagttttttttttttttttygtygttttttyggaattgtattttgggtagyggagtagaattyggaatgtgaatttttttygatatatgtttttygtagataagtaaataatttggaygtgaaatggaaatggtaattaatgtagtaatgttgttatatttygagtgtgtaaattttattgattygtygygttayggggggtgtygggygtayggggatyggtggygtgygtttaggttgtttattttttttttttttttttttttttttttaggttttygggyggggygtttagaaatttygtagggatgtggaygggttgygggaagtaaggagttgtttaagyggygttygggattttyggttttyggtttttggaggattgggygggtgttttgygtttgtttygatagtygtattttttatttatttttttyggttattatygtygygttagygttagtagggttttttyggggttygagtgtagttyggttttgaagtatttaggagagtttgagttygggygatagaggtttggaggtagagggaatttttaaatttagtgyggygggtggttttgagtgyggyggttaggttttttttttttttttgtttyggggttaagtgttgtygggttgtttggygagagtttttttgaagtttttttttattttygtatygaaagygttgatygt

SEQ ID NO: 6786 - DNA, 2629 bp, synthetic construct
  misc_feature 1..2629: note = Description of Artificial Sequence: Synthetic polynucleotide
  source 1..2629: mol_type = other DNA
yggtagtaaayggtagagtaaaggagtygtttttttttatttgaaagtygygaggaggtttggagygttttttttygttggggttygagttttttgggttttggtygggtgygggtagattttatyggggttttygttattttttagtttagttygtagagygagtatyggtagattttaagggygygtgagtttggttgtyggttgggtttttgaggttygttgggygggggtaggtyggtttaggttgtgyggggygtttataaaaagtgatttggagatgaattygttygtgygyggttggtygtttygttataggggygaaggygtttgaygtaagyggaattyggtggagtttataygaattagaatagagygaggtttttggygtattagggattttaggaggtagtttygttagagaygygggtygtgtttygggaaatyggggggyggggggaggggaagagygtagaaaagaaaatttattaaggyggggattggtttgagyggggaggggyggygaggtyggagtttttttttgttgggyggattttttatggttagaggttgagttttattttygtyggtygttttttaggggaaggggaaggagaggggagagtagygataggtttttagtaagtaagygygggyggtattygtagtttttagaagtttgagatttggtygtaagyggattygtgygttttaattttttgtygygttagygtttggagyggagagtagaggyggttyggtygyggygygtyggttttgttatgatggttagttatttygagttygaggaygyggygggggttttgttggttttagagatyggtygtatagttaaggagttagaagggtygtygtygagtttaggtaagggyggtgggggtggyggygggatagtttyggagaagtyggattyggygtagaagttttygtattygtaygtggygtttatygttatggygattygygagagygyggagaagaggtttaygttgttyggtatttattagtatattatygygaagttttygttttaygagaagaataagaagggttggtaaaatagtattygttataattttagttttaaygagtgttttattaaggtgtygygygagggyggyggygagygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyggttgtagtygygggtttyggtagttttggygyggtygttgtggttaaggggttggygggttyggtygtttygtaygggtygtatataygygtgtagagtatggygttgtttttyggygtagtgaattygtataatggtttgggaggttygtyggtygtattttygttttygtygtatttttattygtattygtaygtatattatttgtaygyggtygtygtatygtygtttgttttatygtattayggggtygtygygtygtygtygggttagtttagttttgttagtttagttatygtygygttttyggygttygygtttattagtgygtygggtttgtagttygtttgtgttyggtagttygagttygttatgatgtattgtttttattgggattaygatagtaagatyggygygttgtattygygtttygatttttgagagtttatygtatgtyggtgtagayggatgygaggatgtagggaygygygaygtyggtttyggtygtagtygaygaygtygtygttagtttgattttatattttttgggttygtttttggagttagygtttagggtttttttgtgttttttygtttttttaagtttttgtygtttttttttgtttttttagtttatgtttttttgtgtttatttttttgatttttgtgattttgtatttttttggtttgaagttgtttttttgygygttttttattgggttygttttttttyggagttttagygttttttgtttaaatttatygyggaaagggttyggggyggaggtgygatygggygtyggtagygtagattttttggtttttttttataggtyggtgygttygtttttygygtttttygttygattgtygtgtagtttatggttagaygygtyggataggattgatggygggatygygttgttygagaaagggayggattaataygtgtgtttgtttygygaatttttttgaagttgtttagaagtygtttgtygyggggtttattaggyggggygggggttgggatttagygggagtyggggtagtttggttttayggtttgtattyggtttatatygygggygggygyggagggaggttgygtttttttygttattagtttygtygtttygggtattttygggtttyggygg

SEQ ID NO: 6787 - DNA, 1686 bp, synthetic construct
  misc_feature 1..1686: note = Description of Artificial Sequence: Synthetic polynucleotide
  source 1..1686: mol_type = other DNA
ygaygtttttaggtagttgttaaagttyggggttygtyggtttttaggttygtttgatagagttaggygttygtttggatttagttttttttygggygggaggygyggggaggttaagttttttaaaggaatagggtgggtaggggagtggtgttaggttaggtttttyggttttyggtagttagagyggagtaggaaaggtagyggggagttttatatttygygtttttttyggatttygtygtttattyggagggtataygtttttyggggagttagagaygttttgggggagtttgaggagtgttagyggggttttttttggagtttataagtttttattttattttygagttgggagataagttatagttyggttttttttttgaaagtatygtygttgattttttttttaggtaggagtagatatttgtttgtttttayggygygttagygttttgttttagtygtttttgggttagagttygaaatttatttattgygtttttatttyggtatagatagtttttaaagttgttygtattttttagatttygttttttgtttagttttyggatttygtttaggggttgagttgaygttygygggtggatttttttggttygttgygtagggaattgatttygggaatttagggygtatagaggttaaagaagttgyggtaagggagggtgggtaaatttagtttgagtttaggtttttgtygtttttatttttaagtttgttttgttttttttttgggagaagagtaaatttttttagtatttatttttagtygygaggaggyggygttgtyggttgttttygttatygtygttgtygttttttaygtttagygttagtaggagyggtatttagtatagtygtttaggtagtattttygtagtagtygttaaygagttgtagtygtygtttattgttygygtyggttttygtttttyggtgtttgtygtatygtgggtygtttygtygtgttygatgggtgygtttttagygttgtygtygyggygttyggtttygggttttygtygttgygtygttagttygtyggtagtagtygygtttattggygyggattyggagyggtttaggygtttatttygggayggttygtgaygttayggagggagggaggtggttygtgtatatttatgaaygygggtatyggygtygggtttygygtttttygttttaaggtttygatttttaattttttttagtygtttttaygtttyggggttttgtttaggtttttttgtttagtygggatygggtttttagaggattttggtgggyggtttyggagagttttttagtttygygtttttatttygattttyggaaaagttgtygtaagggatggagggtttttttagaaagtggttattygaggtttgagggttatttggggtggygygagggattttgatttgttatgttttttgaattgatatttgggyggagaggattgaygggygtygttaagggttttgtttttggttgggtttttgggygttttgygtygattggtttggggagggygttaggygtatattagagtagygtttagtggtgttaggggttgtygggtagagtagatagttttggatttggatggtaatggtagggtttygygttattttygagaagtaggggtagtygygg

SEQ ID NO: 6788 - DNA, 1686 bp, synthetic construct; identical to SEQ ID NO: 6787
  misc_feature 1..1686: note = Description of Artificial Sequence: Synthetic polynucleotide
  source 1..1686: mol_type = other DNA

SEQ ID NO: 6789 - DNA, 2132 bp, synthetic construct
  misc_feature 1..2132: note = Description of Artificial Sequence: Synthetic polynucleotide
  source 1..2132: mol_type = other DNA
yggttygaagagttggtgagygygattatagggtagtttgyggayggttttttyggataggataagggygagggaaayggtagaatggtgaygtatttgagtgygtttattagaygaaagaagattaattaagttttygtgtagtgygtagataggtygatatatatatatatatatatatatatatattaatatataygtaaagatagtgagggagygagaggygtatttttaggtagttgataatgatayggtttygattyggaygygggtttaaagtttttygattttyggagtgttttttttttyggygattttyggagattatygttggygtattttttygttttgttyggtttyggygttttttttttttttygtagtygtagtttttygtttttygygaaygyggttttttagtgttttttagaaygttygygtggttgtygggtttygaattttagggtygattttagtattyggygygygygtygtygygtygtygattagtttgyggttttygtattaattattaayggggyggttygggttgyggyggttygaggagggggatggtayggaattygagataggggataattttatttttygaagyggtygygaaattttagtttgggaggttttygttttttttyggtgygttygttttttttttygygtttyggttygtatatttttatttttygtttygggggyggyggyggyggaggtattygtatygygygatgtttagttatygttgtygygttgtygtygtagttagtygygtygtygtygttgtygtagygygggyggtygygygtyggtagtaggggtttggygaggaagtygttgagtttygygygtttygygtttttggyggtygtagygttgtttattaattgatttttttattgatttatttaatttttaggagyggttgttyggaggtaygggtttttttttaaatttgtagygaygttttyggygtgggtataaaggtttygayggyggtyggygggggttgtttagygttygggagtyggygttagaggtygtttgygygygttttagtygagtttygggtattatgtygyggygtttgtagtttyggggygygggtataaaaggtttttyggtttyggtttyggtagtttygggggtygttyggaatttttattttgtygtttttygggattttttagygtttgttaagtygttgttgygttgggaygaggtgttygaygatttygtggagtgttttattttgtygggttatyggygtttgtygtgtayggtttaggagtgtttagtttyggtgttgaagtttattaaygagaygtttaatttttggaygtattttatttygttgttgttgtttttgagtaagttttgtygtttgttttttttgagyggyggygaygtgtttttttattattygtggttgttatygttgtggtgttaygygtygggagtgttgttgattttygttatgagttgtayggygtaygtgtttagttgtttgtygttgygtttgygygtygtttttttttatttggattaygygtttattagttattayggtttyggtagtayggtggtttattattattatttgttgttaggttttagtttgttggatgttagagttatgattttatatttgtagtagygtttgggttggtaygtggattgtaygygttttatygtygtttatygygttttggtgttgtttgtggttttygtgttggyggtggtttgtattgtggtttgttgtaagagtygtatygattggtgtatttattygttygygttgygtattttygttttygttatgtygtttagtatggtttgttttattatgttygagagttggtttttygatttgygtggggagaattttatatttttygtgtatttttatygtygttatttttggttggtggtggtygttttttttaaygtgagtaagattttygagygtatttagtygggttttttygatattatyggttatagttattagtttttttatatttttattttttttagtatttaygattaggtgtattaygtagaagagggtttgygttagtttttttaggygtygtttgtygtatttattttttygg

SEQ ID NO: 6790 - DNA, 2954 bp, synthetic construct
  misc_feature 1..2954: note = Description of Artificial Sequence: Synthetic polynucleotide
  source 1..2954: mol_type = other DNA
ygtttagagygtggtagtttgyggggtygtttaygtttttttttttggygttaagtttgtggttygyggtttttaagaagggtatgyggtgagttygygggtttyggttgygtattatttgtaggtttttayggatgaggtygtggygygagyggattygtgaattygttatygygyggggattaygtattaagtggatgattttgaggtttagggtygggtttygtagtagtggygttaagatygttaygtygaagaygygtatattttttatgattagtgtgyggtatttgyggtattttttttygaaaygygttaggygttgtggygggtattttttgtataygyggtygtttattaattttaygatttttttgyggtaggyggggtagagtggtgaygagtatattattttgttggtggttgygtygaagatgtttagygtggtgaggttgygtttttygttgttygyggggttatataattggaagatagagaggtygtagyggtaaagagygtttagtatgtttygygttgttttttgtagggaaayggygtttttyggatatagtttttgttatatatgttatattggttygtagagaaagaatatttygggattttggttgaatagttygtygaagaaygaygagttagagygttaygtggtgaataygtatattagttgtygtttgttttygaygttttyggtgtttygagtgttattgtttggaggggtygtaattttygttatttttgtygyggttgtaggagtygtttygayggyggtagygggagggyggtaaggagtgyggaggtttaaaygggtatgagtayggggyggttyggtyggaggyggttttgggygtttttagttgttttyggttgttttygttgyggtatttagyggtttatyggggttgtattgttgtagyggttttttgtgttatttgtagtttaggaggttgagtatagtgagtattagtagtagtgtatagttygygtataatattagygtttttttayggaatatttttatttygagaggggaygygggttagyggygttttgggygtyggggttattgygggagtagggtaygyggygyggttgtaggygtagtttggagtagtygagggagygygttygggggtagagttygttgygggttgyggtttattataggtataattygggtyggyggygyggyggaggtagttttgtagttygggaaggggaygtagygggttggttgttggygtygggattygggtygygatttygaggygggygyggyggttggtttttagygtttaaggttggtttttttatggtagyggtttygggtaggatttgygaggggaagyggagtgagyggatgygttttaattttttttttagttttttttttttaagtaaygtttattttyggttttgttyggttttttygtttatttggagtygagggygygttygggagyggtttyggattatygttyggyggattgttyggttgttattygtttttygatttygttttttttygttttygttgggggttttygtattttygaggggtttggggagtyggtygatttatttttgggtagttttygggtagygggygttttgyggttygggaagaaaaatttttaygyggtttagagtttygtttygygtttygtygaattyggygtttttyggttttagygaygtttttttygttttttygggatygtagttttttgtttygtttaggggaaygaagtyggttgggggygatggttgggggyggtttatatgggatttagttttyggtatagyggygtagtttttttygttttyggttttygtgyggygaatttttttatttttttggtagyggtggatggggtatagygygatttygtagyggyggyggyggttgtttttattatygggaggatgttygggyggatagygtaggtaattttygtygtttygtagttttygattggattaaaggatttygaatatatagttttaggtaaggaaatttaggtgtgtagtattgttygattygatttaattygttttyggtattagygtttttggttaaygaggtatttaagtaaagaaagatttygtygtagtygtygtygtygygygaaagyggygtttaggaggatgttgttattygattttttttaygtygggygttygtaaygygttyggattagtttttgygyggtttttgttagtyggygttyggttggtgygygtygtygtttgtygtygyggtttttttttttygtygygtagtttttttttttygtyggtttygttttygtttttaaygtygagtyggtttttatygtygttgygtttygggggttggagaygygattygttttatygygaygygygggggttgtagtttaygggttygaaggtttagttttgygygtaaagygtygggatgygaaygygggatttggagttygtyggtgtygagagttgttagagagttggattttgygtgtagttgtyggattyggttttatgtttttgtttttagaaagagttggtgatgaagtttgggtagaaattttttgtyggtygttygttttaygtttttttyggggtygatattgttaattttttygggtattgaggatatttttgygttttggagyggtgggaggaygyggagygtygttttttggttttygatattttgttygttttttttagtgggtttgtggttgygttttttygaaggaagtaataaatttttttgattttgggggttagaggagaygttttagtttttyggaggggtgtgygggygggatygttttttygttttattggatttttggtyggggttgtttttgttttattgtgttttatatgyggagtttygatgtttttygtattttygttygyggtgttgygtttattgtgattgaygt

SEQ ID NO: 6791 - DNA, 2954 bp, synthetic construct; identical to SEQ ID NO: 6790
  misc_feature 1..2954: note = Description of Artificial Sequence: Synthetic polynucleotide
  source 1..2954: mol_type = other DNA

SEQ ID NO: 6792 - DNA, 885 bp, synthetic construct
  misc_feature 1..885: note = Description of Artificial Sequence: Synthetic polynucleotide
  source 1..885: mol_type = other DNA
ygttygtygtttttttgaggttayggygtaggagagaaggagggygyggaaaygtyggtatyggttgggaagtttyggtgtttygggttttttttggygagggyggagaagtyggyggtttttgtttagaattttgtgattgtagggatygagatattaagggygggggtgtagaggattataagttttttagygygttttatttgtatataaatgtgttttgttttttaattttgtttttgttatttgtgtatttgttttttattaaattaattaattattygtggtttaggaagaaattagaattggggggattgtttttttaagggggatatagttgaaygtggtyggtagtttttggtttttygggtttgggtttagayggatttyggygttgtttttaagatygatatygggtatttggtygtyggygtatttaggagtaygattttatgygtgtgtaygttttttgttygggttaggagttttgttttagttttatttygggttataaatttttggtttygtttagygtagtttyggttyggagggtagtttgttagttaggttttgggttagggatggtttayggtgygygyggggatygttatattttttagygttaygttggggtygygygggtyggagtagggggagggggttygatgaygttatggaatagttggaggatttagttygggaattygtyggggagygggtttyggggtyggygttttatttaggtygatagygtttygggttyggttttatttttttagayggtayggttgttttttaygtttagagygggtttggggttttgaaggaaattagtgtaygatygygaggttaggaattttggagaatgggtaygtaggygtgygt

SEQ ID NO: 6793 - DNA, 2174 bp, synthetic construct
  misc_feature 1..2174: note = Description of Artificial Sequence: Synthetic polynucleotide
  source 1..2174: mol_type = other DNA
ygygttgtgttttttagygttttaggggttyggtttttagttyggttttatttgggygttttttygttttttygtgggtyggygggtygtgygggaggaattttggttgtygygggttttgygttttatttgttatttyggtggttttygttygggtttygagttttttgyggagttagtattttagttgagttagtyggaggggyggyggyggtttygygygtttagagttttagtttatgaatgggattttattttgagygttttttttygggtttggggaggyggyggygyggyggyggggggygtttygtaagttygyggttttgagyggttattygygtagtaagttgggygagttggtagtygtttgtatttgttttttggtttyggtttttgatttygttttyggttttaagygttygggttgygttttyggttgtttygygaggtagttttaggaggtttaggggtttygtttgygtttttggygttagattatggtgggtagtttyggttaggagttttagtygtygygagttaatatygtttgtagttagttttygttttattygagyggaygygygggtattygtagygygygggttattttttttttyggtygggatgggyggygygggattgagtgatyggttttgygttyggygggtaatttttatttgatttgttgtttgtgagttgttgattgtyggggygygygagtttagggggtaygggtagtagygyggygatgatttgatttygagttygttagggygtttttttttttttttttttttttygttttttttgagtttgtgyggagattagttyggtgyggyggtttygggtggattatggyggggagttttagttaaaggygtgtgggygtygagttggagaggatattttyggtatygttgttttttgagggggtttatttaaattattgagttattttagatttaggattttttaaataattattaattgtgttygtttygtgtyggaaagtaagyggaaagagaaagagygtttatttttgggatttygtagatygtttttygttggttttttttygaggggtgtttggttttygaggatttttttttttttttygygtttttttttttttttygttttttgttttttttgtagtgttgttggtygggagttgtttttatygtagttggaaatagttgttttygtttygygtttttatttagatttygggtaatygtttttatttygygtttttyggaattttagaattygggtggtyggtttttggaaagtygtagtyggygygatgtattttgtagattttattttgttgggayggattttttaatttttagaatygygggtygtagggagttaaattgttgtttttttttttttttttygtgyggttggtggtttgttttttaaaggaaygttttatttattttttagtattttttatygggggygygttattygtttgggtttagattttgttttgtaaaygggttttttatgtatgtatgtgtaggtatattttggatattttataaygtttgygtttttttaatagaggtaygttttgttattttgggtatygtttttttttttttatttggtatttygaaygtagtgtgattaaattttttattgttttttggaygtygatygttttggggtgtaagtttggggtgtaaaygtttatttygtaagagggtttgggatygtttygtttygtttttyggtygttagaggttggggaagtttatatttggatttttatatattttgtygttattgtttagattttgattaattttgtgagygtygggttttygatattgtagtttttttaaattttagtattgttttttygygattgttttttttttggtygtttaggttttgttttygtttyggyggagygtaagtyggagggygtagtagaggttggggtttgaggttttygttgagtagttatggttgyggygatagttagttttttgattyggtagaagyggtaggygagggagtttaatagygatygagtgtyggtttttaagygtygttttagttttagtaaagaygggygttttttgtgygagaggtaygttttyggggtgtttagtaaagtgygtttttgtagyggtygtaagaggtyggtgaggygg

SEQ ID NO: 6794 - DNA, 873 bp, synthetic construct
  misc_feature 1..873: note = Description of Artificial Sequence: Synthetic polynucleotide
  source 1..873: mol_type = other DNA
yggtygggtttagygatgyggttgagttgtttattygygtttgttgaatyggttaattagyggygttttyggatttagygggagygtttttatgtygatygyggtaggygtgygtttttyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttygttyggttttyggtgtatgtggtttgygaggyggtagaggagatgtggggatttagggtygtaygtygtgttygaggtttttaygagaggttttttttygygggtttttgygtaattgygtgaagtyggttygggaaagttaagattgtggtttaggaagaggaaggaaygygggygatagagttggggtttgggaygttgagggggtyggtggtagtttttygg

SEQ ID NO: 6795 - DNA, 2174 bp, synthetic construct; identical to SEQ ID NO: 6793
  misc_feature 1..2174: note = Description of Artificial Sequence: Synthetic polynucleotide
  source 1..2174: mol_type = other DNA

SEQ ID NO: 6796 - DNA, 510 bp, synthetic construct
  misc_feature 1..510: note = Description of Artificial Sequence: Synthetic polynucleotide
  source 1..510: mol_type = other DNA
ygygtagtyggagaggagggggyggtattygggatttggygyggtttttgttttttgygttagygtgagttyggttagggtttttayggtygtgtttttattttttagggaggygtyggtgattyggttatagttttagttttygtygttttgtgatttgygggtattggatgattygtagttgagatttygttatatttttgaagtggggaaatggtgagtgtgggggtagggygttttaaggttggggaggttttattygaatyggygggaaatggyggyggygggayggagtttgygaayggagttttygttgtygtygtttagtttttagtttttggtttttttyggtgagggattygggtttatgtyggttttygtaaggyggttttggtttagtttgtagttttatttgtgtagttttgygttygtagtttygtattttttttgggttgtggggtgaggaggagtttatygggaaaaygtttgygtggygtgygaggtgttygt

SEQ ID NO: 6797 - DNA, 511 bp, synthetic construct
  misc_feature 1..511: note = Description of Artificial Sequence: Synthetic polynucleotide
  source 1..511: mol_type = other DNA
ygttttgattyggtttgggygtaagtaaatttaggtttggtygtygggygtttgggtygygttaattygtttttttttttttaygttygttyggtattttttggttygttaagttttagatgygggtgtttgttttagaaaattttyggyggyggttygtattgagtatgttyggyggyggggygggtttggggttyggaagttttagygattyggyggtattygtygttttgaggtagygggtttygataggygatggatttttygggttttygggggygttttaygtgggtgttggtygggggttttttggtagtggttttggygttggggggtygaggttgtttyggygttagtttaygttttygttggygttttttyggygygtagttatttygggatttttaggtggtttttaggtttgggttyggtttgaggattttttyggggyggagyggggyggggttygagagtagtaygtaggtaaggagggttygattttaggtttygg

SEQ ID NO: 6798 - DNA, 417 bp, synthetic construct
  misc_feature 1..417: note = Description of Artificial Sequence: Synthetic polynucleotide
  source 1..417: mol_type = other DNA
ygtygttattttttttttggagtagaaggggaattygaygtttaagyggttgygtgygaagtttttaattaggtttaaggagtygtagagtyggggtttygggttygtaggatttagaagttaygygtttygygtttttygtttygtygttgtttgttyggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtygtttygtygtatttygtygtttgttgtatygttttygttagggyggygaygygg

SEQ ID NO: 6799 - DNA, 1748 bp, synthetic construct
  misc_feature 1..1748: note = Description of Artificial Sequence: Synthetic polynucleotide
  source 1..1748: mol_type = other DNA
ygygggtyggggagttgtattttttgtaggttyggttttyggtttygttttttagygtyggagttygggagtygyggttgtagtttatttttttaaatgatagttgaggttygggttttagttyggggtttgaygttagtgttttttttygtgttgttaggagtagttagygttatygtyggygtttyggtttygyggtaygtttgtaagttgtyggggyggygagttttttttgtttyggttttttttttygttttttttayggagagtygagtagtagttttagagtttttygtaagttttttttatattttttygttttygttttaaaggagtagtagtttttttttgtttttttattgtygtygtygtatyggyggagtttttttttygygygtttttttttygatggagttygggygtygtygaygtygtygttgtttygaattttgagyggggtygtttyggtyggaggaaygygtygtttagttygagggygtagagygttaggagtaygyggagggttggggygygggtttygggaaygagaaagtgtagttttttygggttattgggtyggyggyggggggattatggttttgaaggataygggtagyggyggtagtattattttgtttattagygagatggttttttygtttagttygttyggygygtyggtygtygtygtttyggggttttgygtattttygtttttttttgaagtagtggagttgaaygtaggyggttaggtttatgtgattaagtattygaygttgtttagygtttyggatagtattttggttagtatgttttygttttttagttttygtggyggygttyggygtyggggygagttgtttagggatagtygggygygtttttttatygatygggayggttttttttttaggtaygtgttggattatttgygggataagtaattygygttgtyggagtattttttygagaaggagyggttgttgygygaggtygagtatttttagtttatygatttggttaagttgttgtygtttaaggttattaagtagaatttttttaaygaygagggttgttagagygatttggaggataaygtttygtagggtagtagygaygygttgttgttgygyggggyggyggtygtygtgttttygggttygggagygtayggtggtggyggyggyggyggygygtaggataagygttygggtttttttaygttgggttatyggggtttttatattatygtgygygataattaggtygaygttaaatttyggygtgtggygygtattatggtgtgygggygtatygygttggttaaggaggttttyggggataygtttaaygagagtygygatttygatyggtagtyggagaagtataygtttygtttttattttaagtttatttatttggagtaggtttttgatygtttgttygaggtyggtttttatatggtggygtgtaatttttygggtatygtygttttygttaattagtatygygaygataagatttggagtagttatatygagtatattttttttygtaagttygtagtttyggygttttttagtatttttygttttttgttgagtygtygttagtttgagtttygttggaggtttygygggggtgttyggggtaggygttggttaattttttatagagagyggttttttttgtaygatttttttatgtagtagataygatttatattttatygattyggatattttygt

SEQ ID NO: 6800 - DNA, 1748 bp, synthetic construct; identical to SEQ ID NO: 6799
  misc_feature 1..1748: note = Description of Artificial Sequence: Synthetic polynucleotide
  source 1..1748: mol_type = other DNA

SEQ ID NO: 6801 - DNA, 648 bp, synthetic construct
  misc_feature 1..648: note = Description of Artificial Sequence: Synthetic polynucleotide
  source 1..648: mol_type = other DNA
yggttgtgtygggagtaaaggttygggttagtgtgygtgygggygygggtgattttatttttagggaagtyggygtttaattatttaggtagtagtttyggttgatttttttttttttttttttttttttttttttttttttttttgygtgttttttttgtatyggttttygtygyggagttaggyggtagtatygaygtygtygtagtttttgttygtatygygttaattygygttttyggtttataygtagtyggagygattgagtyggtagtttygggtttaygttgygtatygtgtgtayggyggggttggttgagttgatttgygttgggtttyggygtygtaggyggttggggagggyggygtgggagaggaygttgagaygtaggggyggtygygtygaggtgataagttgygtatttggaaagttattyggttgtttggtgaggttygtgggtygggggttttgggygtyggggtgtgagggygygyggggagggayggggtyggggtgygygygtgtgtatgttgtgaatgygttgygygatgtgygtttttattttatatttagtyggttttttgtttgtgttgttygagtgtggaygtgtgtaygygttgtattygttyggtgtggtagygtttygt

SEQ ID NO: 6802 - DNA, 863 bp, synthetic construct
  misc_feature 1..863: note = Description of Artificial Sequence: Synthetic polynucleotide
  source 1..863: mol_type = other DNA
ygatttttaaygttgtaatttgtgatygtgattaaattttagygatgygagggtaaagygttttyggyggtgyggtgtgagttatttttyggygttgtttgttttttttagtagttttttaagggataggttttgtttttggtggtygatttttaggttttyggtttttttagggygattttgaygaggggtagggggtggttttygggaggatttagaggaaaggyggggataagaagggaggggaaggggaaagaggaagaggtattatttttagtttaatygttttygatttttataagagtgttygtgattttaaatttaaygtgaggygtaaaagygtttttattttttygttttgygyggttaggtaggyggttggagttgatggtttatttygygttttttgttttatttttattygagatagggaygaggagtaygttgtagggaaagtagygagygtygggagaggggygggtagaagygttgataaattagyggtgggggyggagagttgaggagaaggagaaggaggaggattaggaggaggaggayggygaygattagaaggggtttaagagagggggygagygatygagygtygygaygyggaagtgaggtgygtgygggttgtagygtagatttyggttyggttttttygagagygttttgggygtttttttaygttttgtttttaagttttttgtttttttattttygtgagyggagaattgggagtggttattygaygataggttagygggtttgttttttatttttttagtttygygtygtyggtttatagyggttttttttggggatagtttttttygggtgtygttttygttttttttgtgygt

SEQ ID NO: 6803 - DNA, 1288 bp, synthetic construct
  misc_feature 1..1288: note = Description of Artificial Sequence: Synthetic polynucleotide
  source 1..1288: mol_type = other DNA
ygttttttgygtagtygatttygtttyggtttyggtttaggttagagaggtggttttyggagatgttgaagttatttygygtagggggaggggtygttaggtttttttttaattayggtggtygttttagttatttgtatatattatgttaataatagattttttgtttygtttttatttaagtttttygttttttttgggggtttttygggtyggttygygggttgggttaaggtgaatatattatgataataaggygggtttttgttttgttttyggaaggggggygygtagtagygggagyggtaggtyggaygtygggygtygggagggggtygggggagggaygtygtgttyggagygygygygtatttatatatttatatatatatttaygygagtatygygaagggtatttaaggatygygtaygyggggttgyggagatttttygggtagtygygatttyggtttygygagtagtattggttttttgggtttatttygttttttttttttttttttattttagtygtttttttygygttgygttgtagygtgtttttatagtttttttgttttgaattgaatgtaggtgggaaataggtyggygtgtygaaagatatygagtaggtagaaataaggtaaatttatagaggygtaataggttyggtttttygtggttagggygagtygyggtttygygtggygtttyggtygttgttttyggattttgagyggttattgttggggttttygaaagaggtgtyggttttttgggagtyggaagagttgtttgggtgggtttygttttgttttttattttatygttatttagttttyggayggagggtgttttttatttttagttgggaggagagaagaaagyggggatggtgtaygtttgygggtttggaygttgagtaaggtaggggttygtattygttygtgggtttgattttattaattagttgtgtagttatagggattgaattttggaggaatygatttttttttttttttttaggattatttgaggtgtagagggtgggaagygaagtygagayggtygatttygttaygatgttgttgaagaagtaygtagggaaaggagggggtygggagtttagattygaggattygatttttgtygaatagtattgtgttyggattatgttttygtgtgtygttttggyggtttttttgttagtggtggtygtggtgttttgtttgtatttgggtgtgaaaattaaygatttttaggygaggatygtygttttygaattygt

SEQ ID NO: 6804 - DNA, 1275 bp, synthetic construct
  misc_feature 1..1275: note = Description of Artificial Sequence: Synthetic polynucleotide
  source 1..1275: mol_type = other DNA
ygtttatttygttttgtttgttygtttttattgtttttaagttygtttygttygyggtaagtgygtgtttaggygtagttatyggygagattaggagygtagygttygtagtttgagggaatyggygtagggtagtagyggttgtagttggattygygygttttagygtttagtggyggyggtygggatattttgggtagtatttygtatygtagtattttagattaygagtaatygtgttygttttygtyggggttggagggygtagggtygttattttgtaagttygtgggttttyggttatttttatgagagaaggygaagtygggygaaggagtaggaygttyggtagtaggattttttygtaagtttygygggttttttgttttygygtttttygggygtttaagaagtaaaatgtaattatygygttatagttgagaggggaaggggttagygttattygttygttyggaattyggttttygyggyggttgygygtttyggtygyggttttttyggttygggagtgagtagtagtaggaggagaggtagyggttyggggttggtyggggttggggaggagggaygggayggagggagggygygggggyggggagggggtttyggyggataaagatggtaatgttttttatttaagygtgttgtagtttggtttttttaatatggttgttttttttttgtttygtgtatttgttttgtttggattttatygtggtygagaaggaggaatggtatatygttttygtgaatattatttaygtygagttygygtyggatttyggggtyggggyggygggyggyggyggygyggagttgtatayggagaagayggagtgygggygttayggagagtattygtttaagtaggaygttygyggggaggtggttatggttagttyggtttaygatygtttggtttgygattttaatattaagttygtygtttygattygyggtaagaattggatagtttttatttttaagggtaattgtaygtatagggataagattyggaaygygtttttgtagaaygttttagtygtggttatttttaaygtgggttttaatattaaygagattattattatgttttaygygggtgagtggtttagygggygygggggaggggagtyggyggggayggaggtgtttagagggatttagygtttgtttttaggttttttttgggaagttygtgyggygyggaagaygtgtttgggttttttggatygattaagttttgtttygygt

SEQ ID NO: 6805 - DNA, 1071 bp, synthetic construct
  misc_feature 1..1071: note = Description of Artificial Sequence: Synthetic polynucleotide
  source 1..1071: mol_type = other DNA
yggygttgagttttgtttagygygattyggatygayggaygygtagagattttgtygggattygttttttagtyggygttyggggagtygtyggtyggttttatttttygttygggagtygggtagggygagaaggtagygygagtggyggtggygattttygtyggggtttttgygaygagyggtgattagtagygttygtagtygyggtttygttttttattyggaygtggttaagyggyggyggttaygaygttyggtttttygggatygttyggttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygyggttatygttagyggtttgattygttagaagyggtaggygygggagtagtattgggatyggtygtttgttagtaggaggyggagtagttttagtaagaatygygggttttgtaayggtaatttggtggatattttttttaaagtgygtattttyggttttaagaagygtaggttgyggygttaaggtttgtgggggttatggtygggagatgygtttygggtygtttttttttygtttaaayggagtttttttaggttttttttttttttyggttttttyggtttatttyggtttyggttttttttttgagtattttgggtgtygtygyggggattttggagttygttgtygggtaatttgtagtygtygagaagtgtagtygttagagatggtaagttggttgtttttygtyggyggtttttgtttttygygtttttgtaggttgggttttgggaaatttgttttttttgagtttyggtttttygggaggatagggattggtattggttttggaaygyggggtatttttttttgttatattyggggtygagttatygttygt

SEQ ID NO: 6806 - DNA, 694 bp, synthetic construct
  misc_feature 1..694: note = Description of Artificial Sequence: Synthetic polynucleotide
  source 1..694: mol_type = other DNA
ygttagggttgtyggatagttygatgattaggagttttyggttttygaagttgygttttatygtgtaaattttgttgatggyggtgtattgtagttatayggataygagygtttygygtagttyggggtagyggtggtattygaaggagatgtygtttttttgttgtagtygtyggygtygttttatgttygtygygggygtttygggtttttgggtttyggygtttaggagttattygtaggtagttagtgtttygtatagagttagtagygygttgttttttygttyggttatygttgygtttygtygtygtyggtygtgtttttttaygygggyggttttttttgtttgttyggttttgggtttagttygtyggygttgttgggggyggtaagtttygtattagtttttattygttttatttttttyggttgaatgagtgttagttygygtattggggttatttagaggagaygggtaaagtygyggttttaygggttgtattattggtygyggagtttaggggagttgtaggagaaattattgygaggagggggtyggyggagagaygggtyggygtggatttgggagggttgttggygttatttgttggttyggaattaygttaatagttaaatggygttygggaygaygtaggtgaaatgatagttaaggttyggggttygggaaygt

SEQ ID NO: 6807 - DNA, 694 bp, synthetic construct; identical to SEQ ID NO: 6806
  misc_feature 1..694: note = Description of Artificial Sequence: Synthetic polynucleotide
  source 1..694: mol_type = other DNA

SEQ ID NO: 6808 - DNA, 1424 bp, synthetic construct
  misc_feature 1..1424: note = Description of Artificial Sequence: Synthetic polynucleotide
  source 1..1424: mol_type = other DNA
ygagagttygaggygtygtttttgtygtttygggattggygtgaggagtttttgaygatatatattaattygagyggttttaaagatgtagttgtatatggagattttgttgggaaaattygtttgttttttttaygtygtttagtttaggagaattatygtygttatttyggagttttttyggttatygygtagagtttttygagagttygagtygyggttttygagttttaaggtttatttagggttttagatttttgtttygaaaggagaggatttgagaaaatggatgtattgagatttttttgaaaatttttygagagagygygagaggagygaggataygttattygtagttaaaattatatttaaggattaaaataataataattaaaaattttattaaaataataagygtttaagaatttagatygggttggtggggggaggggaagaggygggaaggggagggtygtayggaggtagttttgtagtgagtagtygatttygtygtttttyggtatagttggatyggtttttttagtygyggtttagattygtttttggatttygggttagtttyggtgttaggatygyggttygggtttggattttygagatttygygtattagtttygygggagtttyggtatttttgtatgagtaygagaggattttgttttygygtagtagttygggaagtaggagtygaagygygggtygtggagtaaggygggaatyggaggyggyggyggyggyggttaggggygtayggtgttaggattagttygtygygttttatggggagtyggyggtygtagygttgttgaggygggttyggttggttaggyggggggayggggttygggttgtagtagttttttttgyggttgtygggygggttygggygttygggggttggggggtggggggtgggggaggaygtygagygttgaggtaggggttygggtygagggygyggyggggttgygygtaygttggggygygtggaggggygyggagggygaaatgagtttggtaggtggttttttttattattyggtggtgtattaygagggttattygtttgtygtygtygtygtygtagttgtygtygtygtygttagtygttgtagttatgaggagaatttttatttttatggttggtttatyggttatttygagatgtygtttttygattatagtatggttttgttttatagtttygagtatgttagyggygtygtyggtttggattatttttattaygggggggtgtygtygggygtygggttttygggtttgggggggtygygttyggtgaagygtygaggtatygttaatygtaaggagyggygtaggatttagagtattaatagygttttygtygaattgygygagtgtatttttaaygtattygtyga

SEQ ID NO: 6809 - DNA, 1215 bp, synthetic construct
  misc_feature 1..1215: note = Description of Artificial Sequence: Synthetic polynucleotide
  source 1..1215: mol_type = other DNA
ygtgygggagggaggataagaattygggagtggtygaggataaagygggggttttttttattttayggtgtttagttttttttygttgtaygtggtttagggtggtygtattatttttaaagtyggtttygttaatygttagtttygggattgaatttgttttttyggtygttygtttttygtaggggataggggyggggagggagagatttagaggggggtygggggaggtggggtygtyggggaggaggygagggaaayggggagttttagggagayggttttygagggagagtgagaggggagggtagttygggttyggtaygttttttttttyggtygtttttttttatataagygtaggtagagggygygttagttatgttttgtttttgygttygtygtygtygtygtygtygtttagttyggygygttttggaggattttgygtygyggygttttygggtttygtygtygttagtygtttygtygtttttttttygttttyggtatygtygttagygttttygtygtagygttygyggttyggttttttttatttyggggaaggggagggaggagggggaygagggttttggygggtttggaggggttgaatatygyggggtgttttggtgtttttygtttygtttttttaaaaagttatatygaygyggatygyggyggygttttttttygttttygttttatttygygggtttygaatgyggggagttyggatgttyggttttttgtgaggtttttatttgatattygtygttttttttyggtattggttgggagggygttttgtaaagttgggaaygyggagtttyggattygttttygtygttttyggttygtttagggggggtygtygggaggagttygggggagagggattaggaggggttygyggtttygtaggggygttygygtttttatttttgttttygttagyggatyggttttttattttyggtttttttattatgtatttgttgggttttttttttgtggygtgttttttgttygtygttgygttgttttygggttttygygaggygttygtygtygtygtygttttygagttyggattygatttttyggaygyggagttygaygygggygaggttayggtaggtttgygttagggtttgyggagaattygagagtttgygttagggtttgyggyggattygagaatttgygygg

SEQ ID NO: 6810 - DNA, 1184 bp, synthetic construct
  misc_feature 1..1184: note = Description of Artificial Sequence: Synthetic polynucleotide
  source 1..1184: mol_type = other DNA
ygaatgttgttttygtatygatttaaattygygtygagtttttttttatttygatattataagggagaagagyggagtygtygtygtygtygtygttattatygttatygttatygtygtggttttyggagygagygagygattttgtygygyggggagttttatygggagtygygtttygttagttygttttaggtygtygtygtygtygtygtttatttattttgtygyggygygttttygttgtggtygtgaggaatygagtttagygttgttaagttgtttgggtttggagygtatygtgttatagygtttggtttygggttygggttgygygyggyggttagatatgataggttgaggtttttttgtttatattyggtygtygagggggyggtgygtygtttaattttttygygtygggtygttatygtygtttttygttagtttygygtttagygtttyggttyggtygtygttttattttttygttttattttttygtttygttttatataygygggtyggggtttgtgagtagtygtgtttttagygaagaygggggaattgtattgagaattygttttyggtatttttygaagatttygyggggyggtatttttttttttatataygtaygttygygagtygtttygggtagyggtygtgtttttyggyggggtttygtyggyggtttttgatttygttttagagttgtttttyggtagygttattttttygtgtttataaaagtattttttttttaatttatgaayggatttygatttttgttttgttattatttatgygtttygtattygaggtgtygtttttatttataygttttayggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgygtggatyggttygtggygggggttgttttgygttttygttttygtagtagtygyggatttttattaaygttgaygagttagtgtygygattyggggagagaagaygg

SEQ ID NO: 6811 - DNA, 5820 bp, synthetic construct
  misc_feature 1..5820: note = Description of Artificial Sequence: Synthetic polynucleotide
  source 1..5820: mol_type = other DNA
yggagggaaatygggtygaygataagggtggttattttygggtttttygygttyggtttaagygtttttgggtggggtagtttaaayggggagaggggtttygtgggtygagggttygaggtygtagygagtttagygtttggttaaatttggttygygygtttttttattgttttgttagggttgtgtgatttttyggagttttaygttttygtttaaatagtttttagygtttttgttggtattyggggygtttttattttagtttttgtattyggygygtygygygtagatyggayggaggggaaagttggtaagagygyggygttygygggagaaagygttaatgggyggtygggtgggagtagygygttygttygtttaygttaygtyggtgygggttyggttgaygatygyggygtttggggaygtyggygygtttygttygttaggtgtttygtttggaaatgtttttattagttgtygtyggtttttygttggagygygygygtygagttttygygyggagttttygygggttgtygggagyggtttagygttatygtaggtaggtgaggtttttygttttygttttygtttyggggtttygagattttttttttttttygaggaggyggaggtttygygyggtygtygaggggagygggyggyggyggttgyggygatttttyggtgygtttygggttgygagttgtttttygyggtttyggtagttatayggygygggygggagtttttttagtttaggtagggagtgggtttygtygtataaattttgygaggattgtttttgygtttaaggggataaagtttgttattygtygttaggttttttagaggtygttgygtttgttgtaagttgygggaagtagggtgygygggtyggygyggggyggggggtggggggttyggagtggttaggtttgagttttggaygttyggayggygtttygtttagttttaggtygtatttagggagtaagyggygggggygtagygggagagaggagggagagggtygygggtttttatggagggyggttgggaatttagagatttatygtttgtttttgtggtttttttttttattattggtttygagggggtttyggggttgtgaggaaatgatttgttaatttygaggttygttagtgyggygttagygatygtgaggttttttaaatttatattttagtygggtgtttygagyggtgggygggtataggygtttttaaggtttttggttttaggttttagaaagaaaggtttttgtttggtgtttygggttttyggtttygtttttggttggagttaatttttttgggttggaaggagtttttttyggaygagtttttggtgyggggaattggtggtttttagggtaatttttgaagtattagggttaggttggtygaagaagggttagggttyggtttgttttttyggaggttttttatggtttygayggttaayggtaatttygttaaaataggygattygtttgygtttygygttaggggttgattattttttgttttttttgyggtttgtttyggttttggtttttygtttttyggagygttttaggttagygggagtattttattttttygaagttgagtyggtgttgtgtatttygggagtyggttgatttttggtttatttgtttaygggtgtatttagtatygggggtttttagagggaggaaggtttagtatttygagtttatgtagaygygtttagttgatatttgagatgttgagygttttatygttggtgaaagggatattgggtgttttygttttaggtttggttttttggtgaaggtatttggaaaatattttagtattatttatgggagaagggtggtttagtgagaattttyggtttgggtaggygggtttaggttaggttatagggttttagtgagatgtttyggtggtygttaatttataggttggattgattttgtgttttggaatgagtagtggggtttgggtgaggtygggygggttaggaggttttttgggtagttgygagtttttygaggtagggtgattgtgattgggttyggattttaggygttggggtttgttggygggtaggaagtggagygtgtgtgtgyggyggtttgggaaagtygatttagaggttaggtttttgggttayggagaaagggtygttygttggtggggattggagygtygatttatgtatataggttggaaaggtaaaagagaataggagaaggtggyggtggtggttaaaggaagttttygaaagggtttttaygtattggttgttttgggaagtggaggttgttttttttagattttgtttagaagatgaatggtygtttgttttggggtttyggttttagttaagtttygtygggtttggaaggaaggaaatgtattagttttaggtttgggtgggttgagttgttgtattagagtttagaggtgtagggtataggtggttgggtttttgggttttggtttttttttttagtyggyggagtgtttatagtygtygaggttaggttttygagtataggtgaggaaaggataagttatagttgaatgttttttttttgggggtttttattttttattttagtttttggttyggttgggtttatattttttttttagtygggttttattatttggagagagygagtagtttgtaaataataaataatgggaagtagaaggatgttygggaaaaattagaaaattgtaaggagtggggaggagggagggtgggagaggggaggaaggagggtgggggaggggaggagtaggaggagagggaaaggggttgagagatttatttttagygagaaatttyggtggttagttttttattatttataggaaggtgatattagygatttaggtgagaaagaaagaaaygyggtttgtygygaaattaatatagaatttagaaataattattaatgttatttgattygtgttttttatatatttttygyggttatygaygttaaattgtttgaataatttgtatggagyggttatttattattttygatggtttttttttgtaagtagttyggaygtggttygtttyggtttaaygygatyggagaattygtatttttatttgtaaattaaagtaattaygtagtagatattatatgatgtgtattgtggtttttagatagttattaattatttttaatygagttgttaaaagagtaggtagatttygtttttgggaggtaggtttgtagttggggagagggygaggaygttattattaattagagggtgattttggggygatttataggtttgaatttaggaatttttttgagtaagtttgtataaygttgttttgtayggttttttttttaatttattaygggaggtyggtttagggggygagggtaatyggggygagtttyggtttyggagggygatggygtagaaggyggggaaygggttygggatggttygggygtttttttgtygtttttttgtygtttgtttattggttttygttttgaatttgggtaaggttttagggagggtattggtygagggagttttggggtgggygttyggttttttttttygattgtttygtgygttttagatagaaagttgggtaaaatggataggggagggygttttygttaggtatttaaygttttttttttygtagttagttttgyggggygtygggagggaygagtttagygggaggggtyggggtttgggttgaggaatttgttttttygagygygtagggtygttyggtagttttyggtttagtygygaggggtagggggaagtyggyggagtayggtyggyggaaaggggatyggggaggaaagtyggggaggygaggtgggggyggtgggttgagygggaatttaaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtagtggtygygttaygtyggttttagygygtagaattttgtaggtttygttygttygtttygggtygygttygttatgttttattygtagtttggatatttttatttttyggttttttaggtaagyggagtttygtttygtttaggttatygtaggtgtyggtagggyggatggggyggggayggggggtggggagtgttygatttaygattgtttgyggttttygagttagtaaggtttgggtygygygttttttaygtttaatttttgttttttaaattttyggggaaaggtygaggygttaagaaaattygaygggtygggttygggttttttgatgtttgaattataaggtttaggttgtgttttaggggagttttaggattttaaggaatttttggggaaggaggtttggygygtaaatggygttagaggttttggaaatttttyggggaagggtgtaggtgttyggttgggttttaygtggyggaggaggttagaygygtataagttagtggaaaggggygagtattttggtgtggayggygggaggttygggggtattyggggtaygttttygtgggyggygygygggattggtaaggtttagggttttagtttttagttyggtttttygttagttttygyggtttttttttgtagtttttgatggttattaattttttgagtaygtgttgygagttyggaggtygtaygttggyggatttygggttygtygtttyggtttaggygtyggtttattgttyggtttaygagagtyggttgttggttatygygygttaygagtttaattyggtygyggygttgggygtttatgggggtttttatggyggatygtagggttatggtaattaygtgatttayggttyggaggygttygttttttattygt

SEQ ID NO: 6812 - DNA, 1233 bp, synthetic construct
  misc_feature 1..1233: note = Description of Artificial Sequence: Synthetic polynucleotide
  source 1..1233: mol_type = other DNA
ygtyggttgygtagtttagtataggttataggtyggggggtgggttygggttttgyggagtgggygggtttgagygggttggaaygtttygtyggttttatygtaggtyggtattttagttttaggttttatagygggtttttygtttttattttygygggttttgtagggttggggttgtttttgagtttttggtaaggttttygggagttttagttttgyggagattaaagtttttatattttyggtagagttygggygagtgtttygygggtggyggyggttgtggggtygtttgggatttttygtagtattgattttgtaattttttgtgtttgygtttygtggtgaggggyggygggatgygygygatttttttttgatttagttaaayggaaaagttygygygtttyggttggaaggtggaggttaggtaggattyggtaaaggtatattttaaaygaagtagattttattttttatttgtagagggaaggyggtgtggayggatagaaayggtttttatagttatagaattatygyggttatagtagygyggygttyggtagggagyggatygtggtggaggtttttgagtygagtaggttaygtagattygggaggygttgaagygggygtagttgygttttggagtaggtagattaggttayggyggagggagaggttyggggaygyggygtagtttttgyggagaggtaygggggyggyggggaygtttttttattggttgaaatgttagggatyggtttgggygtggagtagtyggggygagttygtttttaggtatygtyggttgttttaggtagggtttgtaggagtggttyggagtygggtatygaggtatygaggyggggatttggaggggtaggggtyggggtagggtttgttaattaagtttaygggggtygtygggtggtggaggtgggatgggggaaggaggttgagtattagtttygggygatttaagattttttyggtttaattttaggagggaggtagygttggygggtgaagtygttattttttttygggaggtygtttagtagttgtttttttaygtttyggggttattgygtygggttttggttattatttgggttttggtttaygtttagaygaggggtagygygattttttygtagttttattttagyggttgtygtygtagagtatgaagaggtttggtttttgtagaaaygtagtttagygyga

SEQ ID NO: 6813 - DNA, 2865 bp, synthetic construct
  misc_feature 1..2865: note = Description of Artificial Sequence: Synthetic polynucleotide
  source 1..2865: mol_type = other DNA
ygttttttgttttattygggtggatgttygyggttttggggttttttttatgttttgattttggggagtttyggttggtattggttygygaaggtgatttgyggatagattagttagagattaygttggttggtygyggygygggttataaagtttagyggaggtggggtaggggattaagttgtttyggygagggaagaaattgttgtttttaaattattgyggttggaggagtygatttgygttttagygtgttaggataagggyggygygaggggtttaggggttaaatggggygttgggtaggaggggttgttttttgtaggggaggaggaatggttttttgttagggatttggggaaaggtaatagttaggaggggatygggtygtaagaagtttattttggattgtagtaygggtagttagygygaatttagttaggaggtttayggggatyggtaaaygagaaggggatgyggtgaggaygtyggattggygtttttgtygygttgatatttygattgtttttttttygtatygygttttttagtttgagayggggaagttatttagggtatygygtttttaaatagyggggaaaaggygttttgggyggyggttgagtgatygagggatyggttyggagttaggagttgggaggygyggggatgtggtggggaggaggggagtgggggtagtgagggggtttaaattttgyggggaygttygtttattttgtygttgyggttagttttttgygttttttygaygtttatttygygtygtattagygttygtagtagttttaygttgttggygtaggyggygygtaggagggtygtygttttygggaygtttttygggaygtttttygggaygtttttygygttttygaygtygtgttttttttygttttygaaagggtagaaagagtygttygaggygatgttgygggtgtttggtagattygagaagtttttaaatttttygtagttagyggggtttttttygatttgygygtttyggggtggggayggyggtggtggggttatgtagygygtttygtygtttttyggttyggtttyggttagtagtattatgtyggyggtyggggygygggtygggggtyggggygygggtaggaagagygggaygyggggygygygtygaggttttygtttttygtttttgygtttttagagaagtygtggttygygygttttagttyggyggaaatyggtattaggyggttgygtttaaagaaaaaagttttyggaggttgagygagtttttggggtgggygggatygygggggtttttygaggyggggyggggyggggygyggggataygttttttttyggggtttttttttygygtttttttttggttagagtttagagttaggtaggygttttttygagygyggggattgggtatttggtagygttgttttagagttggggatagttggygygggagaagtagaagtaattattaaagaagtygaattygagtygygggyggtaagyggtttygttttttttttygtyggttygygggatgggggyggaggtggyggyggggggaygtyggggyggagtyggtttttagtttygggaatttyggatttttggagtyggttttygtygagggygtygggttttyggatttgggtggggtyggtttttttygtygttttagaggagtagagygggtttttttttttygggggatttygggtttyggggttgattttattyggtygyggtygtttggaggtyggggaattttyggggygtttggygggtagaggagtygggygygggagyggagtygtttatttgggatttgtgttyggggagygttgygggtygggttattttgaattgggggyggtyggttgttgtgggggagttttagttyggaagggaggataatttttagagtttttygtttygyggaatyggggtyggtygtggtttgagggttggttagattttgggatggggggyggggtgtttyggaattttagggagtatttgagtgggaayggaygaygaggaatttttygtttttatgtttggtttgtgttaygtgyggggatttgyggatttattttyggaggttgygattgggygttgattttaygtttggttgtttaaaagagtagggtygygggygatagtygtagtttaggtttatagtttttttggttyggttttgtttttttttygttagttttggygtyggggatgggyggggaggaggagggygtgtgaggatttgttatagggagtttttgatttyggggtaggaggygtygtgagttaattttgggggaaggtttttgygtaaaggygyggaggtgygttygygttygtygtaggttaaagattgyggaggttattagttttgtgtttttttagttttttttttttttttttttttttygattttgatagygtgtttattagttgttagtyggtgggaggttttygyggttttaaggtgaatatagttaggttggygtagtygttggggattaggtttgaggtttaygtgtygttgggtaagttgaggggtaygagggtatygaattygaaatagtygtgggaggtgtaggatgaggataygtttaaattgygaagtygttygagttttygtgttatatygtattggttygattygttgttttggtygtttggttttttagtgtttttagtaggagttaaagggtttgttggyggttttygattyggtatttgtagggtttyggagggtggggygygygggagtatygatttttggtgaagaygttttygtatttgggyggttttgagygagtagygaattgagattygt

SEQ ID NO: 6814 - DNA, 1154 bp, synthetic construct
  misc_feature 1..1154: note = Description of Artificial Sequence: Synthetic polynucleotide
  source 1..1154: mol_type = other DNA
ygtgygtttttaaggatgttyggtttttttttaattygyggtttttttttttttttttygyggttgtygttgttgtygygaaaattaggagaagtggaaygygygyggygaagygtygttttygyggyggtattgggtatgtttygtattyggggtyggtttyggyggyggggyggaygtttttttattagtygggygttygggtyggtygtygaggtttaggtggaggttgaggttgtygygygtygygggaggagtttygttttyggyggttgaggyggyggyggtataggtggygygggtygygygyggggygtagttygggagygttyggygtygggygtygyggyggttttaggttygygttygyggygatagtyggttgagyggagttgygggygyggyggttgtttttttagttyggtyggttggyggyggygttyggagtttygaggagttygtaggagttygtggagttygyggagttgggtagggggygttgygttygtygagttyggaggggtygtygggtygggygttgygtattygygtygggagtygtttttygttygyggygttygtttttgtygttygttagtattttttgtttygyggtygygtttagataataaaagyggaagatgttgtagttgggtaaggttaggattttgttttgaagtygggyggygtygygtaygttttttttyggattgaggagttgtygtyggyggagggtgtatgtttgygaggaagtygtygggygtygygtttttgggtgagttgyggggttgggyggtyggggtygggygtagttttttttyggygtygtttttttttttttgtygttggtgggggtggttttgggttttyggtyggtaggyggyggyggyggttgttgyggggtttttgtttgtttyggggaggatygygatygygttaggtttttttyggaagtygttgtgtttggaagggggttyggggttagtgttttttttggagyggttattaagtggttgttttgygtgttttttttttttgttatttattttttygggaggaagygtatttagggtaatatygataatgttgtttttygttattttgagaatatattyggtgtatttatgaygtttttaatataygggaggagaygg

SEQ ID NO: 6815 - DNA, 1154 bp, synthetic construct; identical to SEQ ID NO: 6814
  misc_feature 1..1154: note = Description of Artificial Sequence: Synthetic polynucleotide
  source 1..1154: mol_type = other DNA

SEQ ID NO: 6816 - DNA, 396 bp, synthetic construct
  misc_feature 1..396: note = Description of Artificial Sequence: Synthetic polynucleotide
  source 1..396: mol_type = other DNA
yggyggtttttygttttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttygatgtgggtygtttttttttttttagygg

SEQ ID NO: 6817 - DNA, 438 bp, synthetic construct
  misc_feature 1..438: note = Description of Artificial Sequence: Synthetic polynucleotide
  source 1..438: mol_type = other DNA
ygaggagtaggggttgygggtygggtttttgttgttygyggttttygggggtygygtygygtygggttaygtgggggttttygtttttygagygggygtyggtgggaaatttgygyggygagagatagggggatggggygtttttgaygygattgtggggtgygggtagttttggaggaggatgttyggttaagtttattttgtttaggtgtyggatttttagtttaggttgyggtttgttttgggttygtgaggygaggtygtagygtttygaygtygggtgggygtgtgggtggagtggagatttgggtttttyggygtatgggagtttygtygtttgyggtagggaatygttttttatttttggttyggttygggtygggagtygtgtttygygttgattyggtgtaattttttagtttatttttttttaygyga

SEQ ID NO: 6818 - DNA, 438 bp, synthetic construct; identical to SEQ ID NO: 6817
  misc_feature 1..438: note = Description of Artificial Sequence: Synthetic polynucleotide
  source 1..438: mol_type = other DNA

SEQ ID NO: 6819 - DNA, 411 bp, synthetic construct
  misc_feature 1..411: note = Description of Artificial Sequence: Synthetic polynucleotide
  source 1..411: mol_type = other DNA
ygygtttyggttttyggggagtygttttttagatttgtttattygggagtttttttttygygtattttttagattttttttgagattygagagygttggtttttttttattygygatagttttgggatgatagtgygggtttttttattygtagtttttattatttggyggttaggggttygyggttygggygggyggygttagtgttttttggagttgggyggggagggyggggygggyggagygggtatggtggggtgtygggggtygtaggygtagygttttygttttggttatggagyggtyggygttyggygaggtggttatgagttaagttatttagtyggygtaygttattgygygyggygagttgagygyggggtagttgtttaagtggatygatattatygt

SEQ ID NO: 6820 - DNA, 1137 bp, synthetic construct
  misc_feature 1..1137: note = Description of Artificial Sequence: Synthetic polynucleotide
  source 1..1137: mol_type = other DNA
ygygtttgttaggtttagatttataygtaygtygtttttgtttgtatatagtgygttttyggyggttygttygtttttttttagtttaygttttattgttttttaagttagaagtttygtagtygtygygyggagaatagygatagtygagygttyggttygtttgtttgtyggtgggtttgtttgttygygtagtagattyggggyggtygygggagttygygtttygttygtygygtttttgtygggatttattygtagyggagggttgagttygtyggyggtttttyggagtttatttattttygygygtyggagygtaggtaaaaggggaggaaaggtttttttttttagttattattttygttttttttaagaatttgtttaataaagygttgaggaaagagaaygtttttttgaattttttagtaggggyggagtttgttgttgttttgygttgttatttyggttatattgtttttygygaygatttttgattagtyggggttaygttygggagaygggattatgaagygttyggtagtygtttggtttttggtygggtttagtttyggtgttttttagttyggtaaaggtaaggygtygggattyggatagttgggtgagggatgggttgggagttttttgagaaaygtygygtagggggtyggaggyggttttttyggygtgttaagggtggygagygtygttggyggygyggaggaggygtygagttttgggtgtttygagaaagtgtttgtaaagtttgagtagagtgygyggggtygagyggggagaagggtgyggggtatyggggtgagatataggaaagaggaggayggtggggagyggtagaagatagygtttttaggattagygattttgtggtttattyggttattgggtttyggygtaaattttttttaggtagtgygggygatgttgattgtagaygtygggtagggttttygtgygggygggagygggggaagttagtgygttygggygttagttagttgatgygggaagaggttggggagttgtagggtygttygttttygggtgyggtgttttggygtagggtttgggttgagtygttygtaaatttagattyggygttgggygttttggtygygg

SEQ ID NO: 6821 - DNA, 2383 bp, synthetic construct
  misc_feature 1..2383: note = Description of Artificial Sequence: Synthetic polynucleotide
  source 1..2383: mol_type = other DNA
yggattttttaggatygyggygtyggttggttgtttyggtttttygyggtygygtgagtttttttttggtggtggagggygtattttaatttggaaatttttagtttttaatttggtttygtagattgaygtygttttyggtggggyggtgggggtaggagggtaaaggggaggtttttttttttttggattgaggttgtaattaatagtttygtgagtttttatttttggttgattgygaatttttttattttaggttaggggtygggattttatagaaagattygtttttatttttaattttgyggtttttgttyggyggggaagtttagttgygggttagtttagttgygggttyggttaagtttggygygtttaggtattttagtttttggttygyggtygggygaggayggagggggaggggaaggggttgttgtttttttttttaaattyggtttttaatygttttatttttygtygtttattygttttgtataggtagttaaaatagagttagyggttaattgayggggaygggaagtaaagtygtttagygtttygttttttttagtyggtttttygggttttttttttyggygttyggattttggttttttttttttttttttatttttttttttgttttaatttygtttttatttttygtttattttttttygtattygggttygttaatttttttttttaagttttttttttagttyggtttttttttygggttygttttttttttttttaattttygttttttttttttttttygtttttttttttttttttttttttttttttatttaattttggtttttttygttttttagtttygattttttttttattttgttttygtttattttgygtyggttttttagttygggttgagttttaygtgtggayggtygygtttttattgatagtygtygttygtyggttygtttygygtttygtygggtttttaaaattttygygtygygttttttatygtygtattttttttagygtttagtttttygtttttttttttgttggtygtaygtttyggtttygygtattttygttyggtttygtagtygttattygygtttygttgttttgtgggatttygagygagttyggagggaatttttttttttttttgggggygatttttgtttgtttgtttgtttttttttggtgatttttgtagttttttaatattygttttyggagygtaygggaattygtygagttttgygtgtaggttttttttttttttgaggtttatattttttgaaattttaygttagggtttttgtaattttttttttygttygttgayggttttggagtygttyggggttttaggtyggttatgtaaygtgtatygttyggggttgtyggttgtattttygtygygtttygtygtttattgygttagattyggygtttygygtttygtttygtgggtagttagggggtyggygttttgtygaggtttttagttagagtagggagttygagttygagggagttttyggagtygaygaagggtttattagattttgatttttttttgaggygygtagattttgtttttgattatttttttttygygggtttayggtygygygttttyggygtyggygatggggagaagayggaggttgtgtttttagttttattttttgtggttgggttgtgtggtgttttgggygtagggtayggtyggttagttttagtttttttygtttaagtygtttyggttttagtygtygtygtaataggttyggttygttatagtaggttttgaaggygggtttttagygttygagtatygygaggagggtgtygtagtggttagtygygttygtyggygaggatagtaggaygtgtttygagggtaagtgggtaagyggtttygtatttagggtttyggtttgggggaggggggaatttttagtttggyggttttttggtttatttygttttagattttttagttggagtttagagttgtagttttttttgttagaatatttaaagatttttaggagygygtttttttttttttttttaatttygtagtttagygggyggaaagtttttttttygggggttgggyggygggtggttagggggtttaggggtgtygatygtagagygtgtgtagagttygygttgygggaataggttttgaatgttyggyggtaggygggtttgggttygtttgttgtaggggttagagaagtttgtttgttttttaygtyggggtygtygttygtgagttttttgtttgaggaygtgtgtagggtttatagtttatttttttatygttaattygagygttttattttgygaygygttttttttgataygtygg

SEQ ID NO: 6822 - DNA, 2367 bp, synthetic construct
  misc_feature 1..2367: note = Description of Artificial Sequence: Synthetic polynucleotide
  source 1..2367: mol_type = other DNA
ygggtyggtttttygtttyggaggttggggagggggtygtgggtttttgygtttttaggttaagyggttttggaggtayggattagtaggaygtygaggtggygygggtygyggtttttttygtagtagttgtyggygagaattaggtagggaggygtygttgttgattgtattttatgaaagatttaggttyggttgtygygttgttatttttyggtattttgygtyggaaayggtygttttggagttygtggtygtyggygggtaggtttagtygttttagtttttgagaaaggtaggttatagttygatttgttttgtggttttattttataattttaatagtaagtaggtttaggttgggtatttyggggtattaggagtaggttyggttaattggtttttattatgaggtttygygtatagggttatttggttaygaggtaaygttggggagttttgtggtttgagggtgggtaaaggataggtttttagtttttttgygtttagttygttttttagyggtagttagttaggaayggtttgyggggttataggggtggaggygttatygttygtaggttygtagtaggatggtygttgggggatgtgtaggtataggggttggataaggggttttagaagtgtttgttttgaggggttggtgtgttttttttttattagtttagtttttgaggagagggaagaaggtaatttttttaattagggtaggtygggyggttgttttattttaatattttttatttttaaatatagaaaatttggggtttgtttttaaatttttttggttgttaygttttgggtagyggattttttttgttaataygtaagattagttttttttygtaggttgagtagaaagaagaaaggtttaattttaaaattttaaattygattattagttttygtttaaayggaagtagggttagttttttaygagttaggtgggaaattgggtttagggagagaaagtgttttagggttaggttgggattygttttggtttygttygtatgyggtagggtttttttayggaggttttagggygygtttttyggtttygaggttyggtygttagtygygyggattttagtttaygtttygagggaggttaggatttttagtyggygggattgygygtygttttttttttygtaggtttyggygaatatttagttttttttttttttatttttttygtttttyggttagtgttttygtttttttygygggygaygggyggyggyggygggaggagygggtygagtygaggaagtttyggtttygygygttgggatgtagygaattagtaggggtygaagaatygtgtagtgttagagttagagttggattyggggttttagtyggagtygaaatttgagttagagttygyggygggygagttyggagtttaygagtygtagaygtagygttgtttaggtggggtaagagaygttgggttaggggygtagggttttygyggtggaggggygtagggaggtggyggtygagttttgygtagtttgtttttggygtgtgtgggtttattyggyggygygggatagygtaaggygyggaaggttaggagttttygaggtagygygaggagttygtttttgygtttagggtatagttatagtygtygttatygggtgttattttatttaatyggygggattaattttttgttttggtttygggtattttaagagggtagtagtttygggggtaygggttayggtttygygaagggtataatttgagaagttygtggtagtttttygtagygtygggtgatatagggtttttttatttttaggagaagtgggtaggagagagggtygttygttgtttttygttgygtttagggatggagggttttattatttatggaattgttggtttttttgygtggttygggattttagtygtggtttygygttaagagggtattttttttaaaygaaatygtttygttygttygttygttygttygttygggtagtaatgtygtagaaaagtagtagaygtyggttygygttttggtttttttygtttyggatttygaygtttygtygtagygttyggaggtgtttttagtttaaggtagtttgttttygtyggtataggtygggttttttttttttaggagagaaattttaatttttttygtaaygtttaataaagatattttygyggttttttttaggtttggttgttgaygtagggtttyggagtaygtagtygttttttaagaatygggtttyggatttttgaaattgattagtttygtaaattggagtttattttttygyggtaaaggtagggttttaaagtygggatygt

SEQ ID NO: 6823 - DNA, 1235 bp, synthetic construct
  misc_feature 1..1235: note = Description of Artificial Sequence: Synthetic polynucleotide
  source 1..1235: mol_type = other DNA
ygaagtttagtygatttttgattgttagtatttyggttataaggtttaaggygaatagttgtygtaygtyggygyggttgtggttgtygaaggagtaaataattttatygttggggtttttatttagattygttgtaaggatttgtattaygygygtgtyggagggtgtattttttaggaygygygttyggtataaggattggttgaagataggygtattgttattygygtttagtattttgatgtgaataggtaggttggyggagagagttggggttttttygtttaaygtygttagtattaattggagattaggttttygttttyggtttagggygygttttaatattagtttygygtatttggtgttgttttttygygtttgtaygygaagygtaaagtatttatttyggtttagtttataggtttgtaaagagttgttttttatatygggatygtgygygttttygagyggaaagygygttttyggagttayggtttygttaatttttaattttattttttgggtagggaaagtaggattgttgtygttgatgttttggattattatttttaygttgaatagttttagygggttttttattattaattttagagttatagtgtaagagggtagtgttttatatagtttttttygatttagayggtygtttataaatattttttyggtttttyggtttattttaaagaattttyggttagttttagatattattyggaatttgygggttgagaggttatygagatttaaattaaggttygygattaygttgtttatagygaaatttttttttttttttttygggattttatagtgaatgatygtggaagttttgtttaaggtattaagtagaagtaaaatttttattattttttyggtgtttattagttygtttttttaggtttttgggattattttatttaaaagtagttttttttagyggggtttagatygtttttgagatttygttgagaaatttttagygggttagygtttgggygttgggygtygagttygatatggttttttggatgtygttgatttgttygtyggttgtttagtttttgttttatttyggggygtagaaaggggaygggtaggggttygatttttagygtttttattggtygatagyggtatatagagttttagttaataattgtaygaagaatgagttagygtygggttttttgagtaggataygygttagygt

SEQ ID NO: 6824 - DNA, 3043 bp, synthetic construct
  misc_feature 1..3043: note = Description of Artificial Sequence: Synthetic polynucleotide
  source 1..3043: mol_type = other DNA
ygatttaggagagttygataygtyggatagttgyggttagtygtggttattttggtttttygttttygttttttttattttygygtgtagtygggataygggaaaggaaagttttggaagttaagygtyggttaaaagatgatttgttygygtgttttttygtttttttttttagtygtgttatatggyggttttaattaggygggtagtgygtttygtygyggagatttagggtygygtygtttgggtagtgggtgatgaaattttttaggygtattatygtagagggygygggyggggygyggggygggggtgggggatygagagttggtatyggggtttatttgttttttaggaggagggtggggayggggggaggggygagtgygygttaaygtygggtgygtgttttggggygtttgggygyggygttygtgttttygtttttttttagttttgygagtttttygagttgygtygtggggtgaygggatygagagtagtttttgttttyggtttyggygygggggagaygtgagygtgtataygtatatatatagtaggggaagaggygttttaagyggygtttaattttttttttttttttaygggtygggtgagaaagtagtygggggttatttygattyggyggtttttggggagggggtygaataagaaaagggaggagatggagataattttttyggatttagtttttttgtttttgtttttgtttttattatttttatyggatgattggagagtaaaagggaattyggagyggggtggygagtagygttttgagaaaatgtaggagtgtgtttggagaygygtaaagttgttttttaagttttggttttygggtaygygatgtttygyggygggttgatttagggttgttttgggtttttttgttatttttttggaaatgatgtaagttttgattgttatttggatttttgtagtttagtttggaatgygtttggattaggggaaagaygagaaaygatattttaggtgttgtayggtttattaaagygggaagatagggtagttgtttagattaaatattgtatttagtgtttttgtttttatttttaatygtggggttttttttaatgtaaagtgttataaggttaggaatttttatgtgtgtttagttggtttatagtattattgtgtttaggaaattgttttaatttattaagttttttgggttgggaattttattgaattttaaayggyggaaagaggaaatttttttaattygatgtgggtgtgaygygagttaggggttttagggatattgttttagagtatatygtttttttttaatagtaattggagtttggattygtttttatattgtatagttttttygattattgttttggagtattygtataygygtaygtattttyggtygygtttatatatatttatatataygtaygtaaaygygtggtygtygttaggtyggtaattttgttyggygtttttagyggygttyggtttttttttgtagtagttgagygtaggtttygtttttyggtygtgttgttaaaagggtyggggtttyggattggtttagtygtygggataatatttgttygatttttttatttaagtgatattagagtttttagggatatttgaggtattatttttgttattgtygggtattygyggygttgttaayggtttggttatatgtttttyggagagttaygggagggygttgggtaatttttattygagtygyggtygygaggaggagggaaaaggygagtaaaaaggaagagtgggaggaggaggggaagyggygaaggaggaagaggaggaggaggaagaggggagtataaaggatttaggtttttygaygggaggttaatattaagaattatgtgtgtygagyggttgggttagtttatgattttggttttggtgttggttatttttgattyggygygggggatygaygttattaatttattygagggtttttaagataggagtttttagtagaaaggtygtttgtttttgtagaatataggtaagtgtatgtgttttygtagtygggagttattgggagaggatatygtgtatttaygyggygygttttaggygtttygtygggagttaggygtttatttagggttaygtaaatttttgggatggtaygggaygtgtaaagggaagygygaggtaaggygaggttygygtygggtttygagggttyggaatttgtaygtgttagtagggtgatgaaatggttggggtaggatttgttgttgttttttttagggtygaggggaaatgaagtagygtttgaygttgttagygttagttttygttttygaatttygggttyggtgtaaagygygttttatttyggtyggtaygygggaggtttagagggttttyggagttgggttgygttttgygttyggagaatttttttttttggtttgtyggttttagtaagggtgtygygttttttttttttttaaaagatgttygatattttagaattttgtyggygagataaatggtattgygaattttttttttgggggtattgttttyggaagggagygtgagggtagygtaaagygtattttygyggtgttgtygttatttttagtttttggttaggttagtaagttaagaaatggtgataygattygaatygtgygttttttttgttttatyggtttttggtttatyggtaagttgtaaagtagagttaggygtgtagggtayggggttggttttttttttagttyggaaagagaaagaaaatttgtttatagttttttygttttaygatttttttttygattttggggggtygtgtgaaygyggtagyggyggygtgygtgygtttatygtaygagttggaatgtaygagtgtttattagggaygttttaagtgagtgaatggyggttttgtgyggttttgtttyggyggygygtggggttttayggattttgtygtttttatatgttggggtyggtatttttattatttygagattttygt

SEQ ID NO: 6825 - DNA, 864 bp, synthetic construct
  misc_feature 1..864: note = Description of Artificial Sequence: Synthetic polynucleotide
  source 1..864: mol_type = other DNA
ygygatttaatttttaattygygatttaatttttaattygtgatttaatttaaaattttygatttaaattttaattygygatattaagtttgygatttagtttagaattygygatttygtttggtttattttttagtagygatattggyggttttygattttttagatttagtgagtttygtaaagtygttyggttttyggaagtygtaggtgtaggygtygttgggttygygggtttttttggttggttygggttgttttaggattayggayggaaaatygtaggygygyggtttatttygttttaaggggagggttygtttggtygtgtagttygtttygttttttttttygaagagagatttggtgttggtatgggtatttygyggttatyggagtggtttttyggatgagtttggtttyggygttgaygttttggttttgggggttgtttggttggtgttaggtagyggaagaygtttggagagttattygtttttttttttattygtttttatygttgttygtgttaggaygygtagtttgtagttgtagtttaggtattggygygggatggyggagttttttttggatggygttagggttatygagtgtatagtttatttggtttgagggtttgttttttttggatattttttyggattttgatttttggygttgggtaatttataggatgagatttatyggttgttggygaagtygatygtttgattttgttgtttgggyggttggtttygggattygygttgttggggaygygggtttggtttgyggtgtttagttatttgttgygggygygttaygtttaggttggtggttgtagtygtagtttygygtttgygg

SEQ ID NO: 6826 - DNA, 2071 bp, synthetic construct
  misc_feature 1..2071: note = Description of Artificial Sequence: Synthetic polynucleotide
  source 1..2071: mol_type = other DNA
ygttyggtyggygtygtttttyggaggttgtgtttttggggtggttggyggyggggttttttyggttyggttygyggygtttttttgtygtygtttyggggtgtttttgtttygttgygagttyggtatygyggygayggyggygygaagagggaagygggyggyggyggyggtygygttaagatgygtygggttatygtaggttgaggygttygtygttttygttttttttttygttygtttttttttttttygtttgtttttttygttygttygtttttttttttttttygttttttttttgygttttttygttygttttttygygtttygtttttttygtttygygttttgyggtgttgtagttgygggyggttttagttgtttttagatgtgggttgggyggttygyggggaattttygygtyggttgygagtgyggggtttyggttgtagttyggttgttatggattygtyggygggagtygttygtygtttgttttgtttygtgttgttgttgttgttgttgttgttgtygtygtygtttttgtygtygtygtygtygttygygaaygttaggttygtygtygtygtygattttttaggtaggtgyggttyggtttttatttttygggattttygtyggtttggttttgtttygygtgtttygtygttttttttttaggygtygtttagtttgatttgggtaaatttygygygtttygttyggggttaagttggttaatttyggggtygggttggtygygtagggggygtttygtatygttttygagygttttgggtygggggagtttyggagtattggyggtttttgagtygyggagggtggggayggagggtygggaaaagtttygyggttaagagygtagagttagttttagygggttygaggggggagttagggygaggyggygtyggggttygygttyggggaygtttyggaggagtyggttgtygagygygtagttttgggttttaaggattggttggggygtttygtagggaattttyggagatyggagggattttgttttattttttttagttttygggygttyggggagayggggtyggtagygggttgagygggagttggataggtaggataggtygttygtgttyggggaagtygagatttygtygtttyggaggttggyggtgagggtattygggyggtaggggttygtygaggggtygtggtataygggtaagggggttaattyggaatggttttygagtagttttaygttttgttaaggayggtaggtgtaagggtygggggattttttgayggggtygttttttygggtayggggaggtttttatygagttttaattttgaayggggtagggggtagagtttttggtaggtaaggttttyggaggagggaayggttggggagtggyggagtttyggagtggtggttttgttaaygttttttttyggttgtaggaaagtyggggaggtgtaggttggtttttggggtygtttggyggaatgtttttttttttygtagtggggyggggtttgggggggygtggtttgtyggygggtttttgaggtattggggtttygtggttttygtygatttaaygttttttttygttgtaggygggtttttggggtayggagyggagygtattttggyggtgttygtgygtattgaygtttagggtygtttggtgttttaygtggtgtyggtagttaygtttagagtaggggtaygagttygtagggtygtttyggttyggatttygagttttttyggaggtaaygaggaggagtttggtagttattttttttataatgttayggtttttggtygagatttgtatttgyggttgyggtttaaygttygtttygtggygttyggggttattatggagtggtagggygagaagggtattattygygtggagtttttgttygggagttgtttttaygtyggagaygtggtyggtttagtygaagttttttttgtggygtttagtaattgygatgggttggtgagtaygtatttttttagttttttttttttygttgttttygt

SEQ ID NO: 6827 - DNA, 1170 bp, synthetic construct
  misc_feature 1..1170: note = Description of Artificial Sequence: Synthetic polynucleotide
  source 1..1170: mol_type = other DNA
ygagttygygttaagagttaygtygagaygygtygtyggtggggttaygygagatgtaatyggagagtttaaaattagtttaggattaattttttagggattygtttaatttttttygtagaagagtttaagtggggtagtggtygttataggttgaggatgattttyggaygygttttaggygygatygtattattygtttttagtttaaagtttgagtgatttggtattatttttttaattgttttttatttttttygtatttttgttgtgtttatygtttttaygtatttgagagtttaaattatgttaagaygatttggagaaaygttygatttgttttttaagttaygtaaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttattttttttttttatggttttattttygttgttagtatttygattttagtttgtaattttgattttgggtttgattataaatgaygaaagatygyggtagtttttaaagtgygggagygagtttygtattggttagygyggyggagggatttttttaggaggttttaagtttttaagtttgtggagagatttggtaatagttggtaaggtttgttttagttattttygttggttttttgtttttgtatttagygtttgagggygttattygttttttttttgygttttaygtaagyggtttaaggaatttattygattyggatttygtttygtatgttttttaagttttygttattttygtaggygttttagaaaggygtgatggttttagtttagtgttygttagttyga

SEQ ID NO: 6828 - DNA, 2168 bp, synthetic construct
  misc_feature 1..2168: note = Description of Artificial Sequence: Synthetic polynucleotide
  source 1..2168: mol_type = other DNA
ygygttataaayggggatttaatttattgttygatttttgttagaggygatttatttgygtttttgttatygtattttygttygygtttttgygttttaggtttttygttgttttttygttttttgtagygygggagygttgtttygtttggtttgttggttttttttagattttggttatttttttygtggtaggaagggttatatgtattgatagatttttygttggtggtggttgggtggtggygaggygtgttttygggygygtttaaaatttagtagttttttttaagtagtagttttttttatttygtttttaggattgaggatttagttttygatgtttttttattttttttygttttatttygttattattttttaatttttttagtatatttttaagttttataygggygtttgttttttttttgtattttttagttttygggygtttygttyggttgaagtttaygtattttgggatttaattgtttttaattattygygtagtttaagtttygygtttgtttggttttygtttygggagtttgaagttatygggtagtttattgggtgttttyggggaaaaggtttaagttgtagagatgagagaagtggggttgggggaggggagaggttttagaaggaagattaygaataygtgygaagaaataaaagttattaygtgtgtaygygygygggggtttaagggygygagygyggagtaygttttagggggttagggatagtggttttttgtagygggtatagtagggggygygggtatttataygaaagygtggtagatgaaygtttagtygyggggtttttttagtaygttgtataggtagttttgtattygtyggtatttgaygttgygtyggtagttttggttattygtgtaagagagyggtttttttagtaggtttattygggttttttgtttgtttyggyggtttttttttaggttatygtygtygttatygagygtggtygygygggtgtttagtagtagtaggtygtygtttttggyggttgtygagtttagtagtattttgtttyggtyggattttatattttttatgtygttgtttaagygtttttygttygtygtygtygtygttgygtygttttttatttagagttyggyggygtygttttttttttttttygygtggtggyggggtatggtattattaygggtatygygagggggtygttagygtttgyggygggggtagyggttttatgtgygtyggygggttttaaggaggaagtyggyggtygayggggygttygttagttagagatttttgagtygggggyggggaagtaggtagttagtaaatygttygggtttyggggygggaaaggaggggttgtagaggaggtygaggagttttaatttttaatagtttttagtttygaattttaaattyggatttgtttggggygttattttgagagggttttttttgtttttttattttygygattattatttttttttttttaaattgttttyggggatagagtgggggagtgyggggygtttygaggygygtttttaygygygtatatttagttttaggtttttttttttttttttttattttttaygttttgtagygaaayggttttagaagttttttttygaggygygagttyggtttggttttggtaggggttttgtagttgttyggaaggtgaagttagttttgtgttttgaggagaaattggagatgtaggtygttgtgttttttygttgttaygtygttgygtyggattttgttattttttygtaaggggtgagagygggaatagttttgttttgttttttaggtattatttagtttggaggttggagygtaaggtaaygtttygggaagtggtattygggttttygtataygggygagtttttagtagtttagtggatagattygtaggaygyggttgttaagttygygaggtaaggattaggtattttttygygttttattttagtttgyggattgtgattttttattttagtattagataagttygygagtaattgaatattttttttagtttatgggtggggtgtggaaagggygtaaaattttaaagtggttttttygyggtgagygagttgtttyggggttttgtttgattgtagygyga

SEQ ID NO: 6829 - DNA, 2053 bp, synthetic construct
  misc_feature 1..2053: note = Description of Artificial Sequence: Synthetic polynucleotide
  source 1..2053: mol_type = other DNA
ygggaagatttggaggtyggtaaaayggagyggtgygggatgatgtttgggaatatyggtaaggtgttataaaatgaaygttaaggyggttataagaggayggtygggaatygaatttagygtttagtayggggtttttgtggtygaygtgaygtggtttygttaggtggaaatygtgygattttttttygatttaatttaygagagataaagatgtttaaataattaygatygtygtygtatattttgtagggtttygggggyggaggggaggggagygttttttyggtagaagyggyggtttaggtttgtttggaggttygtaatttattatgataaatgtaaagattaattaaggtttgattygtgtatataggaggtagayggyggttgatagtggaaataattaaygagtatgttttttaatttttgtygyggttgttgagtatatygyggttttttaggygttygtygttgtygttttygagttttagagtttttagttyggttttggagtggggygtttttttttagygaaaaggtgygaggagyggggtttygggtggtyggggagggggygygtygggtygggaggygyggagttagtygtttayggagtttaattgtttgtatyggggatyggygggyggggygygttygagtggtttygtygggaaagggyggygggygttggagaaggygtttggygygaagttgggyggygtttygagggyggaggataggtggtygygygatygtagttaggtagygaayggttygggggttgygtagygyggttttaaagtttagttyggtttygggtttagttygttgtygtttgttaygggagyggttttgygyggagggagggggygygagatygtattttygggttyggygygtttyggtttttgggttttygtttttttttttttttyggtttagttygttgttttagaygtgattttygyggaaggtgttggygatgygygttgttygggagygtgtgattaatggtttygaggtygtgggyggygtatgtattagtttttttttggtttggttagggtgtgagggtattygggagtatagygaggttatggtagygggggttttygggagygyggyggtggaggaggaggaggaagaggagaagtaggtgaygygggtygaagaggtttgttttttttggttttagggttggygtygyggygggtttttygttttaagtaaagtttggggttaygggygttgygtttaggttttttttygygtagttttttyggyggggtttgtgtygtygtygttgttagggtaggataaaggtttattaataygtgatgggatygygttttataaatgggattggagygagagggagttagagatagygygagyggagggagyggtagggattgygygagygggaygaggygaygggygttygggttggyggagaygggyggttttaygtygggttaggyggggttygygggaggatttagtgaagagtttgggaaggggygaggttygtyggyggtyggagtagyggggygttagtttyggtygttgtygygggygggygttggagatygggaygtyggygttyggayggattgatttgttgatygttygtyggaggtatattttattttattttatttygtttygttagtagttyggygtyggygtygtttttygtaygttattttttttgttattttttttttttttatttttttttygttttygtttttttttgtttttygyggygttagygtttttttttggttygggygggggtttyggttttttgtagagtttttygtagttagtgggggatatttygttttagyggataattagtttttgagttgggygagaggtgttaagggagtttttgtttygaggattaggggatgygaagggtaagatttggtagagttgygtttggaaatatttttttygtttttygttttttygggtaygattagtgtggtttttaagtgtttttygtggagtttttatttygtgtgagygaatygtgygtygg

SEQ ID NO: 6830 - DNA, 1679 bp, synthetic construct
  misc_feature 1..1679: note = Description of Artificial Sequence: Synthetic polynucleotide
  source 1..1679: mol_type = other DNA
ygttttttttygggaagattygttataagtygygtttttygtygtttttaatttyggggtygttttggtygtttgtgaagtagaygtttaygttattgtygtygtttttgggatttttaggtttygggggatagtygggttyggtattygggtygtygttygttttggygagtagattttggttagggtggygggatttgatatgtygttttaggtttyggyggygtataagtattttgtygtagaattygtagyggtagggygtattgttttyggygtgtagtyggatgtgtttgttgagattgttggggtygtygaagggtygtagatagattttgtatttgagtggtttgtagttygtgtgygttygtatgtggattttgagtttatatttgygygagtatagtttgttatagtagaggtataggtggtyggttttgggtttatttgygtygttgttttygttgtygtygttttyggtgtttttygtygtygygayggtyggtggtaaygttttygagtttaggygttygygatttttttyggtagttatttyggatagttgttgattgtgtatggygatttttyggtygatgttggttagygattttagttyggyggggtttagggyggtygttgtaggttygttgaagtaggagatggatttyggatattttagtagttygtygaagtgtaatttgagygggtaataagyggtggtggtyggtgagtygtagagtagtttttygttgtagattgtaaaggtyggtatgayggygggtaggtggttgtatttattattyggataggttttgagatygttygggtygaggggyggtagygygtagygttygaggggtaatttyggygtagggggtagttgygtataaygygtttttggtagygyggyggttgygggyggggygygttttaygtgtttgaaggyggaygtttttttyggggggayggagagtagagggaagtygygtagggttttagagtagggtaggttaggyggyggyggyggyggygggtttttagygagtaggtatttgggatggtggtggtggtgygygtggtggtgatggtggtgattygygtygttygtygtygagtttttttygttttyggggygttygtaygttyggttttygtttagtagtttgtttaaagygaggtyggttttttgtttgttgttgtttttttttyggtaggggtygtygtgagyggtygtygtygttttygttaggtyggygggtttgaaagttgagygtaygtyggggtagaaagttaggttgtygattttygtygaggagtygtttaygatgtygaggaagtgtttttgttttygggyggtttygtttatgtttagggtayggtttagttgttttttgttttttttgggttgtttttatttgtttggggtyggygaggtggtygagggygyggaagaggtttygygtttgatgttttttygygtatygtaggtttgaattggtggygggtttagggggtggggtygtaaagtttttgtttgggaaggygyggygaaatygggygtygggggttttggggagagatygaggttattagtygttgggayggygttttggygagtygygtgttygtggtgtaggaaggygtygtttttatygtygttgaataygtagtggaaaygt

SEQ ID NO: 6831 - DNA, 1474 bp, synthetic construct
  misc_feature 1..1474: note = Description of Artificial Sequence: Synthetic polynucleotide
  source 1..1474: mol_type = other DNA
ygygtgttagaagtttttttygygyggtttttttttttttttttttygtagtaggaggtttgattttygygttttgtattygtgtggattaaaygtttagtttttttygttataatyggaygggaattygygygtttttygggttattttttgtttgtgttgagttatgggygaattttttaaaaaggagatataygagtgggtygtttaattttgaggggaaaygaggatttttttttttatttttttttttgatttttttttttattyggatygtatttttygaattattttygtaaggaggaaygaygaatgtygtyggttttaygagattgtygttttttatttatgtttaaataaggatagaattttgtagygaggygataagaaaataaataagygggygttttaaatygagttttygggtgtgtagattygtagyggagtygygggagygaggtgggaaattttggtygyggygtygggtttygttygtyggggggygyggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygygtygggttttygtygagtagttgagttygtgtgtttygygtttygygtttygaagttgtygtttygaattttggtyggygttgtttaggtttttygttagggattagtygggtaaggatgggaggygtagttgtagtyggtttttttttygygtygggttgtgtgyggtttygygtttttttggttaaatygggaagygaaagttggattttagtttttyggggagtaattttgtyggttttggyggtagttgtttgttttaygygttygggtagtygggggygtygttttttgttttttttygttggtygygttttygaggggttttyggtttttggaggtygttttttttttygggtttgggygttgyggttatagagatttttaayggttagyggtygtygtttaggttaggtagttttagygttttygggttttyggttttatygagtgtyggttttygygttttgyggyggtaagttttttggtgagtttygtttttgtttttttygtygagttttyggggttttttttygttttttgtagggtygtttygagtygygtagagtttgygtgtagtygggygygyggtgtygtttatttygttttygttyggagagtagggtgggttayggygtttattttttattttygygtttygagagygtttggtygaggaggatygttgttayggattttttttttttaaggagygaggttagagggtttygggagagygtygatggttggggattygaggttygygttatttattygtaattttttttttygagtttttgggaaygg

SEQ ID NO: 6832 - DNA, 675 bp, synthetic construct
  misc_feature 1..675: note = Description of Artificial Sequence: Synthetic polynucleotide
  source 1..675: mol_type = other DNA
yggtttyggtaattttygtatttyggttgygtyggtygtggtyggaygttygagaygygyggaggtatagtagattttggygtataggttatgtygtygtaaayggggggygygtatttttttttaaagtttttagaggagataygtatttggtggtagggggtgtaggyggttgygaagtagggttgyggaggattatagatttggtatataatatttagatagtttatgatttttygtagyggagayggttaagtgtttttttattaatttttttttttyggagtttaggggtgttgtatgggyggygtttggattygygttttggagttattaggyggagtaaagttagygygtttygyggttyggaatttagttggttygttatttttttatttttgygattttattttygatygygttttagggtagaagygtttgagttttygttagtgggtatttaaagtttatgttyggygggygtgttgaygttattygggggttgyggagygggagggggyggtggggggyggggatyggggggttaatggggagygagggaygtttgttggaggggtagygagtgtgtttttyggggtttatttttgataagtatgyggttaagggtgtyggagattatgyggtttttagyggattygaggtttygtatygyga

SEQ ID NO: 6833 - DNA, 1133 bp, synthetic construct
  misc_feature 1..1133: note = Description of Artificial Sequence: Synthetic polynucleotide
  source 1..1133: mol_type = other DNA
ygtyggttatygtygagtttttattttatttaattagatygyggggaaggataygtaaatttgtygagggttygggggtttygggttgttgttgttgttagygttttgggaagtgataggtattaggatttgttggtgyggyggyggyggyggyggtagttttagtygygttygttatatatatttttattygttyggtgtataygtygygtygygggtagtgtygtttgyggaggygygttyggggttygtaggggtagtagyggtagtttggtagygtygtygygttttygggtatttggttygygaagtttygtttttgtygtttttygygtygttygttttaygttttttagygyggtygtygttygaygygygttygttttgygttygtygygygtyggtttygggggyggtagaagygygygagggtygttgttygtttttttgygtagttygyggtttttaggtattttgygttgttgggttyggygggygggggtggggyggggagyggggygygggtygagygggggygtttyggtttygyggttttyggyggttgttgtagyggttgttgygygtaatgatgygggttygygtygygttttagtagyggygttgttttttttttygtttagatgtgtgaattttttttttataataaattttttattttgttttttgtygtttttttttagggggttaattttgaggatygtaggggttgtygtttaggyggtygtaggyggyggtgtttaggyggaaaggagyggygygaaagyggyggyggyggggatyggggtttyggggygaggagtttgggyggtatgatygyggtttgttgagttgaagtyggtygtgtttttagagttatttygygggagygaatygagtgtgtgtgtgygygygygttygggggagaagggattaagaggagggttagggaaggaagttggggttatggaataggggtgtaatygaggtatttagagyggtyggaaagttygagtggyggagaggttagaggtggygagaaggggygyggyggtatyggaygtatygtttagtatttggtttttttgggttttygaggatttgaagggtyggagygyggagagttayggagtyga

SEQ ID NO: 6834 - DNA, 1808 bp, synthetic construct
  misc_feature 1..1808: note = Description of Artificial Sequence: Synthetic polynucleotide
  source 1..1808: mol_type = other DNA
ygggygggggaygttyggtagttttgtaaaygygtagataygygaattttatygtttygygygttttttggtttygttggtgygtgtyggggatgyggtygygtaggygttygttttttggttttttggtygggtagygggygttyggttatyggagtttagtttaagggtttagtygaggttttttygygygaggyggttgygttaggtgagygggtatygyggtygygttttttttgttatttatttagyggttagaggtattttgygtttgggagttttaagtgttttyggttgggtgtttttgttygatttttaaaaggaaagtataaatttygggtgygagtttaatttaggatygaattttttygygaatttgaagttattatggggygggagttattttagygtygygttygttygtttttygtatyggttaggatgttgyggaaggtaggggygtygagaggtaagggtgaaagaygtygtttatatttttaaagttygaatttgtattttttttgygaggygtagggygggaggatygttgtagttgggagtyggtttyggataggtaaagygattygataggtgaaygyggygggagggagtaaaygygtaaaaaattttgtatttattttttygttggygtttttttygggaggygttttggttgtygatgtattttataaagtttaaaatgataaaaagttaagaaattagtygtaagtgtatagtaatttagtaatgtttttttttttttttttttttttttttgattgttaattatatttaatgtttttaaaatatatgtaggtgttaggygtatatagatagtgttygagtagygggatttttttttttatattygataggygtgttgtgatggtaagygaagtggggygggtggatagggaaattaattattgtatttttaaattatttaagtattgaattgyggyggtttygttggggtggttggtatygtygygaatyggggttttaggagtygtyggggyggtygtaggtagtatgttgtgyggtaattgtygtaggygggattygggygggygagyggyggyggyggyggttgtagyggyggttttttgggtttagaagttgyggyggttgyggttgtagyggygggggtttttggagygtaggggagygggygtygtyggtatagyggttatggttaaggggyggyggagagatttygagttgtttttggygtgygygagtaggagaygttttagtgttgggttgggttttygggagtattatataggggaggaggaggaggagggtagggaggggggagggagaggagggtagggagggggagaggaggggggatggttgtggggggygggggggagttygggggyggggaaggaaattgttggagtaataattttgagygattttaataatttttaattttaagagggaaagagggagttggaaaagtataggygttgygttttggtagagggaygggaagaggygtttaaggggtttygggtttatagygtagtatttttggatattgtagtgayggtyggagaattttagttagaagaatggggaaagtagtgygtgygaagagtttttttagaagggtagttttggyggggagatttgggygtattggggttggtaggtagtgttgaggtygaagattttttatttattttagttyggttttttttygyggttttaagttaggygtattyggttgtyggtggtygtgygtttttgygtttttgtgttttagygtttttattttatttttagygtyggygygt

SEQ ID NO: 6835 - DNA, 1323 bp, synthetic construct
  misc_feature 1..1323: note = Description of Artificial Sequence: Synthetic polynucleotide
  source 1..1323: mol_type = other DNA
yggtttyggttgyggtggtygtttatttatttttttattttygttagtattttttttttttttttatttgttttgagtatygggttttgggggtygggtygtttttttttgtttttagttttggttttattttaggagttgtygggaygtygggygtttttggaggyggaygaagaaggyggtagggtygggggygttagygggaatttyggtygtygygggtagtygyggtttttttttttattttagggttygggyggttatygygggyggatgagttaggygagggggygggtggtaaggggtgtaagyggayggagggtgggggygtttttatgttygygtygggggggtatyggaggtttyggggtaggggatgygtygttgtyggtgtttatagagggtygtygttattygggygtagagtttaggygygtttgttttyggagggtatygggygtagtaagtygggtaggggagagggagtygtygtttaggyggygtygttatygygtttaagaaagataaaagggatygggaaygggaggggaaaagttttttgttyggttttagatggattttagttttaaattttaygttataaagtttygaagaggygggttgggggygggggtyggggyggatttttaggggygtggttgygygtttgygatttyggatygtgttaatttygtygtygttttaaaatttgtgggaaattttagttttgttatttattttttttggaggaygtagataggatttgttttgtaggagtttaggtyggtygattygygtttyggttataaagttgtatttygagagtttaaattattygtagataaaatttatttttgggaataaagtattygtttgtaggygtttttttygggttggaaggttggygtgyggaaayggatatatttattygtggggttygtttttagttatygygggattatyggttatygagttagggattyggtttttttagtttttyggagyggttggggagttttagtygattygtagtattttyggagtaggtatygtaggattttggttttaygtttttyggaygttttttttttagatgtygttyggygggtyggggtttttttggygggttgygygggygttgygygagttaaattaaatttggtyggaaaagaygyggttaaggttygttyggtttaygtttttygtyggttyggtaaggggtttyggagaayggtttgggggggygagaattatgggygggggaaatggaagatagagggaattgaagtaygggggttttygatgagtagtgyggatgttyga

SEQ ID NO: 6836 - DNA, 1501 bp, synthetic construct
  misc_feature 1..1501: note = Description of Artificial Sequence: Synthetic polynucleotide
  source 1..1501: mol_type = other DNA
ygttattygagttaatgaaygygattgttttgataaggygtttttaattttatygattttggtaaattgtaggagatatttagtttaygttatataaaaattattaaagtgggatygtygtagttgaaaagttygattagtgtttggagattagaaygygagtttttaaagtatataygtattyggtatygggaaagtttaggygtttgtgatttttygaaggattttgggttagtattttygygtttggattatttagggggttattagaaagtaatataygttataagaaagatgtgggggagatttygatgttygygtttttgttaggtggaggyggggtgtaggtagaagtygygygttggattgttggatgaatttygttaygygtaggtttygygtygatttyggaagggataggtaggttyggaagggatttttggggtttggggaygttttttagggtagagagtatygttgyggttygagyggttygggtttttaggygtggggtattyggtttttaagygtttttyggggaygtaggygtttaygtatygtttagttgygygtttttagtatttagygttyggygttttyggyggagtttygygtattttttyggaaagtttgggggtttttttaatttaggttttttygggagttttggggygggggttggaagaaggggttatttatttygtygttyggttygtttygggttttygaagtgtttgttttagtygyggtttagtgygttygtaattaagtatttattttygttttttttagtgtygaagtttttttttygygttgtgtttttggtgaaaataggatatttttttyggttattttataataaatagygtatataagygggggagaagyggggyggagggagaagtyggtttygagggggaggaggaaaggagaggagttaaaatttyggattgygataggggggaaaggagaagaaaagaaaatgagagagygygtttagtygtygtagtygttatttttyggtttttttygtagttttttttttttttttaaggtagygataattttaygtggataggatggaagttttgygyggaagtygggaayggtyggagygtgygtygygttgtyggtagtttygtatttgygtagggaggtggggygggggygaygtygttatyggttattgygggttygtgaggtygtygggggtttygggggaggtygttagggaygyggggggyggyggygygygggggatttatttygtttttatttgatttygggtgattgtttattgttatggtttgygatttygygtggggatygtttagggtttyggggttttggatgtttygggtggygtygtygtaattttygtgtttttygygtygtttttatttygtttttattygggtygattygagyggttgtagtttttaggttgaggggagggattygygatygygtttttttttttgggtyggagagttattgtyga

SEQ ID NO: 6837 - DNA, 1744 bp, synthetic construct
  misc_feature 1..1744: note = Description of Artificial Sequence: Synthetic polynucleotide
  source 1..1744: mol_type = other DNA
ygttttygyggttgttttttttttagggtygtyggtggtttaggatttggttatyggggaggggygtggttttgtygaagtygatgagttataygtyggygygatggtagtgatygtgtataaagaggagygagttgtygattatttgygagtttygtatygttaggtygyggttttgtttagagaygtttttgtygggttttygttttagttttygyggttygggtattygggtagtygtygtttatttygtgttttttgaagaattyggatatttttagggtgtttyggatttgttgtaggyggtttagatatygtttttgtagagggtggggtgggagaggagggtaaattaattaaaygttaaatgagtttttgttaaygatgaggagtygggatttaygttgtgtttggtaaatgtygttaggaggaggatttagggtttygtttagygtggtttagaagggaaggagygtagagtagttgygagttagygyggtgagggttatggtggggatatagtygagggtattgggttagatgataggggtagttttyggttttaggttttttaatattttagggtttgggatttygtttttattagtatttttttatttttttgtataaattttttaaagaygygaagtatttgttttyggtttygygtagttttgaagtyggtgttgtaggagtygttygttttttggatgtgggataggagtgttaggggtttygggttygttagtggggaagaggatagygtagagtagyggtattttttagttgtaggggayggygaggyggtgggagagggyggaggggtaggyggggygggagygggggatygggaaagatagygygtagtggggttgyggyggtgttagygaagygygtttgttttattttgatgttttygatgyggaagtygagggtggtgttggagttgatgttttttygttattgtatgtagygyggtttggtgayggygygttgygygtgtttttttttygtgggagttttaggatttatygttagtatttttttgtatatgttttttygtagtttgggtygtttaygggttttggttagttttttttttaggtaagttttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattagtgtgttttgttagttgtatttaggygtagygttttttgaaagggtttatgatyggtagattgattatggttyggattttttgttagtggtttttttgaaagygatagggttaaggtttgataatyggygtttyggtaatgtataagttttttttttattgaaatagggtttygttaygttttygatttatygg

SEQ ID NO: 6838 - DNA, 1801 bp, synthetic construct
  misc_feature 1..1801: note = Description of Artificial Sequence: Synthetic polynucleotide
  source 1..1801: mol_type = other DNA
ygygtagtttaggatagtagygygygggttaygggygagtggagttgtaggggttygggyggagagtygttgttatttagggaagttttygggatttygggtttttygygaagtttyggaygggygttatygaagtygagagtttyggtygagttttttygtayggtgggygtygygtttaggygagygygygaggtygggyggggtygggggtygttyggggagggggyggggtygggattttygyggtygygygtaggggttgggaagttgttttttyggtygygtygggygaggggttgygtyggttygygaggygtatgygygttgtygagyggttttygtttttttttygtttatygttttttttttttttttttttttttttgtattttygtygtttttttttttttttygtttgttgggtgttgaagttgggyggatggtagtaaatyggtttygttagaggatygagtygtttagtttygttttttyggatttatyggygygttgtttatatttttaggygatygggtaagaygttgtttttaaaataagyggtgttaagtaaatgatattaaaatgtttgttttgtattaatggatggattttttttaaggtaggggggaggtgaaggaaggagggggyggagagygygatygtttatgtttyggygggggyggttgygyggygttggggttttagttgtggtygyggygttttgagygggagygggggtygygtygygggttygggaagttgaatttygygtygttgtttggaygyggttygttygtygtttttagttgttgtagggaatygggygagtgttttgttygtyggggaaygttyggttaggttttagagttttygyggagagyggggygtttgttgggggyggtygggagggtygggttaggggygygggagatttygyggggaygygaggtgttgygggttttgtgyggttggttgggaaygaggagaatgtgttattaatagtgtttaatygattgattattttgggtgttgtgtttttttttttatttttttttatttttgggaaaatgtattgtttaggtggggaaggtgttygaagaagaggttgygaaaatgaattttttgattagtagtaaaatatyggaggggtgtgtgtgtgtgtgtgtgtgtgtgtatgtgtatgtatgtatagggggtggggggttttttttgtttttttttttttttttagttaaaggaaagggagttttggygtgtgyggygyggggtggattttatagttatygagggggygaggaygaggaaygtttattaatygygagtygttgttygggtgggygtatyggagttttttttgttgtaggtgatggtggttttttygtgatygatggaattatagtttaatttttgttttttygttagtttttttgttgttttttatygagtgttgyggtagaggttgggtgtagatayggtygttttttttttttttttttgtttttttgtttttttgaataaatgtyggaggattaggggatggyggagggatagagttggattyggaagtygygggtgggagttgtttttygygagttygaggttgttggtattttgtygygggtagttygygttagtttygggagtttttgggtttygggagagygagtyggggtygtttggttataaagatgttygygygttygttttgygtaygggattygttttgygttttgagttttgygtttygttyggagttygggaygtyggtttaygtgggagaatttttgtygttyggggayga

SEQ ID NO: 6839 - DNA, 1801 bp, synthetic construct; identical to SEQ ID NO: 6838
  misc_feature 1..1801: note = Description of Artificial Sequence: Synthetic polynucleotide
  source 1..1801: mol_type = other DNA

SEQ ID NO: 6840 - DNA, 1684 bp, synthetic construct
  misc_feature 1..1684: note = Description of Artificial Sequence: Synthetic polynucleotide
  source 1..1684: mol_type = other DNA
ygtttttttygggygygygggttttttgtygtttggagtygagttggtattggagygttttttttttggagygtagaggtattygaygttttgyggtagttygtagttttttttttaygattttttagaatagttttgttttgttttttttyggtttttygagtgygttygttattttgtttygygagaggtgaaygyggagaaagtaggatgattatttaygttttygagaaattttgggtaaagaaaggtattattttagttygtaygttgaaagtygtttttttttttttttttttttygttgtgtttgaatttttygggatatttagayggttggagtttttygattttaaggygggygayggtaaagttaaaygttagygygttgyggttttygggtatygaggygttttygttttygttatttatatagggygttaagtgtttygattygygagtgaygaggaygtataggttagtgataygattygtagttagtattgagygggaygayggggttygagygtaggagggtgygyggggagttgaggagygtygggggttygggygyggygygtatttgaggtygtygtygaggaggygayggggagtagygyggttaagagtagtagygtygtttaggatagtyggygyggygygygtagggtygtttyggtttygggggttatygagagttyggggtgggtyggggttgggtgtttgyggttggtaggggggygttggtyggagtttggggagtgtygaggygtygtygtygggttttygtygtygttygtttgttttgygygttttgygyggtgttygtygygtttttgtttygyggygatygttttyggtygtatatyggtagtygygtttygttattgaggtygtygatttttygtygagttttttagttgygttygggygttttttgtyggtgtgyggggtyggggttagggtyggygggggygattygggygataggggygaygggggyggyggggttygggttggaggygggyggggygygggaygaaggggtyggagygtttyggattgatttagyggttttgaatttggggyggtygttgtgtygggttaagtggttgaggaagttttttttttygtttaatttttttattttttggttggggaagtygtttatygygtygaggagtgttttttgtttttttatagaaatatttttgygttttaagtggggattygggtygggattttttattyggttygtagygttgtagtttttgtggttagtttagtttttttaygtttttattygtattyggygygtttaygttaggggtttttagygtttttagattttgtttygtttggttgttatttttagggygygtaygatgygggtygaaaaggaatttagtttttagtgtgttttgttgtttaggttaaggatttagyggatttygttttttttttttttgtaattgtaatattgttttaggtttttttatttttttttttttttatttttttttttagtttggaagtttygyggttttttagatggattyggagygtttttggaggttatagtgatttaagttttaggaaggtygggttttggaygtygygtgttgttgttygtygtygatyggtgttttygtagagataatttggttgaatttatygtttagygt

SEQ ID NO: 6841 - DNA, 6657 bp, synthetic construct
  misc_feature 1..6657: note = Description of Artificial Sequence: Synthetic polynucleotide
  source 1..6657: mol_type = other DNA
ygtgygtgattggayggttttygygyggagygaggaggttygtagygtyggggggagggyggtttagtagggagggygatgygagtttggggaggggttagygattyggttaggaggtgaggatagttttttaattttygggaagggaagggtagggggtygygtttggggggygtygggtagggtgyggayggygaagggggayggaagggagagaggygttggggaagggatttttyggaggtayggggtagygtgygggttgyggtagygatttygattygggttttygggttttgtygggttgagtttgygttygtttygtygtygttaagtttttttaattttgttygttgygttyggatygygygttaggtttgggggygtagtaggggttgggggygtaygttgygtattyggggaygttyggggttygaggtggyggggggtttggtygygtygtttttygggggtggttygggttttaagttttttaggtttagygttyggtygygttygtygtttatttgttygttyggtttyggtttyggggttgygttygtagtygtygtygttttttaagttttaatttygttttygggattgaaatttttttttagtttygtttatygatttgygygygyggtttygtttttygtygygyggtygggggggaatttaagttygttttgttttttttygttttttttttttttttttttttttttttttttttttttttygtttttttgttygtttgygygtttttttttatttttttttttttygtygygagttyggttyggagtttttggttttttttttttttttttggtttttygagttttttgtttttttyggtttttygyggtaattygttttttttttttttyggygaygygtaggggttggggaaggaggggaggttttagaaagygtagggggygttttygyggttygttttyggtttttttygtttatatttaaaaggtggagggggtgggtgggtgggtggggggagtgggggygatagttgttggttgaataagttattygygatttttattattttaagtaaagttaaggygtttttaggttttttygtyggttygttttttattygggagggtagggatttaggggyggagaaygtagggygtaggtygggttttttttgtttagttttggtttygttttttttttttatttattttaatttttgtgaggattttagggggttttggagtatttttyggtttagttttattttgataatttgtttgtgyggaagttttygttygtatgttataggaagggaaattgagttaagagaggtttagaatttggttttatatagygygtygaaggtagagttttaggggtagtttggattttyggtaggagtttygggattttaygtttgggtygggtaggtttyggyggtgtttggataagttygygttygtagaayggtyggygtttggggattttttttagttttygygtagttygygygttttygtyggygtttttttttygttttttgtttttygttygtttttggttttyggttttagtattttyggtaygtttttygttygtygttagtagttgggtaatttaaygagtatataaaagagttgatttaatttaaaggtagtaaattaagataaattttatagtgtgtggggatyggagagggaatgtgaatgaaygtttaygaygtygtttagttttgtatggatyggtttagttyggttgtagggtttgataygttygggttttagggttttttaggagttagaatyggagagtgggttttgagttgttttggtttttaggtttttagtattggttygaatttagtaatttagagtttgtggtttttttyggttggttgggtggggttttygtgataggggtgtagagttttgaaggggagtgttaggaygaaagttagtgygtttttaygattttatgtaaatattggggggtaggggttttggaaatttagtatagttttaggggtyggtaggaagggtatyggtggtttggaatatttaagttgtggtttttttttttttgtttygatttggattayggttagagttaggtygtaggttaagagtaggtttttgtttatttattagatagatattgtaagtttgggatgtgttaggtttgggtttgtggaaygaggtyggyggtgagyggggtatttttttttttttgtttgtttgtgaggtttttttagttgtagttttattagggagaagttggtyggtttttagagtttttttggttaygtttggaaggttttagtaagttattttttagtttttggtttggttagttttgtgtagaagatgattatygggtttygggttttagtttatttatttygtttgttaaatataaattttaagagaggtattggatttttatttttagtaggtttttttaggtttgtgttggttaagtgtagtygaagttttggaatgagttttttttgttttygtaggtgtttttygtgtgttttgygttgtgttgggygtttgttyggaggagtygygttaggaygttttgttattttttaggagtaggtatgatgagtttattttttyggggtgtaaattgaggtygagggtttttttagagygtttttgatyggtattgtttgattttagaggttagttttgyggttattyggggtttgagatttayggagaattttagaggttaatttgaggggygggtaggggtaygygygyggggtygtgggaggygagatttygtaatttgaggagttaggattttagtagagagygaaatttggagttgggggaggggayggtagaggattggaggtygggttgtayggtaggggtygagttttygyggtygttttttttttttatttygagyggaggttgygtygttyggttgygatygagttttyggagtttyggtygggtygtttttttttygtggtygygtygattggyggtttgttgttattyggaygtyggygtygtygtygygaggatatttgttyggggtttaaygtygygttttaygttttttgttttttttttagatttagaatyggggagaggaygyggyggtgaagttgggaggttggaatttggagggyggyggagtttyggagttaayggggyggggggyggggtyggygttggttttggggataaagatttttaygttgtttgagggttgggttttgtagatatygaggtaggaagaaggatttygtatttttygttttttagatttttaaatttatttaggtttagatttgagtgtttaggtggggtgggggagatygaatttttttgggttttygaggygygygaaggygaygttgaaggggggaygtygggaygttgttttttttttgtataygtygttygagttgtatttttaaaygttttaggagtttygygggttttttttgttttttataattttygaagttgtttttagygattttttttygtttttagatggggtygtaggggygggygaatgtgttgygttygtygtgggttgggaggaagggygyggattgtaggaagtttttgtttttttttgggtagtttggtttyggggattygygtttagttygyggyggaggattyggtygggaatggtgttgagattgygygggtayggtttagggtygtgatygggtggttatygtgtagtttgggaagagaaaaagttygggggggggtygatatttygagatygaagagggaaaatgggaggaaagtaggyggtagggagggaagagyggyggaagagggattaggagagttgggggttygttttgggtttyggggtttygttttattyggtagtttagtttagtttagtttygttgygttagtttttyggatygggagaggttagggttatygaygtttattaatagtygygagygggtttttttygggagtttygtagyggtyggtagagtttagttatyggttggggtgggggygggggtttygtaatatttttttyggaggtttaagyggygyggggyggggygttgygtttttttaygtyggttttgygaagtygaggtatttatagtttattttttttttattttygatttygagattaggttttagatgaagaggggttygtttgtggtttaatttggggygtygyggttattttagygtattygaaggygygtttagttttttttttttttttttgtttagtyggttttttgtttttagygygtttyggaaagtttyggggttttygyggygtttttttagttttaggggttyggagttttggtttttttagtygyggygtyggggagggaagtttgttyggtttaggttyggyggtygttaatttygggtgygttygttttygaatttgggtgggtggatggggaygttygggagtygygggtttygagygtygtatttagagtttygygggyggggagattyggttttggygyggaygtygaggttagggtattagggatggggtggttygggttgygagagtygttggggattttgygttgtttttygtygttttttttagagagtatttttttttttgttttttttaggggyggggatttttygatttygtagyggygatagaggggtttttyggtttyggatagttttttgttttttaggtttttttttatttgggtyggggtgygggtttygggttggaggtattgtygygggygagtagagygygygtatttyggtttttygagtgyggyggyggyggyggyggtttttttttttttttttttttttttttttttygggttygttggttttagatagtttttttttttttttygttttgtyggtttttttyggagttygttyggttggattyggtttgygattyggagtttagyggagtyggygggagttaggttgyggygtttattgygttaagygyggggygagygyggggyggyggyggyggggatygygygttyggagttyggggttggtygggtaggygggggagyggyggtttyggtttygattygggttygggygygggygtagtggtggyggtygyggtagygtygaggttgtagtatattttttttgagygtgatggaaggttttatgtgggagagygygyggggagggatggggagggggygggggtygyggygggggygatyggaggggyggggggyggggtygttgttygtaygtyggtgggttggggggtggtyggaggggggtttyggaggggaagttggagttagtygygggggyggygtgggaagtygagtggyggtttygttttttttttttggttygtttygttygttttttgttttygttttaggttatttagaggtttttaggtttyggtttggaagagaagygttygaaggtttgggggtygggattttggtggygttgggaggtgggtttttgggtggggatayggttgtgtttataggygttyggtaatttygtggaagttgattttaagttagattttttgtgagygygygygttygygagggttaaagtatagttygtaggaygygygtttgyggggyggggggagagyggggtatttgggggyggggaggtggagygagagggtygtygggtttttggyggtttygygtttttagagattygtttttttttaaggtygtygatttttttttttttttttttttygttgygygtygtttttygtttttyggtygggaggagggggaggygtgggagyggttyggygtttttygattttyggaaggttyggtttagyggatttttttttttttttatgtgttttyggaattttagyggattygaaatygygttttygggttttgagtygaggggtttttygtygttttttggtggtttygagttttygtygagyggttttayggttttttagggygtttttygtttttattygttttttttttagtttgyggttttygtgtgggttaaaaattttaaattaggtttaagagygttttygttyggttaagttttygygygtygttttataaatyggtygygtgyggagttgyggagttygggatttttagygygygttgggygygatattttggatttygttgttagygtygygttttttyggtyggggagttttatatygttaagagggtagggagaggggaggggaggggattattggaggggagggggttgtttttygggtgtttttttyggaggaggtttygggataggggtgggggtggygygggaggtygtagatagygygtttygaggatggtygggtyggggatgggygygyggggtttttgttyggaygtgggtttaayggttttttygtagtttagaaatttygtttagttygygggayggtygttygtttttygatttygagtttttattatatttgtttttgtaggayggggttggggggattgagatygtgattgaggtyggggtatggaggaagtgtygtygtttgttttygggattgttggataygaagggtggaggttaaggayggagtttttgtttgyggttgtttagtttttagtttttgygygggggygtttagatttttagggaatagggagatagagygggtygagttygg

SEQ ID NO: 6842 - DNA, 546 bp, synthetic construct
  misc_feature 1..546: note = Description of Artificial Sequence: Synthetic polynucleotide
  source 1..546: mol_type = other DNA
yggaggyggyggggtygygggagggagggggtygggtttaggygattggtagygygagttygggagttttttygtgttttygttygtttygttttygttattatttgttygggatttggygtyggyggtttygggygtttttagtttyggttygggtttyggtttyggtttygggygtygattaggtttttttggttttygtygygygttttttaatttgttgttgtygtygtygygttttttaggttttgttagttattygygttttgagttyggggttagatttttatggaagygtygygatgttygtttttyggttgttggatttttagaagaygaaataygygaggtgagyggyggtygyggaggttygyggggagggagggaggggygygyggyggygggggtygyggaggttattttggttttygggtttygtygttyggagygttagaggggatyggyggatttttgattttygttygagaaaattaggatttaggtagtttygttttttygttgggatggagtaatyggggygttygc

SEQ ID NO: 6843 - DNA, 288 bp, synthetic construct
  misc_feature 1..288: note = Description of Artificial Sequence: Synthetic polynucleotide
  source 1..288: mol_type = other DNA
ygygyggygtattgygggtygggaaygtgttgygygttgatatygggttagttttttgtgatgggattttttttttaaaaaygtaggygttttttygggtygtagtygtagtygggagattgagggttagggygyggtygyggggttttttgggtyggggygyggtttaygttttaggtttttgyggttttgattagaagtygttgygtttttggtygttttttattygtttygttttygtaattttaggtttagggttatagyggtttagttttttttttttygyga

SEQ ID NO: 6844 - DNA, 947 bp, synthetic construct
  misc_feature 1..947: note = Description of Artificial Sequence: Synthetic polynucleotide
  source 1..947: mol_type = other DNA
ygtgaggtygyggtgttagtttatattttattgtgggtggygggttyggtttygygaggaggygtygtttttaaattttayggtttygygtagygaagaggygaggyggtygyggaaggtaggygtagtttatttttttygagaggtttygatatttttygggtgagtttygaaaagygygyggggatttyggttgagygttgggtygttagtaattyggtttttagagagttataygaaggaggggaagyggttttttttggggtttttgggaggtttggttygggtttttttygtagttttyggyggttagtttygyggttttggggygttyggatygagtaaaggtttyggygggygggtttttttttygttttttttaagygttygtttttygtyggtttagygtaggttttttygatttygttagygtagggggygyggttgtyggggatttagtagygggygygygggtaagtgygyggygggygygggttgygggattygtttygggttttatttyggattttttttggtttgtttgggtgtttygggtygggggtagtygaggtygygyggygttttttttttgggttatttttttttygtttttttttaggggagaygaatygattggttgttyggtygtyggaayggtaggtttygtygtttttttygtttttygtattttyggttyggtttttttttattatygygtttygttttaattygtagttagtattttttttttatttttttttygttttygttgttatttttttttttggatgttggaagygtagttggtattttygtttttttaattttttaaattttttttttttattygtttattttttgtgtttyggttttttttttgggtgttgyggaggttttttyggttygggggygtgtgtgtagggaggyggatygyggaatagataygg

SEQ ID NO: 6845 - DNA, 1313 bp, synthetic construct
  misc_feature 1..1313: note = Description of Artificial Sequence: Synthetic polynucleotide
  source 1..1313: mol_type = other DNA
ygagaatttgtygtagggggagatttygtygttaggttttgggaattgtttgggygtygttaaagttygagtyggagttgttatttggggtagyggtygggaagaggtaaygatgttagtaagaaagtagyggaggtaggaggyggtyggaggagtggattggagyggayggagtttygtygttttttagttyggagygtttggagygaaagttaagygtttttygagggygatttttttttttygggygygygtttattygttgtagtyggtagttyggygggagaggtggtagttgtagtttygtatyggggagagygagttttttgygygygygtttattygttttttaggtgattyggygttttygtygygttygttggaagtttgtaaatttttttygggggtttygtygttaygttgggaagttggggaygyggggggaggtttttggttygtygttttygttgtygtttgatygtatttttggagggtttygtattttgttaggtttttggaggtaaatatatattttygatttataattggttttygygttaggggattygygygtttttatataygtaygtaygtygggyggattyggygtyggttttaygttagtatttttttaggygygyggygyggyggttatygagygtttyggtatttaygyggygyggggtttttagggtggttttaggatatagtygaattttatagtttattagtattyggggtyggatttttttttggttygttaaaatgtttataaatatagattattttttagaaaaaaatgtatygtattttttttattttttgttttgtgatttgtttattggattaagtaatttygyggttgttgtygagaattaatttttgtaaataagtatattttygagatggtttttgyggtaagtgtaataaaagtggttaaatgtaaaagttttagaagtggtygagtygtatttttaggaatttattaaataagtgtggagaaggtaagagyggagttygggtgaagggattaygttggattgagtaaagattataatatattttatttagagtgtattatattattttttyggtgaygttaygtgggatttttgaatttttaaattattgyggttygttggggagggayggagygaggggyggggtyggygygtygagggggtaggtttygtttyggtttygtttygatttygtttygtttgygyggattttggtgtattygttygggagyggtagyggygggggygattgygtaagtaatagtttgtagagtttagygtygtgtgataygg

SEQ ID NO: 6846 - DNA, 848 bp, synthetic construct
  misc_feature 1..848: note = Description of Artificial Sequence: Synthetic polynucleotide
  source 1..848: mol_type = other DNA
ygygaagtttygyggtttttgygtgttttggtttygggaggataaggatttttttttttttttatttgygygyggagtygagtttttgttgaggtgagggtttyggaagtttaygtagtttygtaggtyggtggtggtygyggttgttttgygggggtgagtgtgttyggtyggggtyggagtttagygtgtgttyggtagayggyggtgttygygygttttttttttygygttygyggtgatagtttagatattagttygggygttgatagaygattttttttatttgttagttttttygtttgttagtagagttgttggtaagtgagagaaaatagaggggygygaaggtaggygyggttagggagtgagyggggygttgggygyggggyggagtygggtgygyggygttygggttaggttttatygttygygtyggttttygttttgtttagtygtygtttttttttttttttttatttttttttttttttatttagtttttttttttatttttaaattttttagttgygygttgatygtttttgtggttttgtttgggggtagggggagaataygaatagattygaggtgtttttttttggagttggagtttaattttaatttttatttttatttttatttttgtgtttatttttgggtattagttygggattatggttggttttygtagttgttttyggagygtatttggggttatggtttgtygygatyggagttygttttaagtyggagtttgggggygtagaagggggagygygtygagaaagtgtygggtaaaygygygtygygtttggttgggtatygygagttgggygaggagaygg

SEQ ID NO: 6847 - DNA, 2406 bp, synthetic construct
  misc_feature 1..2406: note = Description of Artificial Sequence: Synthetic polynucleotide
  source 1..2406: mol_type = other DNA
ygggggaggggtataygtagttttygtgyggaaagatggtgttttttttttatagggttgygygggtatttattttygttgtaaagygttygggttaggygyggtttgtttygggtyggggygagttygttgttttttgyggtagatagygatgygygtttttygttttagttttyggttygttyggyggttygygygttttttyggtgtagtatgygggygttgtgaygttttyggataaatgtygtgtaattgtgtaggygaatgagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatttaatgtgattyggttgattatgtaaagattaggattggaygtttttgtagttttatttygttatttatttttttttttttatttygtattagaaataaagtggggggggggggygagtttttggaggagaaaatgataattggtatttaattttaggtttatagtgygtygyggtggggygtaaagaygtaaattttygggatggygagttttyggggttttattgggttaaaygaaaattgatttgatttgttttttaatattygagggagagaaggggagatgaggggagggagggtagggtttgagtgtgtgygtgtgygtgtgygtgtgtgtgtgtttggggagggggaggaggtattaagttgtagtttgygygyggttttgygtttyggyggggttgygtgygtgtgtttttgttygygttgttgaaaygggtttttygagggatyggygttatatgatttygtttgtttttygttagygygtagatygttagttttttagtttgttyggtatyggaggagggtygggyggtatttttygggtattggggttttgyggagyggagaagaggttttagyggggaatggtatatttggatttaagaagtygyggttyggygttagattttggagtgtagatatttggggggaggggagagttagagggagygagygagygagygttagagagaggtagygygtagygygtayggayggggggttgttgygyggagaagatgtaagygygtggggtttygttggtttttgagtattatgtagaaggggattyggttgaatgatggttaygtygygtttttgggattgttggygygtaaggayggtaygygtaaaggttatttgagtaagyggagttyggataatataaaatggtaaattaagtggttygygttgttgtagaatttgtttttttatttygagagygattygagttygyggttttyggggttttatttgttggagggttgygtttgygatygygygtttttttttaagtyggygttgtyggttaaggagtygttggagaaataggtgaggygagygtygygttttgatttttttgygtttyggtygyggttttgggggtttagggttttyggttggttgatggygtttgaattttggtttttttatttttggygttttaggygttttttgtatttttagygagaggggaggtttgtttttagttaggygagtgattgyggygggtagagggggtagggattgagggyggggagtagatgtgggttgyggttgtttttygtyggaygagtttygtgggaggygggtatagaggggtygatatttggagatgtagaggaagatggggttttaaggattagagaygatgagtttggatataygtttagttaaaaatggtgtttttaatttttatttttatygtttagttttaatagtttygatygtttgttttatatygggaaygtgtaatttttygygtttaggtatgggaagggtaagayggaggygttygagygttgttagtttttgtttygtygtagttgagggyggagagyggtttgygttagtttttyggagttgggttggggttatggggttataygggtyggttyggtattatygagyggtggtgggtttttagttggyggtygtyggagtaataagtttaaagatttttaaggatygttttgatgygtyggggttagggttagggttgttgyggaggtagygggaygaagtgggygttttttttttttttygttttttgygtygtygtygtygtygtagtygyggttatagygttgygt

SEQ ID NO: 6848 - DNA, 1218 bp, synthetic construct
  misc_feature 1..1218: note = Description of Artificial Sequence: Synthetic polynucleotide
  source 1..1218: mol_type = other DNA
yggatttaygtyggttttgttaygtgttgttygtagttttygttygtttttttygygttggtaaygggtattgattgttygatattttagygatygtagagatttttttaatgtygggygtattatyggygggttagyggtttygttggtttttttgatatattttttatagttattttttttagttgagatttttttttttaatatttygttaattaaygtgtaattttttggttaaaatgttagagttaagattaaatttgaagaaaagaatgaaattataggaagttttttagatttagtygttagtaaggttatggttygaagyggtgtaggggyggygygtygggaagttattggtagagttgtgygtattggggggtgttgtaagygttggggagagtgtggagaggttgygtggagttgygygttyggggtgggagttgtatttttaatgaagygygtgaagggtaagyggtgatgggttttgygttagtggggttgggagygtgttgggggttgtaygtggggttgygygtaaggtgagaattgygtatgtgggtttggggattgygygtatygaaggttgtaggygttggggagggtgttgggggttgtgygtggggttgtttttatyggaagttgtaygttyggggaagygtagaggyggggtgttgygygygttggggagtaygtggggggataygtagggggataygtagggattgttygygygaatggtttygaaygtatgygttttattttatattttatagtygttatgaygatygggaggttygttygttaayggttagttaayggttgyggggataagttygttgaggttgttaggygagttaggtttttttggatttygtttgattyggatgggttgtgtttgaaattgatttagttttattagggattatgaagaaataaggagtaaatttaaagtygttgtaattttttygttttagttygtttaagyggtygtayggggtttttttygttygggagttggaggtggaaaagtyggttttaggyggygggaaattgttagggggygttaggaggtttttttyggggaggattttaaatttgaaaaagygaaaaggtttggagttaaaggtggtggttaagatttttttygattttttttagttygttygtaattttttggygtagtttygggaagaggtgtaygaattgtaggygygg

SEQ ID NO: 6849 - DNA, 1848 bp, synthetic construct
  misc_feature 1..1848: note = Description of Artificial Sequence: Synthetic polynucleotide
  source 1..1848: mol_type = other DNA
ygtagtaygagtgttagggygygtatttggggggtgttttggyggtgtggagagagaagagagagggygygggtgatattaygttygggttttttttttttygtygggtgggtggggtttyggygygtygggagggygyggggttaagtagggggaagaggaggagtaggtatgaatgtgtttgtgtgaagatyggggaggggtggaggaggaggaggaggaggagaaggaggaggaggaggaggaggyggyggyggyggyggyggyggyggyggagggyggggagggagygygygygtggttygyggygttygggtttttttttagttttygatttyggttygygaygygtygttttttagtygtygtygttygtttygtagttgggatttatttygggtttggggattyggygggygggagaagygggggttttyggygyggtttggaaggagygagaaagtaaaagtaaggygagtagtattttaagtttttttaatttygttttttgyggyggtaggygttttgttgtttagygygtttttttygagttygagagtggttgaaagaaaagggattgggygggggtyggggyggaggaagagagagtgygagggagygaggagagttyggtaatatttgttaaaatttgggggaggaggagygyggggaggaggaggaagaggaggagagaagggaaggagggagygygygggaggggagygyggagtygagggataatttttttatttygtgagtagtgtaggyggtgttaggtyggggyggggggtttttttatttagtayggggtattaggtygggatgggatttttttttagaaagtygattggatgttaggagaggygtayggttgggggttttttttttttttttttttttttttttygyggttgaattaaattagaattgttatttagggtttgtgagttagaagggatyggattataygattttygaaattgatgtyggagttgtaygagygggagggagygggtaggggtagygttatyggygygttygtatattygtattygygtatattygtygtttttatttattygygtygttttttygtttttttygygygtttygyggtygttygygtygtattatgttygyggygggygtatttygygtttagttyggtygttygtggtagtygtagtygttygyggtygygyggagyggggagtygttagtttgygtttygttygygggtttatgggaagttyggggatttgatagtygttgtygtygtaggtaygtttygttygaagttttttgtttygyggatttygtagttygtttttgyggtygygttygygttttyggggttagaggtggtttttagygtggggaygggatggagtgaaaatggttgttaaaaggygtttagatttagagagtygtyggtgaggygttygagtaaggtttgtattygttttttttttttggaaggtttttttygaagagttygattygyggatyggtyggagayggattggagaattttatttttyggaggggggaygaagtttgtygtagtggtggyggygtttttygttttygtttttatttaaagggtttagaagaatttygygagtttygtaygygtttggtttttttttttgygyggtggygttttayggttygggtttygggygygtayggygttygggatgggyggaaggaggygggaggtatggtgggtgygygyggggattttygtygygggggtygtygtygttggggtttttttagttygggttatgtttyggagggygggggtgtggtgtgagyggatggagagaggygygttttygtygt

SEQ ID NO: 6850 - DNA, 2119 bp, synthetic construct
  misc_feature 1..2119: note = Description of Artificial Sequence: Synthetic polynucleotide
  source 1..2119: mol_type = other DNA
ygygggaggtagatagygttttygtttttgtaattatttygttygttygattgggaagatagtgataaagttygggygtagaaaaggtagggttagggtaatygtygagtggtagyggtagggattagattgtgtttgattttggtaaattttattttttttgggtyggaggtatgtttatagaagggtggttagtaaggttggaagagtygaagtttttttttattatttatatattattttygggttygtagggttgggaggygagtttagtaygygttttaggtgygtaggggaagagtttagygttgygygtagagtyggttttggagtttgttttgggggtttgtttttttygtttatttttagtttttttgtggggatgggtgyggtaaaagatyggyggatttttttggtygtygtttggtygtttattagttttttgattttggttaaatttttttttttttatatttgttttttttttttatattttaygttaggggygtttygtggattgtaattttgaagagagttttggtyggagggtgttagtttygattgygtttttaattygtaggagtgattttgaatatatttttattyggagttttagtgtttttattygtygtataggaaaaagygygttygatttygggtatttttagtatygttttagtaagtgtgttygagattagatgaggggtgygyggttgtatttatygttttttagagaygtgggygtttggyggggattaaggtggttgtgattagtaagtgygaygtagttattaygagtttaaagtttatggttagtaggttgygtaygggtagtaaggtataggataygaaggtgattaaaaggagttgttaaattttttgttyggyggtygttggttttttagyggtttyggyggaatttygggyggggtygtttagygygaaaggatagtagagtagygygaaggtgaggttgaagagtagygttagttggtygatttgttgtagttggggtatttgtagggatyggaygttggttattaygagtagygttaggaagaggaygtagtgtatygggtgtgagtttttggttaggtygggygygggtttyggygygtttagtagttyggttagygttagygygttygttagtaggttgagaayggttagygtttttagygtggtygtttgttttagtygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygygtttttygtyggttyggggygtyggggygygggyggyggygtyggggygggygggyggygggyggygaggygtyggggygyggggygyggggygggyggagttggggygtyggttgtttygygygygygttyggagygygttttttttygttygtygygtttgygtattggagttygttygygtttygatygtggttttyggyggygatygygttgygatagtygagtttygggagtygygaatttgggygygtatagttygygttttaatttygygttttgygttttygttygtyggaggagtygygtgatttygagtattttttttgtttttttygagttttagtttttttatygtgtatagtggaatttatttttttggygttatttggggagtygaaaatattgaaattttgygaaattttttgttgyggggtagttaattttggaaaatatgtgtttttttttatttaataaaattaggttattagatttgagaggggttygygtttgattgygaatttagggttttygtttttaygagayggagaatygaygtttaagaattttyggggttaggaggaaggtggaggtttggggygtaygttttttttatgygtatgagggatttttygtttttyggtaatttttttttaagttttagggtygyggagattttgtgggygggtgygggttgygggagttgtgttggggaggyggygg

SEQ ID NO: 6851 - DNA, 562 bp, synthetic construct
  misc_feature 1..562: note = Description of Artificial Sequence: Synthetic polynucleotide
  source 1..562: mol_type = other DNA
ygggtygttaggagggggagggggaygygygtygtygggttygttattttgtattyggggtygttggtyggtyggggtatttttaygttygtttygttggygagattggagggattygggatatygtaaagtattttttttagtgtttgggagygttygttgtaygtttagttttaygtttttggaattggggttttttggttttygggtttaggtttyggttttaggatgygagtgtttattygagggggtgggaaaagttgatttttygtaagggaggggaaggtgtaatttatttttttagataattaatggaatatttttygtttttttttttttttatttgtttayggtagaagttaggatggygttttttatgttggtttgggtgtatatataagtgygtgyggaagggtggttgtaggyggaggtgatagygaagtaatttygtagttygttygayggttttttgygttttagatttttttttggygtgtaagatatygtgtgttttygtaaaaygggaatgttatatttgatagygtattttttygttttaygg

SEQ ID NO: 6852 - DNA, 1404 bp, synthetic construct
  misc_feature 1..1404: note = Description of Artificial Sequence: Synthetic polynucleotide
  source 1..1404: mol_type = other DNA
ygtttgttttagygyggttttygggggaggtagtagygttttttgtttttyggtttggtttttgyggtygtagtttttyggttttgttagggttgtyggyggtttygtttgtttagttagggttgyggtttagaggaaygygygtyggtgtttygggttgtygygtygttggattttagtttgtatttygtttttttttttttgaaaaggtattaggaaaagagagagggagagaagagtttatagtaggtaagtttggtttgggttatttgttattttagtgggagggtgtgttggagatygyggtgttaagyggggatagtygggatttgggggtggttgtgggttygaagtggaggaygagtatggtttgggagataaggaatygttttgagatagagaaggttttygggagyggatagagagtgggygaaatyggtgygtagtaatygyggygttagttttagygyggtttttggggygtagttttatttygttttagtagttgyggagttttttgaygagttttygtttggtagtattgtataaagttttttttttgagaygygtttaggaattttgttttttttttggttttttggtttttttattattttttttggtttgggtagtagagagygtttatgaatgtgttttyggttttygtaggttgtaggtttatttggagaygttttagtygggaatattyggggagtatttgattaaagggtatttgygttttygttygtttttttttttgttggtttgggagaagggaaaggggtaaggaagaaggaagggaagygtggtggtttttgttgtagygttttggaagaggaatgggygaygttttttttttygtyggggaatygygaygtttygtttgatggaagtgtgtatttttttagatttagagggaaagttggagttaaatagtagttataaagttggttgtttgaaatgtggttaaggtaaaatattygggggatttttttgtagtagtgggtttggttygttttggaaaggtyggatttgattygtgttgggtatttaattaggagtgyggtttttagggtgttttttttyggtttttgtttaaygagtttggagttaatgygttaatgggttattttggtagygtaygggtygttttyggtattgtttttttttttttgatgattygagtttaattttttgggttgagttgttttgttttygttatagtgtaaggagggaagttgataggaggaggagaygtygygttgtggtagggagttttgggatttaggggattggaagagagtygygygttagtagttggggtygttggtgttygggatttygagttatggggataggagttaaatagtygaatttttagygatttygtttygagygaagygg

SEQ ID NO: 6853 - DNA, 819 bp, synthetic construct
  misc_feature 1..819: note = Description of Artificial Sequence: Synthetic polynucleotide
  source 1..819: mol_type = other DNA
ygygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtygttygattttttgtattatggatttygttygttttttggggttgtygattttgttgttttttttgayggaggttgtattgggygatgttgtttaggagttaataggtatttggtygttttaggagtttttttttttaatyggyggagagggygtagygggttatggggtttygtgtaggygttttttaagtttygttttttttaggtttttgtygygygtttygttggtaggggggattygtttttaagtttgtattttttttgtagaggttttttygttyggaaggggatagaatttttygggatgttttttttttttaggagttaygtttgattatttttttttttttttgttttttttttgttttttttttaggaaataaygyggagatttgttttttgtttttagattayggattttgtygggttttattttttygttattattaygataggtataygtagagttgtygttagtttttgtaygggggttgygagggtaaygttaataatttttatatttgggaggtttgygaygatgtttgttggaggatagaaagtaagtgttttgygygtatttaggattttygygttttttgygtyggyggttggtagtagtttygttagttttttaygtttygt

SEQ ID NO: 6854 - DNA, 1128 bp, synthetic construct
  misc_feature 1..1128: note = Description of Artificial Sequence: Synthetic polynucleotide
  source 1..1128: mol_type = other DNA
ygygagggtttttagyggttygyggtttygggyggatttttagaaygagtgygggtygttyggattggtagattgygagtttygaggggygygggaygtagtyggtttagataaagaaatyggygttagyggtygtttttgtygttttttttttttttttaygtatttttttaggaaaaatagggtatattgayggttaaaggggttggtttttttttttagatagttggaygggaggtgttttttgyggggttttgaygtttttygtagaagagtygygggtttagyggttttygatagygttttygtttygtttttyggygggygtttttttttgttttttygggtgygaatygggygttggtyggggatttyggggaygygtgygtttttygtygygygaggtgtygtygagttagttygagagggyggggggygggyggggyggygygygggggygggggagyggtygggataygtgtggyggyggygggggggaygyggygttyggggttttaagaaggtgtggagyggggygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyggygggggttygtttttaggttygttttygagttygtttygttttygttygtttttttttygtttttttttygygtggttttttygtttyggygtttttaaaattgaatgagygagyggygygtagggygygyggyggyggyggyggyggyggyggtatggagygtagtggttgggttyggtagattttttttttagygttgttgttgggggygaygttgagggygygygyggyggttggttattattttygtttttygttttttttttttttgtgtatttattayggggagttggaaggggatggggagtagggygaggtgtttatttttttgtatattgygggtaattttatttattaygtttygggataagaatattatggtaggtatygtagtattttygygttygtygtygtygggtgygttygttagygt

SEQ ID NO: 6855 - DNA, 1128 bp, synthetic construct; identical to SEQ ID NO: 6854
  misc_feature 1..1128: note = Description of Artificial Sequence: Synthetic polynucleotide
  source 1..1128: mol_type = other DNA

SEQ ID NO: 6856 - DNA, 1128 bp, synthetic construct; identical to SEQ ID NO: 6854
  misc_feature 1..1128: note = Description of Artificial Sequence: Synthetic polynucleotide
  source 1..1128: mol_type = other DNA

SEQ ID NO: 6857 - DNA, 1921 bp, synthetic construct
  misc_feature 1..1921: note = Description of Artificial Sequence: Synthetic polynucleotide
  source 1..1921: mol_type = other DNA
ygggygttgttttttgyggtttttttygtygaggtttgtgygtggyggggtttttaggagyggtagttygtgyggtttgggggyggtttttttttygtatygtagyggggygtgtaaagygtttgyggttgtagtgtgggygtttattttaygtgttyggyggygtgygaggagtagtaatattttttgtgggygatgaaggtggataggttgttgaatttgatgttgtaaagayggtagtatyggtggttgtygttgggtagyggygtyggygtgtttttgttgggagtttggaygtttttgttygagtaggaggggggygtyggygggggyggtayggtttygggygyggyggtyggggaygggggygggtygggyggyggtttttggggtttygggtygaggtygtttygggggttaygggattygggttgyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtygtttttygygtygtttayggagttattygggttttggttgttttygttgtttyggtygttygygtygttttygggygtggtygygtttttagtttttttttygygygtttyggggttyggggaygagygyggygygtygggttyggygggttggtyggggggygygygggtygggtyggggggygttttgggtttgygygyggtaggygygttttygggygtayggyggtttgaatagtagaggygtttgtgtaygtagtagttgttgaygttgttgaaggtgatttygtattygaagtaygtagygtttttgggggtttyggggaagagttyggtttgygygtygtyggygttygygttygygttttgttgtagtyggttgtgtattagttyggatattttggttaggattttygaggyggggggygtygygtygggttygaataygtattgyggaaggaatagggtttyggttaggtttagttygtygggtatygggttggagttyggygtggggttggatagttyggttttgattttggtyggggyggggttgygyggygayggygttygygayggggtttggggtttaggtttttyggggtttaggatgggggtygttttyggtttttttatygtttttattttgatgtttttgggggtygtygggggttygttgttgtttttattttgggttagaggtttygttttggttttttygttggtggtttyggttagggtttttttgtttagttttggygatggggtgggygttaggtttaggttygygg

SEQ ID NO: 6858 - DNA, 2872 bp, synthetic construct
  misc_feature 1..2872: note = Description of Artificial Sequence: Synthetic polynucleotide
  source 1..2872: mol_type = other DNA
ygggtgttagggygygttgyggtttygygggtgggtagaggygygtagaaaaygygygggtggygygygyggttatttagtgggtttygttygygtygtyggygtygtygtygtygtygtaygtgygtygtygtgagygygaagggygttyggattygygttttgttygttygtttgttygtyggggttattgtggatttttaggtaatagttaagtgagaagttttttttattatygaaaggtgtttgygttttttttaygtttttttattaagtgtygygaggtgygattttattttaaatttatttataaatagttaggygatttttttaaagyggaataaaagtaaaattaggttagatatygggggaagtyggtygtgttaaygygtggatagggaaaggaaygygattaaggtagtagttatttttgtgtayggttatttygaagygttagtagggtttaggagttttttgattttagaaataggagtgttttttttttattttttttttttttggagaagtatttttgagatgaaygttgaagtgtttaatttagaygygagaagygtgtatttgtttaattgagtaaataaaggttagtagttggattaataaagtgtgtgtttttaatygttagatgtttttattgttgttttttttttygaggttgggggtgggggtgyggggaggaaggggaaaagataataaataattaaaaagaagagagtaaataaatatatatttggtgtttygatatatatttttttttagtygaggttttttyggaygaagtaatattttgtattatttaaattaaaaattattygtgagttaatagtaaattttttttttttattttttttttttttattataaagtaaaatgaaagagaataataagtggtgatgttgggttyggaatgygattttaaygtygagtttaaatttgatatatgttatattygtttyggtaagtagggygttgtttttggggygaaattttgtygttatygygggaggagygyggagtagagtaaagtygtagttyggtttagygtggaggtggttgggatagggtggggtgyggaggtgtagygygttagagtgagggttaagaaatttatygygatyggggaygtygtgggtagygtttygggaggtggtattygyggyggygaggtagaagtttttaaataatatatttaygygygagttygggtagttgttgtygygagtggggggygygttyggggagggggggggtygaggaagtygtagttagyggaygyggtygtygtataaataatyggggygggygttygygggygggttgygggtggygyggggttagagttagggygaagyggyggtygyggagttgtaygygtyggygtgtttygygttttttyggaggttygygttgtttygygtagtygttttttttattyggatttgtgtgtgtgtgtgtgtgtgtgtgtgtgtttgtgtgtttgtgtgtgtgaatgtgygttggtaggygygygtattyggtygygygygygtgttgttggtaatgygaattgtatatatattgttygyggggttgttttttttyggaggggyggggtgggggataggaygtygtagaggattttgaagtatygtyggattatttgtttgttttgttttattttgtgttgttattgtygttgttgttgttgataggtttggaattagttggttaggatgtttttttttttygtttatttattttttttygttttttaatttttttaaggagggggaaaygyggggaagaatattgttyggatttgtagyggagttttttggttgaygttaggtttatttgttatgtaaataattygttggagaatttgtttgtgttaygttagatttttttttatttttatttttttttttattttttgtttygttttttttagttygttttagayggygagttagggaagggggtggggagggaggygagaataaaatygtatgttgtattggtaaagtygagttgtgtttgttgttttttggtagtttttaaagtaygtttttttagtagayggagttgttggtaaatgaaataggggattttatttgaagtgtagaaagtttygaagggatttaaagttttyggtggtagggagttaaaagtatatggtagtyggaaagggagattygagygtgygttaaagygttgattggtttttttttttayggtgtgygtttttgyggtttggggtggagagaggtygagtgtttttttttttattgttgttttggtttttgttttatttgggttaaggagttttygggttttttygtggtygygtagtttaggttatyggggygyggtttggaaggaaggggtygttaagttgggatttagagagtttgaggttttygggaagggttttattagtgattgaggggagtaaaagtaatyggaaagaaaggaaagaagaaayggttagagtttgtttygygygtattttaaagtygaggygttygygtgggggatgtaygggtttagtygttagttttgggtttyggtttttatttatygggtgtgattyggttgggyggtttgtttgggatttagggyggtgataggggaaaggtygagggaggagagagygggtttyggaggggaygtaygatyggaattttggygaggggtttttttyggagttttagtttagaggggggttagygtttttttttygtygttttttttyggttttttttttgttygygggtygggygatttttygtyggtygtttttttygygygtygtagattgagttygttgttttgttygtaagttagtygtaaagygtggygtttygagaggygt

SEQ ID NO: 6859 - DNA, 2906 bp, synthetic construct
  misc_feature 1..2906: note = Description of Artificial Sequence: Synthetic polynucleotide
  source 1..2906: mol_type = other DNA
ygygtttygttttttttggttygttygggtttagggygtygtttgtagttgygygyggtygtttttagatggaatttttttattaaygtaaggttyggtyggagtagttattygggagttgggyggygaggggttatttttttttatttyggygggtgtaggatyggggggtttgggtagtaattagtggggaggagygttggattgtgtaygtygagttyggtaggttttygtatgyggtatgygaagggaatttygaggtttttttgtagaattygagtayggttttttyggagttttttgtttygygtttgyggttttttgaattattttaataaaatgatygtttyggtagttatttatgtttttttttgygtagtgttygtagyggatygygttgtgtggtatttygagttttggggattttgttgtaygygttttttagattttygggggyggggagtggggagataatygttagagtygyggggygggataaatggyggaatygtygygyggygttaggtaaattttgtaagggaatygygyggtttgtyggttttattttaagtattttygaaaagaaagtatgtggygggatatttgttatttattatgtgttattttyggtgaygttttttggagttgtgtttatyggggattygggttygygggtgttgttygttgtgttygggygggygtygygttttttygygtyggtttygggttygttaggtagtyggagtygttgggtttttttataattatatttttttttttatygttttygtttttttttatttttttattttgtagttgggttttttttttttttttgggggyggggaaggggggatgatttttaaaaattagaattattgatatttttggttttttygtygttttaggttgaagagyggagggggattygygggtygagggtttttttttttgttygygttagggtygttgggtgatatygaaatttagaggttttygtttttygggggttttttttttygtttttygaggtgattggttggygygaagygattggygatttygggygygattttggtygyggtttttygygtygygtygggtgaatggtygygggyggaggatygggaggygtygggygtagattaatygyggtygtyggtgggagtatttgttatttatatggaagagatttggygtttgttaggttagtttagtttttttagtttagagattagttataagtgyggtygttgtgttygttttatgyggyggyggyggyggyggyggyggygttgatatggagttgygggttttyggygggtttttttatygygttttttgyggggagtagggtaagattygtygttyggtagtagaaagyggtttygaggaaagtaagtgtygaattaygggataaaaagtttttggtttttaaatttttttaaaaygttttgtttgttggaaaaggagaattttttygttttattttttttttygtttttttttttaaaattttttagyggatagttaggtgtattatttttttttatattattttagtgatttgttttttttgagtataagtagatggttttgtatgttygtagtttgtgagagaaatagygggyggaggtgaygggaatggggggagaaggagagtgggtattagggggygaggggttggtygggtattggagtttgattgggtgtttgttgattttaygttgtaaagaataaggtagttattttttttgtttgtttatgattatattatagtaaagaggtttagaaaagagggagattttattyggaatttttaaggtttggagatgtgattttttaaaagtttagtyggygaatgggagattgaagggtgaygggaagggggtaggygygttyggygttttgattgggygtgyggyggtaggattttaaagygttttgtttyggatygtttgttttgggtgatttttyggatttgttttggtggaattyggatttgtttygtygagatgaygaggtattttygtttygygaatttaataggagggatttttgaagttagyggttttygggatgagtyggggtaattttygttttttgagygtgggttggatggatgtttaattaggatttagggaggatgggggtygygggggaagtygggygtttyggggttttygatatttatattttygtayggygtaygttttgtttygagtttgygtttttygagttagtayggygagtttgggattttygtgttttttttttgtggttttygagaaaygtyggagtttygtgttttgttgggggttggggggatggagaaaaggtttyggggattttgtttaaaaagtaaaggtaaaygtattttaatagtttttyggtagttttygyggttggygyggttttagtttygggyggtttygygyggggygtgggygygggygttygggyggttaggtgyggygggggyggaggttgtatttttagygygtyggaatgtttyggggygygggaaaggtaaaagtagtttggygttttttttayggttttagtttttatttatttagaattyggttttaatagtttaaggaattgagaagaaaaaggaatttgygttgggaaataggggtttttggygggttgagtggtygttgttatggtagagatagaaayggagaggtagagatggatygtttagttatgttaagygygaagtttattygtttagttagaaagttyggatattttttgagtttygtatagttggtgaaaaaataatagaattattaaaaaagaaaaaaaaatttttttygtttgataygygtttttttggtgtaaatgaaatgyggagggataygygagttatttagttgygtaaaatygtattttygygg

SEQ ID NO: 6860 - DNA, 2906 bp, synthetic construct; identical to SEQ ID NO: 6859
  misc_feature 1..2906: note = Description of Artificial Sequence: Synthetic polynucleotide
  source 1..2906: mol_type = other DNA

SEQ ID NO: 6861 - DNA, 1696 bp, synthetic construct
  misc_feature 1..1696: note = Description of Artificial Sequence: Synthetic polynucleotide
  source 1..1696: mol_type = other DNA
ygaaggaggggttggyggtagtgtagtagygaagttygggttttyggttttgggagtttygtggtttyggtygtygtttttygagtttttattaygtagtttygaatttygaaygygagttygygtttygttagtagttagygggggtgaggatgaygygggtygggygagaggtaggttaaatgtagtagtttygtygygggtygtygggtttttgagtttygttttttagagttagggggtttygggtgygggtyggagggygggggtyggygygggttttttygtygtagtttygygtygttttagtttattagyggttatttaattgtttttttygatyggtttaaaatagttgygaaygtttgygatttgygygyggttttttatttgaygtttatttyggttygttygttygttygttttggtttygtttygttygtttagagggggyggggaggaagyggttyggggaggggggaggggggagggggagagaggaagagaggaggaaggaaggaggaaagaggaagaygggyggtyggaggygyggggttgygyggygtyggtyggygyggygttggaaggygtyggygttaatttygygaggtaggygayggagggggagyggygttaatatataagagtattgtattaygttaatttttttttagaatagtatgygttagtagtatatttaygttttgattgaaggataaaaggatgagagagtagtttgygtggttgtygtttgtaatatygygagttyggygygaggaggagayggtgggygtygygygtaggggtttygttgttgttgttgtygtygttagttagyggggattatgtttttgggtttyggagygtttttygtagtygygattttygttgtttaygtygttgtagtagttygttggyggygyggttattgagggygtygggagtygaagtygygaattygtttttttygtataaagtyggagtyggyggygygtygggggtygggtagyggygggyggygaygggyggttgygygtygtygggggttgyggtygtygtygtygtyggattygygttygttttyggattttttgaaggggtttgyggtgygggygygatygygggygtygygygttttttyggtyggyggatygggttygagygtagtygttaygtygttggttttygggggtyggayggagygtygtttygygtgtyggtagtyggyggattggagaattgatttttygtttttgttttttttatttttygagaagaggygaggagaaagggggtgtgtgtttggggagggygaaggygtygygaatatttttttttaattttygtygtttygygagtttaygatygtaattagttgtygtyggttyggagyggtygaygtygggagagggagygtagtatttagygagtgyggtttgggyggtttyggggygttttygtatttttttyggyggyggttygtagagygggtyggggtygtyggagygtattttggygatgaagygttttttttygyggttggagygagtyggtgttagggtttaaggataaagtygggaagygttggtggygtygttttttgggyggaggggggggtatgtatttgtatagttygtygggttttggtttttttaggygygttttaatttygyggtttygtyggtttyggtttygg

SEQ ID NO: 6862 - DNA, 2054 bp, synthetic construct
  misc_feature 1..2054: note = Description of Artificial Sequence: Synthetic polynucleotide
  source 1..2054: mol_type = other DNA
ygayggttagygtttagagttgtaaatttygaggyggttgagygtttttttttgagygygygtygtgygtttyggttatttatgtatgttttttttttygttttatatygttatygttagggtagtttygtgygggtygaggggatttaggggggtgtyggtaaaygttggtgyggaggagagtyggtaagtygggyggyggygggtgggagtatgtagggaggygttttttgttttttttgtyggtygttttttttygttttagatgttagtygygagtttygagttagygagagygagttagagagggagyggyggygggyggygggyggtagggaggagaggaggygaggygagggagggaggaagggaagtagggagggygggagggaggagaggaggatttagagagygttaggtagttggagtttttgtagygtttggtygggttttaatgtatagtagtagygagtygyggyggtagtaggtagttygggagtttyggyggyggtygagttagyggyggtttygttttttgttttttgtaaattttgygagtagttygttyggggggtygggggygygttygggaggttyggttyggttygyggtygagtttttygtygtygtagygttagtygtygtagttattatygtygtagtttygtgttttttyggggagtagtyggyggttttygyggttttttagtttyggttttagggtattgttyggygagtgtttyggtaagggtgggggttgtygyggygyggtyggtygygggttgtyggggggyggtygtygttatttagagaggygygtagaggygtygagagygtttttyggygggtttttygygtattygtygygttygggtagyggttygatygggygagtatgggyggygyggagtgaygtygttgtgttygtttggtattaaggatatttagttygygggggtggggaygaaggggggtagttyggygtygttatygtagttttygagagtygtygtygttgttygggtttyggggttgggtggaggaaaggggtgttyggaatygatttttatttttygatttttttgttggatattaygtttattttggaygtygtaagagaagttgttaagtttygtaggttttgattyggygtttttygygtttttyggttgttttyggtttttttgtgtttyggtggagtatttgygttyggggttggggttggaggaggtagttataygygygtataygtataygtttagaggagggygagaggtagyggtataggttttatttgtagtgttaatgyggygttttygttgaaggagggaaaygyggygygtttaggtaaggagtyggttygtyggggagtggggtygggygggyggygagggtagtaaggtyggatagatttgggtygattygggagtttttagtgtttyggagttagttygyggtataygtataygtatataygtaggtatatatatagatttatatyggtatatayggygttygygtatttgtttaygttttatttggaygttygyggaggtgtagyggtyggagtagggatttttygggtgtgttttttttttaygtttttggatttagatttttttttttygggattttyggggtgggattttgtgtattttyggttttgttttttattyggggaggttgagggagtaattttttagtttttagtttttttygtttttagttgggttttaaaatgggagaagttttgagaggttttyggagatttatttagtgttatygyggtttygtggtttttggatattttgggattttaaygggagatagatttatagatattyggaygtatatttggagagagtggtggtttagygttyggggaggaggttagataggyggttggggttgtagttttgtagggyggygtatatgaaatagatattgygtttttttagtaagaggtagtataaaygtttttttgaagygtggtattgttttttygggaatgygtygagattttaggtagaaagyggtttaaagtatygtygygt

SEQ ID NO: 6863 - DNA, 1258 bp, synthetic construct
  misc_feature 1..1258: note = Description of Artificial Sequence: Synthetic polynucleotide
  source 1..1258: mol_type = other DNA
ygaataaygtagyggygttaggygttagggtttttatttttgttttttggatttttttygtttttttgttttatygagggttttgtgattygattttatygaattaatygttgtttatygagggtttgttgygtttaaggaaggtatygggygaygagtaaggyggggaygtagtttggggaygtaggggttygggttttagtttagagataggaggtyggygtttygatttggtattygtygaygaatttattttaaggtttttattggyggagtttttgttatttttttttttttttaaatgtagttttygttattttttygygtttaggggttgttgtttgagtttagttttgtttattggagggyggyggtggagagggtgttggtttagygtyggtagttgggtttaggattaaggtgggygttygtyggttttggtttttttagttttayggtgtaggatttagggygyggttattygagtttttyggaygtttttttttttgatgttygttgtttttgttttggygtttttagttyggggtygtagtttgttttttttttttttttttttygtygtagttygtygttttygggtagagtttatgtttagtttgggttttygttygggatttaggaagaggttggyggggttggagggtgygggtyggygygggagggygygggaggyggggagyggyggtttttgattggtyggggygggggagtgagyggagttttttataatgtttyggtgyggtgtagtygyggatggatgttgygggaaggggttgttatttgttgtttttgttagyggygygyggatttgttygygtttttgtagtygtygtygtygtygtygttagttygttyggtttttgtagyggygtygtttgygtttttttygyggtygtyggagygggygttatgaattttagtttttyggygggagaggagaaaggggygaygggyggtagtagtagtagyggaagyggygtygggagttgttgtttgggygtygagggyggygyggattygyggggygtagggttagtygyggyggygggggtygttgttttggaygagttygyggtygtyggttagaaggagaaggaygaagygttggaggagaagttgaggaatttaatttttyggaagtaggtttygtataggtaggtgyggggagtyggtagtygagataggtgygtygyggygggagatttatttttttatttagtaaggggygttttygygg

SEQ ID NO: 6864 - DNA, 628 bp, synthetic construct
  misc_feature 1..628: note = Description of Artificial Sequence: Synthetic polynucleotide
  source 1..628: mol_type = other DNA
ygyggtggttttyggtttttttttattttattttaygaatyggygtttggtygttttgaaatgaatgatttygtygygtttyggygtygygtttttagygttttttttygggatagyggttaaggtgattttgatygttttygggtygygggtygggtttgggtaggggtttttgggttaggagagggaggtygtttygygtttattttttaaggtygttttttagttggtgttgttttygtagttygattyggatygtygtagtagtttttyggggtygygggttttagtttttgygggygaaygyggtttgggggyggygggggygggygyggggygygyggygaggggyggyggyggtygggttygygaggggggttttygggtyggttttatgyggggygtttygtygygtygygttygygtttttgtatyggggtgyggggtttagttygaygygtattyggygtttygygygttttgygggttttttaggtyggtttygggtgggttaggatygyggygttggtaggtyggggttgagttyggtttttygygttggagtttttgygtygggtgtygtygyggtgygtttagygtttgtttygtygagtygtagtttttaygt

SEQ ID NO: 6865 - DNA, 1075 bp, synthetic construct
  misc_feature 1..1075: note = Description of Artificial Sequence: Synthetic polynucleotide
  source 1..1075: mol_type = other DNA
yggaggttygttttygttaggggtttygggggtgygtgattatgaattttagagggttgggttttgatttgagtgtygattygttaatgaggaygggaggataaggttgtygaygtagyggaaggtaggggggaagygattygaggatttgaygattatttttaggtaggggttttttaagtaggtayggaaattaattttattaaatygyggagtggggattgggttygggyggtgtttagtagggtaggggtagggttagttggygygtaggtatttgtagggtggagtagaataatygtggggattygtttttttggaggggtattgtttattttttatatgagttttaggatattttygtggggyggagtttyggagaygttttaggttaygttttygtygttttatttttgtttgyggggggtygagtagggagggaggtttagygygygttgtgtgttygtagtgtttaygggtagyggggaygtttgygttygggttttygaygygtagtttggagagttgyggagggtgtttyggggttatatatttattattaattgtatttaggtaggtttttttgtttttttyggggtygtygttygtgggagggaaggtgtttygtttygatttatttaygygggtagyggtgtttttttygtttatygygttatyggtgaygttygtttttgygttygtaggtgtayggttaggtgttttatatygtttygtaygayggygttttgygtttttgggaygtgygygggtttygaggtgtttygyggtttttttygtttatgygtagtttttygyggttttttagtaataaggtgggttgygtygtygygtttttgtagtyggtttgatttygyggggtttttgtagaygttagtttagatatttagyggtttttagagygtttygttttgttattygyggtggtggygttygatggtyggygaggggygaggagygaggaagttygggygggaggagagttygtygtaggygtttggtttttttttggtggttaggaggygttgggagygggagtgttygttttggggatygt

SEQ ID NO: 6866 - DNA, 5566 bp, synthetic construct
  misc_feature 1..5566: note = Description of Artificial Sequence: Synthetic polynucleotide
  source 1..5566: mol_type = other DNA
ygaattagttttgtygttggatttttggtygttgttygggtyggygttagttttatataatgtygygtgagtttttgtgygtgtgygygggggaggttygagatgtttttttttyggtaagttttygygttagtatygttttttagtttygygggttttttygyggygagtygggaygygtggttttygygggtttatttgaagaaggtyggttygagtagygygtatagtagatttaygtyggttagagtatgggttgygygtttaggttggygtyggtttgygagttgttygagttygagtttatygataggtygtygtygtttaagtygygggttttgagygattygtttagggggtygtyggggtygtygttttttttggygttatygtgtagygagagygttttggagtygtttttttygttattyggagagtygttgtyggyggttgggagyggttygttygygtygggygtatatggygggttttgtyggggttttygggagttygagtttaagagttgtttygagtygttygygtygtygttttttttygtatygttygygtygttttygtygtyggtttygtygttttttttttttttygygttygtatagtaggttttygygttttttygtyggtygaattygggtygtaggatgttgtygatgaagaagttggtgatgyggtgygggtgttggtggttgtygggygtttgtaggatygygggtagtattagagttygtyggygttyggtgttygtttygttygggttgttatygtygtygtygttygagtygtygtyggggttggatttyggttgtygttgtttttttatygtygtygttgtttygttaggtttggggttatttttttttatgttgtttatagtaaattttatattggtttttyggggaygtttttttaaattagttttyggttttttygyggygtatayggagattttygygtttttatttygtygagtttttygagggygtgygyggyggtygyggttagggttgaggttttataagtygtyggtygygttyggygyggagttatttttgaatttaygaattgggttagaaatattaygagtygtttygttygtttagaygatgagagatttaatagagttaagttttygatttygtygygtagtyggggtttagatagtygtagtggttyggyggggaygygggtygtttttygggtttttygttttttttygygttyggtygtttygggtttyggygtygtygtttgggtygttyggggygagagttgygygtatgtaggtagygygtttttyggygtttaygttygttygggtyggtttyggtygtygtygtygttyggtygttttygttygtaygttttagtyggttttygagggtgtygggygttygyggttagygygttygttatygttygtaygtatatggaggtttttttttygyggtygtygtttygttgygggtyggggygttttatyggygtgyggtygygttttygtygagtttygtagagtttygyggttygagtygtatgggtgagagaygygaggttagggttyggtygggtygggttgggtygttygygtttttyggtygttygtygttttygtygtttyggttttygygygggttyggaaatttttaggttattyggygtaatttgagatatttttattttggatttttgtttttatttttaatagagttttttygagtgaygtygtaggtyggttttttggataygtgtttygggttaatggtygyggygtygygygtttaygtgaygtttyggtygtygttgggtgataggagtagttygtygttttttttttttttaaagyggtygygtttttygtttygggtgygggagtttaggaattyggagagattttygatygygttttttgygttygttygygttttttttgtygtttygyggtttaggggtgtgagttattyggygatagtttygttaggttatttyggggygygtaggtggataygtataggaagatygttatttttaagatttttatattgtttatygtggggygaaattttataattttttgtataaaatgtataaataatattaaatgagttgtygagatataaagggatttttgtggttygttttttttgttgatggagaggaatagtgttatttttatttgattyggtaattyggtagttttttgttttaaaygtagagttggygygtaggatattttttttgtagatatttattgtaagtgtgygtgtgtgtgygtgtgtagggaggygygtgtatayggtygtattttattyggggatagygatttttatgaaatatgtttagygattygaaagagygggggaatgtagtatgyggttttatttgygaagggagaaatttaggagtttyggaggttttaaaggaattttttttgttaaggagaggaggggtgattgtttagttaagattttaaaattaagtygttygtttttttttaatttttttattttgattgaggagtttttagatyggttatttygttttttttgttttaaaattttttaaattaattttgtyggagagtagggtttatttgaaaygagaattaggaatttaayggtaagggtgggagttttagttggtttttttttttttttttttttattttttttagattttttttttagttgttgttagaatgtttaattggaagttttgtttttttttttttttttttttttttttygggtttttttttatttgtttttgtttatttattaaatattygttgttattttaggttygtttgtttattatttaaaatgtatttttatggaaatgtgtgaatttttggaaatattygatagggtagttttgggggtgygggagtatttgtaygttatgagtatttttagtgygggggaggyggggaggtygtagtttggtayggatattttagggttgattggttttgggtagttgtatygtgtttagtaatttagattttygtagaggtagttagtaggttgttgttaggttttgagtgaatttggggagtttggtaagtattttygaggtagygtggtttgttaggttatttggggtttgaaggttgtattttggttttgygaagttttttttttagtgtttattttaygtgttgttttttttttgtaggttttagagtgttggttgggttgggatgagaaaygatagtttttatagttgtttttaggaaaattatttttttatttaggaygggaatggtgggggaggaggtgttgggttggttttttggttattggaygtggttttggttagagtgtgttttttgttyggtgtgtttagggtagggtggggaagttttttttygttggggttggatttttttattttttttttattggaggagtttttattaaatgttttggttaggtatatatttgttaggggtttttttygagttttaaaaaattaaattttatagtttatttgtttttygggaaaatagggttggtgagagtttgtgggaagttttattgaygtttatttggttttttggggggagaattttttgtaattttggaaattttgatgattattagttaggaaagggagggtttaaygattttgggttttttgaatatgatattggggggaggaggggttttgagttttttggtttttgtaaaattattttaggttaatggttttatttgttttatgaaagttaattaggyggttttttgagaagtattttttgaatttttgggattttttgtttttgattgttttagtataaatggttttaagaygttgggttttagttttgtgtttttttgygatttagattttaattygtggttgtaatagagattttgggaagtagagygttatttttagggygtttggygggtyggtgggtagagatttgttttygtagggtttgygggttgggttttggggttggttggaggaagaggaattygtgggtygtttttttggaaaggaggaaggtgagaggtggagggaggaataggagaaagagaaataaatgaagagagagataattagagggtatygggttttttagagtggatttaaataygaaataattttgggaaagyggtaagaggggttatygtttaaagggtyggggaagttgggatggggttgtagaaagttgagttgtttaggggttgggyggtgttgagttttatatatayggaatttygtaaggtgttttaggaagtttygagaagygygtatgaggatyggtttyggtygtttgttttagttgggayggygtttygygttttttggggatgyggggtagtggygtgttttttttttgygatgttagtttyggttgtygygttttygygagtttagagttttygttttttttttygaaygatygtygtttttaaggtyggtttttttgtgyggattagaygagtttttttyggatattagtttttttygggatggaaagtggggtattgattygggaatttygttttttttttagttttatttaggaatyggagagygttygygattattygtttgyggaggayggttttttatattttttaggttygttgtataaagaggggtttyggagagggygagtaggaaagtagtttttagaygtygtgygttttaggatayggaygttagttttgtaaataaaattttagtgaagygtttyggagatatygggygttyggatgtygagttaggttttygtttttatttgaaaaygaggttagagaagggtgattttttyggtttttttgygttttttttattygtttygtttttttagtttgaygtggtgatatttggaaaaatggatttaatgaaagtygttygttygyggyggtttygttattygyggggtagagaygtttaataatttttgagagygagatttttattttagttaaagtaggtttggttagttttgygttttyggttgggagtygagtttygtagttaagttttaggygtygggyggggaattggggtygataggagagtaatatttttttyggggygagtagagagttatygtyggtttttggggttgaygtttygattyggtttgtagataaaggtygaaaygaaggggygyggggagtaggggtggggygggyggggttaaygggyggatattgygtgtttgygtttttttttgggygaaggaggatyggtttataggtttatygggygagttyggggayggggtttgggaggttgggtttagggtttgagatttttttagaataattttyggaaggagggggttaaatgyggtagyggygggtttgaaaagggttaggagygtygtaggaattggggtgtataggttttygygtgtttagygtttygttttttttygttttaggtttgttaggggygygygtggygygggtagagtttggtgggtgggttggygyggatagaagttttgtyggggagyggggaggggggggtagtygtattgtaygttttggttttgtttygatygttggagaagygt

SEQ ID NO: 6867 - DNA, 5566 bp, synthetic construct; identical to SEQ ID NO: 6866
  misc_feature 1..5566: note = Description of Artificial Sequence: Synthetic polynucleotide
  source 1..5566: mol_type = other DNA

SEQ ID NO: 6868 - DNA, 1164 bp, synthetic construct
  misc_feature 1..1164: note = Description of Artificial Sequence: Synthetic polynucleotide
  source 1..1164: mol_type = other DNA
ygaaygtttggattttagygagygggyggttttttggyggyggtgattatygttgtgttygttgtttttaygyggygttygttaattttaygtgttygtagtygygyggyggggtygggygttyggagttgattttagtttttaggatagaaagggtggttaaaygtagatttggtaatttttygagtyggygattatagattgttggtggttgygttayggtttygggagggttagtttttygttgggtttttagggtattaagaaaagaggggtatgygagtttggaagttggagagagttyggggttttttagagygggtgggaygtygygtttttaggatttygygttaygygtattttttttatttygatatttattgttatttttatagyggagygaggggtttygtygagggygagygtatttygtgyggttgagatgttyggaaygttttttygygtttyggtttttttagaaggggttatagtyggttygygagttttygggygggggttgagtygtagtgttaattaaggygaggttattttggttygygygttttttattttagggttttttyggtagagaggtgattgtaggttatygttagtygggtttttatttttygttttygtygtttyggtttttatatttyggaattttttyggyggagtttgygagttygggaaygyggttttagttagagtggaagggatagygygggaattyggtagagagaaaaagygggaattgggygtygtygttttaygatygggaggagattttttttyggttttttttggattttatttyggggatygtttyggggttagagtttaggttgggagagtttttgggygtatttatygttttttttaatttttttttttttatttttagttygggtggtagtggttattygtygggtttgtaggtggaggggagtttgygygtaaaatttayggtyggyggyggttattttttygygggaggyggttagattttggagttatayggttagagttagtaygagtagggttttgttttttatttyggggygygtttttttggaggagttgtaaggygyggatygattgatgagtyggttgagtyggaggttggagagggttggagtygyggtttggygttgagtaagtygt

SEQ ID NO: 6869 - DNA, 1495 bp, synthetic construct
  misc_feature 1..1495: note = Description of Artificial Sequence: Synthetic polynucleotide
  source 1..1495: mol_type = other DNA
yggygygtattttatatygtttgttttgtgttttaaaaygtygaagttaattttttaygyggttttttgttygattatttatttttgygttgttaggtatatygaggggatyggttttttttttaggyggtttattttagygtttttygttagagggtatayggttttygtgtaaagygtttatggygyggggtaygygygtaygtagtttygatttttatagtttaggttttattttygggttgggtttagtygttaaggygttggggaggggtygtgttagggagygaagygttttygggattttgggagggtgyggtygggattgttgttttttgttttgagttttgggygtaggygttyggtaggattyggygtttaggtgagyggyggtttttaggaggggaagtatygygygatttaaygggygtttagagygtagggygaagaggatgggygagggagagggggagggagaggttayggtatttgaggaggaggaggagtaggaggagtaggaggaggatygtggggttygggtygygttgygtatttatttgggttttggttgttygtygyggatttyggttttttgtyggagtttygttttttttttttgtttttttttttgtttttgttttttttgygttyggatatttygtyggagayggagygttttaygyggayggttttyggygtaggygagtttggtttaagggttyggatygggtttgggaaaagtttgtttttygagggggagagygagyggtygygttgaggygttygygttgygygggggygtttttygttgtttgtagggagygyggygyggaygyggygggyggttyggttatttggaaygggygttygttttggttttyggggttgtttttgtygtttygggaagtygtygatgggttttatygttggyggttygygttttggtttttgttyggygttttygtaattygatyggggagaggttattatygttttgtttaygtttttatygttyggtagtygtygtygtttagtttttggttttygygygagttyggagttttaataagtttyggggaatttttygtyggtttttttttaattgtttygtagttatttatttttygttygtaggttggaggtaggygtttttttygtatttttttttggtttygtttttttttttttttttattatatttttattttgaggygyggataygttatygggaggagtttgggttyggygttttygggygtagtttttttttttttygygttggtygggyggggggtggyggygyggttgtygggaattttygataggggtygttggaygttgygyggagatygaggttagygtttyggagattygggaatttaggyggagattygaggttttygttgttygttttttttygtagttaggtagygtttgggagggttgtttygttttattttaygyggaaaaggayggygtagagaaaagtttgyga

SEQ ID NO: 6870 - DNA, 352 bp, synthetic construct
  misc_feature 1..352: note = Description of Artificial Sequence: Synthetic polynucleotide
  source 1..352: mol_type = other DNA
ygtygtygttggtgggtggyggyggttygggtgttttttggattgygtagtaaagaggtattttgggagatggggttaaggttttagggggtgttattygygaayggtttattygttagattaggggggttttttggttgtgygtttggttagaattggttttgaygatggaagtttttggaattaaagygttgtttttttttttttgtgttatagttggagttgygggagygtttgttttgttyggagttygyggttttttttyggttgtttygyggtggygttaygygtttttttyggagtaagttyggtgygtagggtygggggygtgggyggttgttgttagaggygt

SEQ ID NO: 6871 - DNA, 1141 bp, synthetic construct
  misc_feature 1..1141: note = Description of Artificial Sequence: Synthetic polynucleotide
  source 1..1141: mol_type = other DNA
yggggattaggyggtgtgtygttygggtagttagtgggtygggygagtttgyggggttggaggggaygyggggttgggaggttggggagttgggggttgatttygggygggyggggyggggtagggatttgtyggtttggggygggygtattagaygagtttttygttygtaggtttttagygtttagtygygtttyggttgygtttygtyggtttygtttygtttygtttygtagagtygtygttagtagtgggagaygtgygttgagaggygggggttgygttyggyggaatagtagttttygggyggagagyggggtyggggttygagagtaggtgatgttaagagttgagygggattygtgagygygyggtttagtatttattagggygtttygtaaaaaatttygttttygtttgtttttgggaattataggtaagttttgggttttygaggtgtagttttaggtagagtttygtgttgggaggtgggaagggggtttgattttggggatttaggtagtttggggatagttttattaggggtyggtgtttagaattggtgagggaggtattttaggggttgggggagaaggagygagygtttttygtttttttttggtatttagyggygygtttgttggtyggaaaggtagygagaagttygttttttttgttttgttttyggygatttgyggttygggtgggagttygtaggtttygggtttttagygtygttggttagggygygggtaaagtttgttttttygygtttagtyggttttttygttttygtagygtygtaggtgtygtttgttttygtttttttgttgtaatygttttattatggatttttygatttagatttttygyggggagtygggttttatttgygtttygagygtttgtttgttttttaatagtagygtttggtttttyggttgggtygagttygatagtaayggtagygtyggttyggaggaygygtagttggagttygygtatattttttyggttatttyggttattattayggyggtttatttygtagtgttygtygtgggtttggtgggtaattygttggttatgttygtgattattyggtgagygyggggatagygtagygttgggggttgggygg

SEQ ID NO: 6872 - DNA, 3297 bp, synthetic construct
  misc_feature 1..3297: note = Description of Artificial Sequence: Synthetic polynucleotide
  source 1..3297: mol_type = other DNA
ygagayggataggaatygaggagatttttttgtagygttttttatttttyggatagaaattttgtagattaygtttatttttttatttygtgtatygttygtggttygtgggtagtagttgtttttttgggatttttttygtttgttygygagttttygtayggtygygtttttgttgttggggtygttygttggttttggttgttygttaggatttttttttgatgttgttaagttygggaagtttaygatgtattttagtgttygygygtygttttttttaaagttttttttttatttatttttttataagygtggagggagatggggtaggtygyggygtttatagattttttttyggygtttatttttttttttttatttttttagtagyggtagggtygtagygtaygtaaatttttttttaaaaygtttattttatttttagttagtygttttttttagggttttttygttygagttgggtgtggggatygtygygtatatagagaygggaaagttatttyggtttyggagygtygtttttttagaggtttttggttygttygtttttttagygttggaggatagtygygtatatagatttttttttttaaygtttatygyggtttttagttgtagtttgtatttttatttttygtttttagtttttygtttttygttttttgttttttagttttygtagttygggygtttagatttgtttygattttttagggtagtttygagggtgyggaagattaagtgttygggtttgttttaggaaaatttyggyggygtttgtaygttaattgttttggygtaggygaagggtggagggtatttttttgtttattyggtttttaagagygtgaatagaggtttygagtgaaygtttatatttagtyggttttttagggtttaygygtggggygtttatttttttattttgtttttyggtgtttttgttttggttgtattttttttaaaaggaggygttaygattttaggaggttttgtttttttattttttttagyggygtttaaattattagtttygggygtttaattttttttttgttttttttttatttygtgagaaagtygaygtttttattygtttggttttttygaaataygtttygggtggttaatgygatttttagggtttaaagattagattttygygttttttattaagatatygaygygaagtygtagaggtggaatygyggaygttttggtaggttygggatatattgattttggtggygygatgttttttttygtaygyggaygtattygtagttttatttttttaaattygtattgygggaaggaattttygattygtatyggttttygtttygtagtaayggygatattttgaggttyggaygagyggygygttttttttagtttyggttattttttagtaygaagttttagggygagttygagaygaagaaagagagttygaggaattgggatatttaygagtttatygtttattttgtyggtyggggaggaagtttyggtyggttygttttygttygtygtgygtatgygtttygygggtgtttttttaatattgtagygyggagggttgttttttttaygtyggygattgtttatygygtttttygttttttttyggttttyggtttttgttttagtttttttttttyggtttttttttttttttgttttgtttttttttygtttttttattttttttattyggtygggtaattttaygtttygtttttttttagyggyggygtattttatygtygygggtgttaggggtattttygaggttttaygyggggygygatttttatttyggtygtagttttattgttttagtttygtattagtaagttttaagagtgtggatgygaagttaggygygygtagagggygttygygaagttttttgtgttatygttttttttyggygygyggggtygagygagattagagtgtgttggattgygtgttyggatttygtgaatgaagggagygggaggaaggagygggggtgggyggtaggtatggagggggygtttggtttttagagtttygygtttgtggattgygygtttttggagggtagttttttatttttttttyggttyggggygtttttttgagttttgttttygttttatttyggygtagtttaggttttyggttttttygttttggaaagyggttttygtttttttttagttagttagagygyggaggttttatttagtaatygagygggggataagggggggaattaatttttgattttagatttygttgagattttyggtagtygtttttygygtttttttttttagggatttyggagttyggggaaaggagtagattagggggtagygggagggggaatttagtygtttagtttttyggattygtagtatygygtgttttygtagttygtagygttttttygggagtgggattyggtggggtygyggggttagttttttggagttyggagggttaagttgaagttggaaattgatttgatataaaaataatattaygttatttttttttttgtttgtygagagggtaggggagtgggagagygagygttgggagtaggyggaggygygtttgggggaggttyggagtaggyggaggagagygataygttgagagtttgaaaggtagtttyggggaagagygagggttttttttygtttttttggattatggaaaggaaatggtttaggaaaaagtagtttggagtgttttttygyggggaggggyggtgtttygggagtygttaatgtttygttttaggatttgtttagttaygtttyggttttttygattttgttattttttttattgttagttttagyggagygggttagttggggttaggaagaatygggagaggttggtgttttggggaggttgggtgtggggygtagtggagattayggtatttatyggtataggygagttttgtttagyggtggygtttttttttttgggtttggttatyggatgggggggttttagyggaygatttttygagggtyggtygggtagtgttagygtygtttygagtaggagygagaggyggttyggtagtttttygtgttttttygagagtygggyggtyggtagggygggaagtaggggggagaagtttaggygttttyggggagtttygggagggggtygtyggagaaggtgagagaagaattttgygaggttggaaagygggttagaaaggaggtygaatagtttyggggyggygggyga

SEQ ID NO: 6873 - DNA, 2213 bp, synthetic construct
  misc_feature 1..2213: note = Description of Artificial Sequence: Synthetic polynucleotide
  source 1..2213: mol_type = other DNA
ygaaggygaygggtttaggatttgtagaaatygttgyggtttggggyggtyggggatttayggttttttggggyggttttgaataggttttggggygtagygttygttttttaaagaagtttgggatygggttttgtttygttgtaagttaygtttttygtgagtttataagtgtaaaattagaaaagaatgtttygtttaaataattaaagagyggtggttttygygggggtagyggaggyggttagtagggttttygttttyggggagaagtgtttaygatttaagggttgtttgttttaggaattttttaaagaattatagatattgagagtattyggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttygttttagttgggtatyggtttggaagyggtttggaattagattggattygaggaggtaagatttyggtagygygaggttaattataggttttattygyggtttttagttyggttttatygtagtyggyggtagatattttaaattttttataygtygtttttagygaggygtttyggggaaagtagygtgaggtagtgagtygaggggyggggttaggaggaygtttygttttygagttygtttygtyggagggtttgattaatgattttttaagtygttttagttttyggygtagttttttyggtgggttaggtttttygttygatttgttttagtyggtyggagtatataygtttggtygyggggygttygtataaaagttatagttagyggaggttggaaatagtygtygatttgggtatyggtyggaygaggatggagtgattagygyggttttggttatataggttttgttttaygtttttygttygtttttaygayggagyggagttttatttagtygttttaggaaaggtgaggggttygttagaygygtattgygtagttttygggttyggaayggtggygggtgtygtatttygaggtgaggttaagggtttttygtttttygggtagaaattttttttggygtgaaaggtygagggyggttggtgagtygtggtttttygyggygtyggygagaaggagtygygttatttttygtgygtgtygggttggataaagttatttaagygygaaygagtgttgattttgagttgtgttttygagattttttttttygggtagagtagattttttgtttaatttgtttttgaaaagtaaagtyggtattgygtttttttttatttttttaggaagtttaagaatttyggagtttygtaattttttttagaygttyggaagtaaatygygttttaggtaaaaygagttygtttgagagygtttttagtttygttgggttgttggtgggygtayggggagaattagggggttgygtttttygggttaagttygatygtttttyggttttatygtattttyggttttttgtagygygygyggygygggaagttgttatggatygyggtygtttagygggtagtttttttagygttagygtygagttygygtttttggtygtygttattygygattygygtttygggyggatygggtyggggtyggygggttttgggggyggttygygtttygggagygggyggtyggyggyggygaatgyggygygggagygtagtygggtgtagattttgyggtaygtttttttggagttgtagygtaygttgtygttygtgtygttygatattaagttgtttaagttggaygtgttgttgttggttattatttatatygygtattttattygtagtttgtaggaygaygtygaggygtyggyggaygtygggttgggygttttgygyggygatggttatttgtattyggttaaggtaagygggyggggygtatygyggggttggggtygagattaggatattttgatttgttttgttagttatygttttgggtagatgttttaattttttttygggtgaggygggaagtygatygggagaaygatttyggttygygagggtattggtggtaaggttttygtygygaaagtyggttttttygyggtttataggtggttggagaggygtttaaagtygg

SEQ ID NO: 6874 - DNA, 363 bp, synthetic construct
  misc_feature 1..363: note = Description of Artificial Sequence: Synthetic polynucleotide
  source 1..363: mol_type = other DNA
ygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttttttggagttygttgagtaygtataygygtaggygaagttgtttttttaggtttttggygttttyggygyggttgttttygyggttgttttygtttatggtyggyggyggtgygtagygyggygttgttygtygtgttgagygt

SEQ ID NO: 6875 - DNA, 960 bp, synthetic construct
  misc_feature 1..960: note = Description of Artificial Sequence: Synthetic polynucleotide
  source 1..960: mol_type = other DNA
ygtagaaaaygttgtaggggttaggygttygagatatttygyggggtagtgggtattaggtttaggtttyggttgtagagyggaggggygtygggtttaggaaaggggttgtgggtgggggtaygggggagattygaggggtgttgggaagagggtttttttttttagygttagttttggtgtygttgtgtattyggagtygygygaagggygtttttygattyggaggtataggagygtttagagaggaaagaaagaaaaagttatygttggttygaatttttggaagtyggagtygggttttttgttttaaatatygaggtagaattttttttagygttgtttyggtttttttgttatttattttyggtttgtttttggaagaatyggttttttagtttttygtygtygtagttgtgatataagtaagtgtagtygygttgttyggggttygttagggtttttygygttygttttttatygtggttygyggyggtygygttttygtttygtttygttyggtygtttygtyggtttttgtttttagttgggttgtygtgaygaggagaygttgttgtgaaattaaatttgattttgagtttttaggyggyggtygagagttygyggttgttgatgtttttgggttttatttyggggtaggagggyggygatyggygttygggaagyggttgaggggygtygygatttttagygagygtygttygagttttagttygttygggtagttttygaggtttagggygtygtygttaggtaygygaaagttatttggaagggagttgggtgygygtaataatggggttttgagtygtggtyggtaggggagaggtgtagtygtttaaggttygtggygtygggygttgtaygtggagggatgtgttaagggtyggtttgttttttttyggggaggtggtaattgattgggaygtygggggaygg

SEQ ID NO: 6876 - DNA, 1404 bp, synthetic construct
  misc_feature 1..1404: note = Description of Artificial Sequence: Synthetic polynucleotide
  source 1..1404: mol_type = other DNA
ygttygttttttttaggttyggtgggattagattygaagttaattttygttaggygttaggtgtagattttaggttaggttagagtagtttttgggttttyggatygggatgttygttttgtttttttttttggtttygttyggtttgttatagggggaggtttyggtttygtatttygggtagygaatttygtyggtygaggttagtttygtgygggggtttttygygggatygatygttaagyggtattgttygtttygggygttygttyggttttagaygtaggttttgyggtygtttygtgataagtatattgaygggttattgttttttgaygagtgttaaaaagttygtttgttttgaaygttaatttttaagtgatttttaygaggttttttttttyggttttttygttgttgtttygttygtattyggtttttagtaggtgtttaagaaaygtttagtaaayggtagygtaggygagtttgttttgygygttggygygttttattgtttayggatggygggygattttaygggattttyggttygtaggattttygttttygaggttgtttttgggtygggaggggttattttagaggggygtttattttygayggygggggtyggggygtygygggtaggggagggygtagtttttaagtagttttagtttggtttagatttygygtttagygagtyggtyggttaggtttatattttttatttgtygttygttttaggggaagggttttttygaygaygttygagtttttttttttttyggagggtyggaggtyggygtttattggtyggttttgggygaygtttygttttttygaygttaygggttaatgagygygygttgttagtttattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttyggagggtttttttttygyggatttygagttygtttygygyggtttygygttttttgtttttttgtaaagtaatttttagggtyggttyggggygtttttttttygtagttygggyggtyggggtttttgagttyggyggggtygtattaggggtgggtgggtyggggtttygggaggggaagygygagygygggagygaggaagaaaggyggyggttttyggggatttygygt

SEQ ID NO: 6877 - DNA, 1247 bp, synthetic construct
  misc_feature 1..1247: note = Description of Artificial Sequence: Synthetic polynucleotide
  source 1..1247: mol_type = other DNA
yggggggtaggtygygagagggagaggatttygggagtagaygaagaagtggagtagttaaagtttgygttagaagaggttggggattgygagaggagaggttggggtttgtaggggagygtagtagtttttagtatygatttaaattttaaagattygtggtttttgtttgatttygagggtygggaatagaygtttgtttttgtggagagygatatttaatygagaaaatggggttgtttygagttgggttttgygtttggtttagggygaggtttttttggtttygggttggtttttgaggggygtaaayggtaggtttggyggttggggtygaggagggagggtattatygtttygaggtagtaygtagtttgtagtagaggygtttgttttaagttgttttttgggggygtygtygtygtttttttttttyggggtygttygtttttaggaaagtggaggyggttggygaggatygagagtyggggtygygttgyggagggattatattttygggagttygagggggattttggygyggygggttagtttttgtttttyggttaygggtyggtagygttygttttttttyggttagygtttgyggttygygtygygygtatygttyggtaatttygygygygtttygygggggygttgygtttttttgttatatyggygtatygyggttttttttttttatattttyggttygtattattyggttttttttttattttttttattttttttttgttttttttttttatttttttttttttggygaggggygggagggggygtggyggggtyggggtttgtgtggttgggattyggtttttygtatttygagttygttygaggagtygggtttyggtygttgtttagtygtttygtgtttygygygttttgygtygtygttatygttttttggggagaygtagttatttgttygttatggatatttttagggttttgttttyggtygttttttttattagttttttgtgggatttgttyggtttttagtaggtttttattttatttttttygtygttygtygagttgggttttattaagggtatgygaagtygtaaggaaggtaagatgtagygggygtygygygatagtgaygygggtygggagggttaggaattatagtygyggttttaggaygaatttygggtttagtagtttygggygtaggagtygttaggtaggggttygygygtggtgttttayga

SEQ ID NO: 6878 - DNA, 1861 bp, synthetic construct
  misc_feature 1..1861: note = Description of Artificial Sequence: Synthetic polynucleotide
  source 1..1861: mol_type = other DNA
ygtttattgggygaygtggggaaataagttttagttttygaagygygattaaaaggagaaattaagtttttatygttagggygggggagggaagttgggtgtyggtaggygtttygtyggagaygagatttttttyggttttagaagygtttygttagggttagagagggygagygtggygggagggaagtttttgttttttagyggttaggygattygaagtygagygtygtgttataygtatttygtttygttttgtttgyggtattttygtgtaatttttatgaaaatgttttttygtttttgaygtttygyggtgtaatttttattttttaaygaggagggggtygtygtaggattgggaatttagtggtyggygttttagtattttyggaygygtttygtgttttttttagtatttttttgagggatygtttattgygattttaygtagtgtyggttatttygttttagtygtagggagtattaaataaaagaatttttgtaaatttttttttttggatattygygggttttttaaatttggtttttatttttttagaatttgtatgtagttaaataggaaagttggygygggggggatggtgtgyggaggaagggatttygaagtttttaggttatttttggtttygaggagygygyggagtggagtygttttttygygggttygatttaggttttttttttttgttattttttttttttygttttttttagattaygtagtaagattygtygagggygaagaagttgggagtgattttaggggtttttgyggttagattaaatygtaattttyggtgtttttattttygyggatygyggggtaaygttagygagtagygtttttttgaggaagggaagagggggaaagggtgatyggaygagygtatttgttttagyggattttyggtgtatatttggggattgggggttttttaggtggygtttttttattttttgygggtttttttygtagttttaaatattttaaayggygygygtatttttygtttggtttatttatygatttygtygataygtaggttattaagtttaaggtgagtaggatttaygygygtygtatattttttagggatyggttgtttttagtygttgtttgtaattagggtaaaaygaagttttttgtttagygttyggygtagttygygtataygaattyggagtagagtatygtagygattgyggtttaggttyggggattygggttyggggttygggggygttygttttttttttttgygtttgttttygtygttygtagttgygtttygggaaygyggygtttttttatttgttggtttttgtattttygatayggagttggtgtttygggaaggttgttttttgaagttttttttgttttgttgtggttttgttttttygyggatttttttttygtgtygaggtttagtttttggttttaaggaataaattygttggtttgaaagggagttayggtagaagtttaggggtagagyggygggagygygygattygygyggttggagtttygggggtatttggagagtagygygtttaagyggggttattggtttygyggttgygtttttttttttttygygtygygttttttttttygggttttttttttttttttttttttttttttttttggtttttttttttttgagtttgtttttttgggtttttttgggygattggggagaggaggyggtagtgtgatttttagataaattygggagaaatttttataggattataygtygattggtagtttygaggattagtgggygtygyggtttygygttgtggttgygtyggttttgtttatygg

SEQ ID NO: 6879 - DNA, 3044 bp, synthetic construct
  misc_feature 1..3044: note = Description of Artificial Sequence: Synthetic polynucleotide
  source 1..3044: mol_type = other DNA
ygtygagggggaggggttggaagatggyggyggaygtatatttattygatygygatagagtttaggtttttagttygygtygtygttygttgttygtagttattgtgggtagttttgttttgtttygygttgttggtagagtygtttygyggaggygtgggattagggtggygttygtattttttgttagygygttttygttygggttygtttagggagtatttgtgtayggttatattggattttgtgttttagttattgttttagygyggygggaaaggagagggtaygtatagagtttgggtttagttttagtttygttggggtttyggagttaagatgattagygaggaaattyggaaaggygttaaggaaaattatatygtttaaggttygttatttttattttagtyggttttggygtttttttttttygatatatatttttgtttttagatatttttaaaatagttygggyggtyggygttggtygtagttttygtggtttgggygtygttagygggagggagggyggygaattggggygygtaggyggtygtagggtagtgggygagggggyggagggtagggagagaggygggaatatggagttaggtttttatttgagtayggattgtttttttttttttttttttttttgtttatttatgayggttaggatgattttttttttttttttygtgaggtggttgaggttaggtatttygggttgtagaggyggttgagaggtygtygggatgggagttaggyggtttyggggttygataggagtygatatgtttggtggagtygaattattttagggaagyggggaggtaattttattggtagyggyggtatyggygyggyggttggggtagtttttagygttgggataaatatatataaattaatggtttttaatttaaggygatagttttttttttttaagaaaagtagggggaggggagggygagygygtggggaaggagggttgaggagtgygtttygggaaatgtttttttttttygggggygaagggttgtgaagtgagyggtttaagggaaaggggaattggaggtygggaygyggagtgygyggagaggygggggagggtggtggagtaaggtggyggggatagttaagggtggggtgattggagggagtaggygggagggygataggyggatyggggygygagtgtgttyggtygyggttagggtygggagygygygygtygtttyggaggggaaggggtgtttgygaataagttttyggggaattygtttygagygttyggaggyggagtattgtyggttygaggggtatttaggygggagtygagagggtygtgaggaagygaggayggtttttyggagaagtaatttattygtttygtyggttgaygtattatagggttttygygygttatagagggagaatttttttaggtatattygggagygggtygyggggtyggaaattttygyggagattttaattttatttattttattttyggttagagtggagaagygaaagyggagaagatatgaygggggttagyggyggagagtttyggggttagggtttttyggttgttaaygttyggatttaggygagtttygaygtgtagyggggtttggygtyggtttttttttattaygygttyggtttagggtygtttagtygtygttatygtygtygttttttgggtygatggagtyggygyggaaggttygygygttttgygtygtygtygtttagtgtygtygttagtatttttttygttttttygtttttygggtttatttygygggggyggygttattttttygttgtttaggttygggtatygygggygtttygygggyggtagtygtttttttygagygygatttttaggttgggttyggggtygggyggggagggaggagagattgagygtgaagggagagggygttygagttttyggggayggaagtgtggagaataggagygtgtgagggggygttygaggtgtygggggygggggaagagtatgagtaggggtgggggtaggggtgttaggtgtagtaggtagggaggtagaggyggygagtgggggygttygagggatyggggyggggyggggagygtaagggtggtaaggygttygagagttagggttggagttgaaggtgggtgatagggagggggygtttaggtgttaggatttgaggagaaagagtgygygtagygggagggtttygaagtgtyggggygggattttggaaggagggagaaygtgaggagggaggaagggtttttggggtgttagggatgggggttaggaaaggggtagagagttggaggtttataagtggggatagygggggagggaggttggagygagtggggaaygtaggtggtgtygagggyggggatagggygaggggagyggggygtgaggaagttgtgggaaatygygttggaygttgagaatgtgyggaaggattttgaggggaggaygygagatagygygaggagagaygaggagagttagggttggtygggagggtgygaagatgaagygattattggaggttgtgagggtgaaaggagtaagaatygtttagagaygggttgggtyggtgttggggttaaaggtttttgtttgttaggttttttttggygtttattttagaaagaagaggyggagaygygaagagatygggttagagttagattttygaagtayggagatgggtttaatgaaaggaygaggaaagaygagaaattagyggtyggagaayggaggtggtygtygtygttttttgttttgttyggggttgggygtygttyggagagttttttyggagggggyggggyggggtygggtgaatagagttgggygggttygttagtttttttaggygttttgggtaagtaatgtgggtgattgagttygggtgtgtgtgtttgtgtgtgtgtgtgtgtgtgtgtgtgtgtaygtatataagtgagygtgtgtgygtattttatttagttttttataygygygt

SEQ ID NO: 6880 - DNA, 1603 bp, synthetic construct
  misc_feature 1..1603: note = Description of Artificial Sequence: Synthetic polynucleotide
  source 1..1603: mol_type = other DNA
ygatttgatttttgygagygtgtttgtttyggaaggtgttttttgattygtygtgttttttaagtattatygggattttygggtattygggggtttagggttatgtatttttttgygygtttatygttttgaatttatagttttygygttgggaagtgattggyggttttttttagggaggatttygygygttattagggttagatattattygaattttygttyggttgagygttttggyggygtgagtyggattygttygaagttttaggataygatttgttagttattagttygygttygtagggtagagaygtayggtygttygtygtagaggygygaatttttatatttattttttgtttygtttygggtttggtgtggttttggtatygtttaggatygggattttgaygttttgattttttatygygtggggaagttatttttttygtttygaggtttygatygtttagtttttttgagaagtttttattttggttattaaaagtggtttttaagagtagttttaygttaatygtataaagtaatgataataataataataagygtttaaaggagygggattgttttttyggttggaygatagygtyggggattygtagygtgygygggtyggaattaaaaaagtagttygggagygygagggttgagyggggtaagtatgggttgtttttygtagttttttttttgttygaggttygggttggtygtttgtttgtttatgattgtttagttgttttttygattgtttaggtaaagtttgagatatttaggggatygggagyggattttttttagtttygttatttatttatygttttttygtttygygtatttygtttttgggtaataattttattaattttyggtttygygygtaaatttaygtttgatttgtyggggtttgttttgttttygtygggatatttyggyggyggttgttgtygttggggttttygyggtgttygyggtygyggttgtygttttttyggttttygtygtygtygtygtygtygtygtygttggttaggttyggttygtygtyggtyggattttaggtgtttygggygttgggttttttygggagtygyggatttaygttyggagatgagtaagtaaatgagagaagagagaygggggtatagagagtgtgatagtgaggaggggagggggagaggagagygayggggggagaatgggaatgtataagygaayggttagggagagagaaaaggggaaagagaagagaaaaataatayggaaagaaggaagagaaggagggagggaygggagagygagtagygaggagagggggagygygggggygtagggygygggaggaggagygygttygttygtttttygtttyggygtgygggayggatatttyggygtygtygtygtygtttygggtygygtagtttttgttttgyggygggaggyggygaggygygygagggaggggygygtyggggttgtggggaggggagattattttattagttaaaggaggattggttgtatttaaatttagttyggatgtaaattayggtttyggttttggtygggygaagtgygg

SEQ ID NO: 6881 - DNA, 1365 bp, synthetic construct
  misc_feature 1..1365: note = Description of Artificial Sequence: Synthetic polynucleotide
  source 1..1365: mol_type = other DNA
yggtttgtatttttatyggaaagtgygtttgttatattttttyggattatttygttttttygagagygttttgttttttatagttyggaaagaaagaaattttagttgtgaagtgatygtggagaaagygtaggaagygatataattggttagggaggtagagagtgtgagygggygtattttttgtttggggatygygttygygggyggggayggagtattttagtggttgtattygtygtttygygtttttgtttggygtygttaatttygyggyggtygttggaattttagagttgttaggygtttttagtyggtttyggtaaatttttttttagtttaygtgttaattaagyggttygtttttygagttygggatggagtatygygtttagggaggtygygtygttygagaygtgygtayggtaggtaatttatattaaggtagtygtagttgyggygtttgggtatatygtygtggattttaaatggtttaagagygtttttttagttttgygtttttagtgtttttagagttttttttttttttyggagygtyggtataaygtattatgtygttgggtyggagtttagggttyggtagaggttgttaatttattgattataattatttttttttttaattygttygtagttgttygttttggattaagtygtttygyggttygtgttaggtagtgggttygtttttttttttttttttttttttaaattgggaygtgygaaggygtagttgttttttyggggttttttttattttttatatattttgttttygttttttgttttttaggttygtggyggagagatgttgatygygttgaattgatyggtgyggttygggggtgagtggygagtttttttttgagttttttttagtagygyggtyggygtyggttttttgggygaattttttagtttttagattttgagaggygtttttttttygttygatygtttagatgtagtttygtttttttttttttgtttttattattttgaattgtatggattatagttattgttaaggtaatygatggagaygtagtaagygaggtgggtttttttttgttaaaggtgygtggtgggttttaggggtggygtgtggaggygtttatttaygttttggtttygggggtttagatggttagggttgtgttttttattttagtttttgygggtttttagtttttatttttaggattttggagttttataaaatattttgttttttgtattttggaggygyggggagtyggagygagaygygttgggagttyggygagtygggygttaatygggygtttagggttaagtygtgyggttygtatttatgttygtygt

SEQ ID NO: 6882 - DNA, 419 bp, synthetic construct
  misc_feature 1..419: note = Description of Artificial Sequence: Synthetic polynucleotide
  source 1..419: mol_type = other DNA
ygtggygggygttgtttattyggyggagtygagyggygtgtagaggttataagtgtygtagttggtgattgggggatttttttygggaatygtgtygggagagygygyggtgttggagtygtatygggtggtygaagtagaaggtgagtggyggggagtgggatggggtggaggttttgaatgtaagggtgagagttttggagtttagtagagttggagygtatattttygttttttttttttygttttygagtattaggyggatatattygtatttygaatgttttagtgggygtagagtttattagaaatggatagtyggatttttyggygtttgttgggggtatygttgttaggtgtttggggttygttttttyggttttgttygtatagggygtatttagaggtygttttttyga

SEQ ID NO: 6883 - DNA, 3675 bp, synthetic construct
  misc_feature 1..3675: note = Description of Artificial Sequence: Synthetic polynucleotide
  source 1..3675: mol_type = other DNA
ygtagygaggtyggttgygyggtygtygygtgggtyggagtttagtgttttttggtggygtygaggygggtaggyggttttyggatygygyggaggttygayggttgtgatttaggggtggygtygttgttagggyggygggaggtttgattggggtttygtygtgggttgagttayggygtaattaattattagttgttgggaatttttgtygttygttygyggtgatttattyggtagttaggtttatttgtygagygygggggttttggtttttaaaatgaatttggggagagtgtttgttyggggtagggtttttygttttttygttttagggygttygtagatttagygaggatttgayggtttagaygtagtttatagygygggttttttttttttggtgggtattygtgatttttgaaagtggggtgtagagygttttagttgggaggtttyggtgaattattggggttttagattttttgggttyggggtttttgaggttagggagttygagtatygttttagggggygatttatagaagggattggttttttggagttygygagttgttygagggttaggtttgattttttagttattttttggttagttgttagtttgtygttaggtaatttttttttatttttattttttttttggttggggttaggagaggaagaggagtttaggggtttttgaggtttgggtttgtttttttggagttttagggttttaggygggatttaggaagtygaaggttaaggaaaagtttttygatagtttaaagggagagggyggggagggggaggaggtaaaggaggttaaaatgggaaggagataaagtttggagagggtttatttggaagtagggaataggtgygttttagttygagtttygtgtttttattttaggtggtttygagggggttatygygtggtttagggttgtatttayggygtattttgygtttagttgtggggaattaaagagtgattatatatattaaagagtgattatatatatatatatatatatatatatgtgtgtgtgtgtgtgtgtgtgtgtgtgtgtgtgtgtgtgtgtgtatttttttttttttttttagtaaagtaatagagaggttattgggtygggggattgygatgttttttttygttgttttgattttaaaagtggyggtttatgttgtttttagygttttttagggaaaygattygggtttgtaggtgttggtttaagygggttgtgtygttgggaggygagggggtygaggtagttttygggattttattattttaygaggttatgtttttggttaatgataygttttygygtygggtggttaggtggggggtggggggtggggaagatttygtgaatygttgttgtygtttttttgtgtgtttatggttttttttttttttgttttttattttttgtttaatttgtttgaagttgttagtttgttatttttggttgaatttygttttttttttttaatttygagttttttaaattttttattygttagggttgtttgygtttttggggagyggggttagaaggatttaagaagtygygtttatttttttatttttygttaaaattygtyggyggtttygttttygttttttttttggyggtttaggtygtttttttygggtttttttygygtgygttttgygtygygttgggtttgtagygggagttgttatagtagtttygttagttggttggggattaggygggaggtggygygttttggaggttgtgggagggagggagggagggaggttyggtttyggygtagttyggttttygtttttygaggttttttygtyggagyggggttgttaagygtatatatatatatatatatataygtatatatataygygtatatatatattygggtttttaayggygygtaygtaygtagygttyggggtagattagygyggyggtygtttttygggaygttyggaygtyggagggtttygattttygygyggtttatgygttygygttygtttygttgtttygygaggttygygggatttttttygtygtygtygtygygttygtygttttyggaggagygggttggtygatygttatygygtygtttttyggtygttttygaagtygttttatygyggtttttgtygttttggggtygygtttygttttygygttttgggggttgagtygagtaaatttygygtatyggtygaygttyggyggggatttygttgygtattygygygttygggtgggygttgggygygyggatttttggggagygggttgtttttttygttgtatttgttyggtttttttttygtttgtaggggattttagagatatygttatttygtaaattttttttttttattatygagagggggygaggaggggtaaaaggggaagtaggtttygttgggygygyggatttgtaggttttttgttgggtatygttattygygagttggatttataggggtatygggtttygyggtygtttttyggtygttttttggtttyggttttygtttttgygtttttygygggagyggggggyggggtgyggagggtagtaaggttygygyggtatttagyggggtygttttgtatggttttgygtagtggggygggttgtttyggtygggtttggygtagggtgtyggggttttyggaygtttggtttyggygttygagtagttttttgtgtttgttygttttttyggttgagttygggttygygtygtttttgtttygttagtygtttygyggtggyggtggttgtggyggttttagyggagggggttttttttagttttttygtttttygtttttttgttgttgttgttgttgttgtygtygtygtttataatttggaggyggyggyggyggyggyggaggaggaggyggyggyggtygtygggygttgtagtgggaygygygyggttgtgagtttgygggatatgtttttygygtyggttttttgttggyggttatgaagaggtagaaygtgyggattttgttttttatygtttgtatttttatttatttgttggtgggygtygtygtgttygaygttttygagtyggattaygagatgygygaggaggagaaatttaaagtygaggagattyggattaaggggaagtataatattagtagygaggattatyggtagttggagttggtgattttgtagtyggaatygtatygygtyggygtttagtggaaattygtyggttttttttattttgygattayggttattattattataggtaagggttgggygygtygttgggttttygygtttygggaggagttyggggaggyggttgagygygtygygtygggttgggtgtagggygtygagggttaaaygtagttttttttgggggttttttygtagygtttttttttttttagggagtttttttttygyggygttttygagttttatttttyggggattttattyggtgttttttatygygttggtgtttgggtygggygtgygagtttygagygagtgtgtttgagtygggagggyggaggygttatttttgygaagagagtggagygttaagaataattttatagtagatatttatttatttatygtttyggygygggttgggttgygygg

SEQ ID NO: 6884 - DNA, 3675 bp, synthetic construct; identical to SEQ ID NO: 6883
  misc_feature 1..3675: note = Description of Artificial Sequence: Synthetic polynucleotide
  source 1..3675: mol_type = other DNA

SEQ ID NO: 6885 - DNA, 3378 bp, synthetic construct
  misc_feature 1..3378: note = Description of Artificial Sequence: Synthetic polynucleotide
  source 1..3378: mol_type = other DNA
ygggtygggtyggygaggggggtttyggtygagaygygaggygygttaygggattyggyggygggagyggatggygagygagygagygagygggygggygggygggygggagggaggtggyggtyggggttgtttaagatggggtyggagtygygggttaggygyggaggagayggaaggggygggtagggtygygygggygyggtgygggygttttttttyggtagttagyggtagygygtyggtttttygtttttygttattgyggtttygygtyggtygtttgggtttggagtttygyggygttttyggaggaygggtttygygttttaygatttattttyggaggyggggtygggtygatygggggyggaggaygtygtaggaggttgttyggatttygggygtttgttaggttttttttggggttttttatgttaggtttygyggttgtgttygtaagygtagatggtttygggattygggttattttgaygtygtagatttagtaygttgyggatygggtaygttggatttygggataagtgyggagggtygggggttggaagggattygagagtagagttygygtttttattttayggaygyggttatygaggttygagaggggtyggagtttgygggagagggaagggttttygagggttttataatttggttgygttttttttttagttygggattyggatgagtgttgtttgaggtygaggygaygaatygttttttattygtttttgygygggatttyggtaggaataagygttygtttttgggatyggaggyggtaaattttaggttygagttttttagygtagygtttattygyggagtygygygtttttttggygtatttttgggtttygyggttyggtttttagtygtygggtttttygggttagttttttgttttttagatygaggygtaataagtttgaaagtagygttaaggagtagttagygagtygaagggagggygtggggygtygggygtttygggattttygaaygygygtaaygttygttttyggggatygggygygggyggtaggygagygggattgattyggygggttgygtatatttttttttaaggtttygattgtgygyggaygggggygygtttaggaattttygttttttttttygtttgtttgattttgttgggtatttaaagtyggattyggyggtatttyggygtgygggygtagagtttygttgtygtttaygggagggagyggttygatttttttygttgttttttyggtagtyggggtygtagaygagtggaaggtatgagggttttaggagaygtgatagtygtttttttagattttatatatygtatattattttttttttagatagaaaagggatttagtttttttttttttygttttygttygygyggtttttgttgttttttygyggyggttttygtttygagggggygtgtgtttgtgtttgtggggagagtatygagggttttygtgggtttttaggatggagygggagagtagattttttagttttttttttaatataaaygataagyggtttttttggggygggagtgtaggttttttattygtttataygtttttttgttttttaattatttyggagttgtagtttaggaatttgygttttagattyggaggaagaayggggaggtygyggyggggaygggtgttgaaagagggttggtttagggtttttygggttttagtttaggygtttgygttttaagaaatttagaagtttaaaataaaagtggaaaggggtaaggtgtttagyggtttggggttggggtgttagattaggygttttttttaggttgtyggggagtggttaagtaggagtygtygyggttaggaggagggaygygggttyggagtygtagttttygttaagttttttyggtygtatygtttygyggtgatttttagtttygtygttttttttygaggtyggaggagttttttatttygtttagggggtygyggggatttagggagagggtttttggtygggtttagagtttttagtttttttaggagggggygggggtygtgttygtttttygaggtagtttygygyggttttaagttagygyggygayggtggagggtyggyggtttttgtttatyggygaygyggattygggagtgttyggygttygggagtgttyggygtttggagyggagayggtatagggtyggtttaaagttgagagyggtttattygygyggtttgttygatttagtggaaaggtagataaggagggaagagttaggygttygygtgggggtggggggygtaaaaatagtttttygttygaagtgggggagagtatttttagggagtttttattgttaatgttaggtttataggygagggtttttaygagygagggtttygagaaggagtttggggtttttttttgtttgtttygagttttgtgygtggggggaggaygtttygggtttttataatgtttgtagggggttttggaygtgattagtaggagggggataygttygggggtttttyggagtttgttgygtttatgtgtggttgttgggggttatggggggtttttttagattttygttagygtttgtgtgtgttgggggtatagygggaaygttttttttagtttgttttgtgtatgtgatgaagaggggtgttaggttgtggtgtgtggatggggaggaggyggyggygtygaggagttttttttgygtttagggtygttttttttttagtttgtttaatgygggttygyggggatttgttatattttatygttatygttggagaaggtagggggttgagggggtagggggtgggggtttaaatttttgagttttgagygtaaaatttyggagttgygaagttttaaayggygaagttaggaagtttgggygttygtttttttttygatttttttttattttygttgygtttttattygtygygtttttagtttttygttggagttttttttattttttttagtagtagyggtttygtyggygaggattygattyggygagttgtaaattttygygagygtttygygtygtyggyggttgagtygggygttygatyggaggtggggggggtttttttagtygtygtygttttyggttygttttgggtttygtygggaygttttttggagagtattygtyggygtaygtaggttttttttygttttttygygtttgttggagtttttygggygttyggagggttyggatgttygygttgyggaygatgttggygygygggttygggtygggttaggaygyggygyggtygtttgtgttttyggtttttyggtttygygttygt

SEQ ID NO: 6886 - DNA, 1108 bp, synthetic construct
  misc_feature 1..1108: note = Description of Artificial Sequence: Synthetic polynucleotide
  source 1..1108: mol_type = other DNA
ygggggtttygattttttttaggttygtttttaattttatattgttattygttyggygtttatttattttttttagaggygtatggatttygtyggtygggttaggttayggyggttgygggttatagygattttttygggataggaygggtgygggttttttttattygtaggttygtyggtagttttygttygygtttttgttyggygtttttttygtyggttyggtyggggttttatygygtyggygttgagttgggttaagatggygaaggtggagagtyggttatagaggtagygygttyggagggygtygaggggtatygtgyggtagtygygttaygattagggttygagttgygggggggyggaggaggagggtttgggggygggygggataygggagggagataggyggagygttagyggyggyggggaygygggygtttyggttttygagyggyggtttygygtttyggtttyggtttyggttygtygtttygtatttgygttygtagtygygygttygttygttygtygtygttaggtttygyggttygggygtttatgtygygttttgygttygtygtygtygtygttgagagtygyggagygtagttygagggagygtygggygggggagtygagygatygggggyggggyggggggygagagttggttyggggttyggtagtygttygtttygygttttygtygtttttagttttttyggggttygygttttyggttygygygggaaggagggggaggttyggaggggygygtgggygtaygtggagyggggagggtgygagtygggtgtggtttgggggygyggggygggttyggagygyggygagggttygtttyggagtttttyggtttygyggtttagggygtyggttggagttgaygattttgggatygttttattttttatatttatttttttygggttttattatttttggtgtttgyggtttattttttgggatagatatagtttttttygyggggaggtttgtygttggaaatttttttttgyggtttgatttagtygttygttgtttaygggtygygattgtttygttttttatttgagtaygt

SEQ ID NO: 6887 - DNA, 1700 bp, synthetic construct
  misc_feature 1..1700: note = Description of Artificial Sequence: Synthetic polynucleotide
  source 1..1700: mol_type = other DNA
ygaatatttataygtatatatatattygggagygtayggaygagttgttttttttaaggttatttaaaygttttaattattttygggygygtaagtttaagygygggagttaggatttatygttaagaygttttgggygaggaattttayggttattgtttttagtagtagttatttgtatgggaaagggaggaagagagaygtgaaygtgygggttyggtttgttagttttygagagttatatygaagggtttatgygygygtgatttayggggattaggtagaaagtygtttatygtygtagggtagggtyggttatygygygttggtttttttttatgttggyggttygtttattttgggtttyggttagttttatttagtttagaggygatagataaagygagtttagygtaggatgagggaggtagtttatttttatygtyggtttyggttygygagaygyggggatagygyggtgygyggttygtatgtaggggtgatyggagggtygttttttttaygattyggaaagaaggagagtttttygttaggtttttgtgggtgttttttggtygaggagttyggttttygtttttttattttttttttttttatttttaagtaggagagygtgtagttttagtttgtataaggygttttaagtyggtgttttygggttagggtttgggygtygttygggggtygtttttatttygggttyggttttaggggttgttgttygaaygtattggtttttttagaagtattygtyggyggtatatyggtagggyggtyggttttgttgggttttttgggygtyggtttygggggttygggyggtttttttyggttttyggtttggattygygaaygygygggygygaggggttgggaygygggagttttttgagtgyggagygyggagttttggtgtttyggygtattgtagttatattttygggtygygygttttygtygttttttattygygtygtagggtttttttttttgaggygtygttygygtatygtygggggggagggggtagygttaataaattggggagttyggttygtygygtttaggttttygtttggagtygtygtattygggayggtgygtagygttggaagttyggtttttygagagttagttgttygtygyggttttygtaygtygggtagtygtttttygtygtttygggygygttattatggggtttyggtttagygtttggttgttgttgttgttygtygtttttttgttttaygaggagtatagtygggtygttgygaaggtgagttttyggttagtttygttttyggygtttygtttygagtttgggygtttygagaggtttttttgttygygtttggattygttygtttgtttttygggggtygygygtggtayggttaggtgtattttttgggtyggggttygttgggggtttttgtaggttaygatygygtattggtggatygagttttttttgttatggtatgggtattggagagttaaggaattttttyggggaagggaggagaaatagttygygttgtggyggggtgagggtgtttgggagtyggygggatttgaattygygtygygggtatgttyggtagttgggygtttttattygtttygggtgygygagggagttgggggttggagggtygggagygtttatttygygt

SEQ ID NO: 6888 - DNA, 692 bp, synthetic construct
  misc_feature 1..692: note = Description of Artificial Sequence: Synthetic polynucleotide
  source 1..692: mol_type = other DNA
ygattygygatygtatattttgtagagattyggtttygtttttgtatttttygtagatttygttttgtgattatatttttygttttttataggtattggttygyggtygtgtaygtttygtttttattggtttygtttygtgattaygttttygtaattttgatagattttattttygaggattttttttaggagtatagtgatttygtttttatagggttygtttygttatattgattttttygtgtygttygygggattttatttttgttygtttgtttyggtgtttatggggaagtttggtgttaggggttattagttagtttaatttatygttygattggtgggataaggataggttagygggttataggtyggaagtgagattygttyggtygttttgggaygygggaagatygaggtttyggtggtttttttttttttygtttggtttttttaggagaaggagyggttaaggtaggattygatatygyggtygtattygtttttttttttgttttagagtatagtttgggatttttaggggggagattgaatgagtgttgtygaggatyggygagagtttggaaygttygygttttygtaggagaaygaggaggtgayggatagggaayggggagyggtygttgggtgggaygtttgagattttygggaaatggtygggtygtyga

SEQ ID NO: 6889 - DNA, 1924 bp, synthetic construct
  misc_feature 1..1924: note = Description of Artificial Sequence: Synthetic polynucleotide
  source 1..1924: mol_type = other DNA
yggyggagtaaattgaaygttatttttygattaaataggagtttygggtttatttgtttggaagtttttaggyggtttggaggggttyggttttygggygygattygtaggggttgttttgttyggttygyggaayggaygtttattygtygtagttaygaatttattaaygatattaagtattggtygggtagattaggygtygtggaggygttttagttttttagtttttygtaaygaygygttttaggggtgygtagtgtttggygyggtgatyggattyggtygttttttygatygygtagagygagaggttatattttggattttaggtygggtttttgyggttttgggagggaggtttyggaygttttttagatttygggtttttgtaatttygaggtygggttttaaaattayggttttttygagttatayggagagttygtggttaagggttaagggyggttttygattttygggatygtttttttgagaaatggttgagagttaagtttagagttgygtagggaagggagttaaagagttggygtygagygygaagggtygggaggygyggggaggttttttattygttttattgttttgttygttaatgaygtygatgatagygatagygtyggtygagtgttttttttgtttygggtygtttaggtatygggtttttttttagtattygtagtaygtattgaagaagaygttayggaagttttygttttttagattygggggaattaggaaaygygttyggygattttygggtagtagtatygggttaggtttgttttyggaatygttgaygttattygtygtttttttygtttgggtttttygygggtygtaggggtggaagttygatttgggttagggttyggatttttttttttyggtttttgygtygtygttttyggtgttaggaygygttttgttttygtygagatttagaygygtygaaagtttygygygggtagtttttygttttaygtttygggttgygygttttttygygaagtttttgtygagtgygygygayggygtygtyggattttttyggatygygttttygygtaygtttgatyggagtatttygttttaygggggygttttgygygtttttttttttyggtgygattttygtttttttttttttygyggtttttaggagtttaggtatttttygaygtygttgtyggyggaatygggaatttttttyggggttttttgygggttygaagtygttttttygaggyggyggagttgggtagtttygggtttygygtygtttygygtygtttygyggagtyggagttttttttyggagtttggatatagtttttygtttygtygtygygtattggatttyggtagygtggagtttgttygggaagttgggttgygtyggtttggggygaaggtttaaggggygygggggtygggaygyggggttgtggygaygatyggttttttgygaaygtttaggtyggygggttyggggttataggttgggagtggagttggyggttattggggagtagagaggaygtttaggaataggtgtattagggtttyggyggttgggtygagggtygtaagtagaggggatyggyggttgttagtaagttttaagtagatgttttyggyggggtagtygtattttatagygtttatttygygtatatygagtatttaaaaygagtaaaatyggtttataygttggaatgtagtttatgattttaaaattttatttttaggttgtttagattatayggtttygttttatttatttttattgaataayggtygttggataatttagagaagtagtagaaattaygagaaaaatagtggagttaaayggyggtaaggatygataaggttggyggggatattgagtaaayggygg

SEQ ID NO: 6890 - DNA, 1991 bp, synthetic construct
  misc_feature 1..1991: note = Description of Artificial Sequence: Synthetic polynucleotide
  source 1..1991: mol_type = other DNA
ygtttagtttttatttayggagggygaagataaaaagygttttaggygygtagggaaatygygtaaygttgtgtttattgtagygatttttttagaaaaataaataaggtttttygataggttattygygtaagtagtagtyggtygagtttttttttttygttaatttagtagttagygttgtygttttttaagattttttttaatttaagtgtaatttagtaaggagggagagttagagattttggggaygttygaggaaatygaatttygaaattttttgtttttaaggygyggtyggagatttttgggattttaaagyggagagaattttttaattttttgttagaagagyggggttagagatttttgggatttttttggagtygaatttttttttttagttttatttyggagggygggagygaagattttgaagatttttttagygtaataaatttttttaattttgttggaaygygggttttgggatygyggggaagtttagaggggygaatttyggaattttttgttttgagagygggattagggattttagggattygggagtagagggaattttygtaatttygtygaaatatagggtgagagatygtggggaatttygagtygagygaagttygtaattttgttyggygggygggattagaygygttttyggygtttttagatyggygatgtagygtggtygggagtttaggattttaagygtygtygttgtyggtaagtatygtygtatttttttataatttaggattygtatggtaayggttatgttggggggattttatttaagaaattygggttttgtygggagyggtggtttaygtttgtaattttagtattttgggaggtygaggygggtggattatttgaggttaggagttygagatyggtttgattaatatggtgaaattttygtttttattaaaaatataaaaattagtygggtatggtggtgtgygtttgtagttttagttatttgggaggttgaggtaggagaattgtttgaattygggaagyggaggttgtagtgagttaagatygygttattatattgtagtttgggtaatygagygagattttatttaaaaaaaaaaaaaaaaaaaaaaattaaggttgaattygggttttygtaygttygtatttatttgygyggttattaygygttgtttttyggygattaggttgtattttttgtattggtagtygygttatatgtagaagygtttgtggtttttgagyggygaggygtagtygtggtttttgtagygtgygtatttgggtagtygyggggattttttgttttyggtatttaggttygaygtttyggagtyggagtygttttttttgttgttgttttyggygttygagtygttggtygtttttattagygttttagaygttttgttaaagttttyggttttgttttgyggyggtatttygggggygtgaggggttttygayggtgtagagggtttgttgaatgtttygtygttgggtatggtgtttttaggagaagtgygagtattttggttttttttttygtttggagattgttgygagggatgaattygayggatagygaygtttyggaggaggaggygtaggagaygtgtgygttgtagtyggaggygtagttggagtggygaggtttgggtaygttaygttyggagtggtggggggttgtgtttttttttttggygygygygygatttagaattttyggatattttttagaatattttygggattgtttgggagggagygtggttaygtttatygtttttygattttagttatygttttttagttgtttgtaaatttgtatyggttgtaagtatttagggttttgttgtagggtttttgtaagygtatygagagatatagagyggtttgggaatygygtggtatttttygtttygttttyggaggygttaagattyggttgttaaagtayggtgtatyga

SEQ ID NO: 6891 - DNA, 1667 bp, synthetic construct
  misc_feature 1..1667: note = Description of Artificial Sequence: Synthetic polynucleotide
  source 1..1667: mol_type = other DNA
ygattttatygtagtgagtgtgygtaygtgggttttaattttgttttgttttaatttygttgtttttttgtttaatttgataygtttygaattttttaatttgggaaggtatttggygatattgaygtatagtttygtygtttggttgttyggaggygttttttttgygggygygagtgttattygygttgggtttagatttagtyggtttttttygggagaggaagtttyggtttggyggagagtaggaaggaaagtttygataggtttaygttttaaaattttgtttttagtttttttaagtggagttgtagttggtatttygaagttgttttygygttyggttaaattttygtattttagaygtttttatttggtttggygagttgygtttgtagagtttygggttgyggttyggtagtttaaygtagtgyggyggtygyggttaattyggtagtagggygyggyggttgyggttgygayggttgagaggttggyggyggttgyggggyggygayggygtttttyggyggygggggttttggtagagygygtagygagtyggggatgaggttttttaagttttygttggtttgttgtyggygtagygttatttgygtagttatgattygttgtygttygatgatgaggatgtatttttygtaggtgtagtttttgaagyggtagtaaygtttgtggtttttgagttaggataggaygttatggttgyggtagygygygtatttgggygtgygttgtaggggygttygtggyggttgygatatygggtygtttatgtataggtagggggagtygtagtygtttatgtttygggttttygaatgagttggtagtttggttgygggagagggttagggagygttggayggyggggttgygaggttygtttaggggyggttttygggygaygyggtttttggtttygtagtttyggtggtygtgtgtgtttyggggyggtyggaggtgtygtagtygtttttttagtttttttygygtttatagttyggttttttagtttaygtttagttaaygtygaygygggtttttgttttgggygygtagtygggtyggtaygttttttttygyggaggygttgyggyggttgtaaggagtyggygatagttttgattaaggtttgagttagtttttttgtagttttttygtgagtyggtyggatttaatattttygtygtttttttttaatttttttttttttttatygttattttygtttttggggtttttgtttttttgtatttttygttttaygtttttttttttttttgygtttttygggtgtttgtattttattttttttgttatttgtagttaggttattttygygggggygttygyggtttttttttttaagtttttttygttattttagttygyggttggagattgyggygttttagaaygyggyggtgttygyggggyggagaaggggaggattagygggagtgagggtgggggtgtttgtaagygagtgaggtggtygtttygtttttttttttttttttttttttagtttagatttggtygygttttttygagtttaaggtygtttttatttygatatttggtygtagaagtttagtttygggagaattygaatttaygggagtgttgyggttgtatttygg

SEQ ID NO: 6892 - DNA, 433 bp, synthetic construct
  misc_feature 1..433: note = Description of Artificial Sequence: Synthetic polynucleotide
  source 1..433: mol_type = other DNA
yggttttttgtagtttygggygttttattttgttgaggtygttttyggttttttttgatttaggttgggygggaaaggtygggtygttttygtttggtttagatygttggtttattyggygggygygygtagttgtatttagygtagygttattggttttagtttgtagattgygtttttttttttagtattgttygtttaggtttyggagttttaygttttttgattggtyggttgttaggyggtgtgaatattgattggtygaggtaygttggtagggagtttttygtttttygyggtttatatttttttttttgaagygtttygttagagttygtttatygggttttyggtgtagtyggttygtttgtttagaatttaaattygaggtatgayggtgtttgtaagagagaagttattatttatttygygg

SEQ ID NO: 6893 - DNA, 896 bp, synthetic construct
  misc_feature 1..896: note = Description of Artificial Sequence: Synthetic polynucleotide
  source 1..896: mol_type = other DNA
yggttttatattttggygggyggygtayggagygtttyggttttyggtattagttagygtyggagtgggtaggattggagatggtagttttyggtttaggggaagygggattttayggaagggttgggaagagggtaggaagagggggygggggygggaattgtttygttttttttttttttgtttatttttattggttaagggttttttggttttaatttatttttygtttttagggygtygtttaaagtgtgyggagtaggtgttttgggtggagttataattttgygygagtgttttggttgagygtagygtttatttattgttygygagygtttatttatttgttyggtygattgtttagygaaaggggttttaggtygggygtagtygttattygggggatygaggttaggagaggggttaagagygyggttgatttttgygggtyggggtaggggayggtggtygyggttatgtagttttgtgttagggygtgggggttgygtttgggtygyggggtygggggyggtygtygtttggttgggggatyggggtygtgttgggygtygyggagtygggatagtagtagtggyggyggggatagygtygyggttggggtttygygttttttggagygttttttgtttagataygaygatttygttyggaggtatatyggttttggggataaagattagagagagatgttgtagattttggggttggyggtaaggatttttattyggtttttygyggtttttttttygttttgttygggttttgtttgygyggtttttyggtttttattttgagttttgttgygtttygygtggttttygtattttgggtttygggtygtggygtggaagtaaattygtgtttttggttttygt

SEQ ID NO: 6894 - DNA, 1494 bp, synthetic construct
  misc_feature 1..1494: note = Description of Artificial Sequence: Synthetic polynucleotide
  source 1..1494: mol_type = other DNA
ygagyggtttaggagygagtttaaaatttygtataggtttgttyggtygygttttttgattggttaaggygygttygtygtttygtyggtygtaggygttayggtagttttagtagtttgggtttygttatygttttygyggtagtttyggtyggygtaagtgyggygygygttgggggagggggygyggyggagygttaggttggygtygggttatygygggattaagttttttagttaygygtgagtgtttgtgygttttgattygaagtttttygtygggtygttattttagaagagaagatagtgagygtgggygaggygaggtatttagaggtttyggygatttttgttttttagtttttygttttttygygtygyggttttgggygggygtygygagtygggtaagyggygtttgagtttyggtttagaggtygaggygygttttygygttttgygygygygtyggyggggaaggtgygygggygttttgggttyggygtttgggggtgggggtgggggyggggatgggggtgggggtgggggtgggggtaggggtggyggygggtygtggggyggtggggyggtgygtttgttttatttygygyggttyggygtttygyggaagtygttgttgtggtttttttaaaaggatggggtttagaagttttttttgttattygtaagtttttattttttttagtttygyggtggataattttagattttttagtattttygttattttttttttttgttttygttgattaagaggtttaaaagtttttttttttttttgatttagaggggtatagttttggtgtyggggggttgggggtggggtgttagtttgggggttyggagygtagattaggtttttagggygygggagtttgttgtttttttttgtaggggtygttttyggaygttttattygtygttaygtggtttygggatgtgygggttgyggtagagagtgggtagtaatgtttttggttttgygttttygttttagtygyggggatttygaggygagtygttaattggtatyggtgtttygttttttatttttggtatyggygtttttttaatygtygttttygttggtgggagtaygttggttttgttttttttttagtttttttatttttygygttgatgggygtttttgtttgygatttggtagttttaggatgtyggatgttattagggaagygatgtttgggagaygttttgtgttttgyggagttgygygtttgttgggtggtgatggtgtatatttttgtttgygttttttgtagaggtataaaggttgggttatttttgtttgtagttatatggaaattaagyggagattgygggggaggagaagtggttaggygtyggygggaggtagaggtygtttygtagttattgggggygagtgggggtttttggagatttttattgygyggtgyggtttttgaggtgtttygtttgggaagatttygg

SEQ ID NO: 6895 - DNA, 828 bp, synthetic construct
  misc_feature 1..828: note = Description of Artificial Sequence: Synthetic polynucleotide
  source 1..828: mol_type = other DNA
yggaggttaygagttattagttyggayggtgaaatttattttttttttgygttttaygttyggatgggagaattttagttttttayggygtatyggggaataattttagagtagtaygygagtagagtttttagygtttttaygtttaygtttaygattttttttttaatygygyggtataaggaggtatttaygyggagttaatttgatagttttygtyggggtggaaattygyggttttttygtatyggtatttyggatataggtttygygtaggygygtagtttyggatttygtttttgtttttgtttttgtttttattttttttgggtattatyggatagtgttttgattygtagtttaatygtyggggtgtygattygyggggatttatttttttgttttttttttygyggyggyggyggygttagttygttttygattygagygtggygttttygygttggtygttyggttygggaaattgttaaattggtygttattatttaygygtttgtyggggaagggttygtyggygtygygttttygaggtttttgyggygaatygygttaygygygatttttggtygggggygggaggyggyggyggyggtaggagaagtttaaggttygagyggttygtagtttttaygtttgtatttttttattttygttagttygatggttygtttygyggygtgtattggagtaagtaggtttygtttygagygygygygttttgggaagtgttgtaagtttggagatttggagtgagtttygggygttgttggttygattgttygyggtgttttttyggtgaggtygygg

SEQ ID NO: 6896 - DNA, 2705 bp, synthetic construct
  misc_feature 1..2705: note = Description of Artificial Sequence: Synthetic polynucleotide
  source 1..2705: mol_type = other DNA
yggggttgttygtttatttaaatatttttygttttagtaaaggttgagattygttagttttgttyggtttgattagggygtttttttttygtygggtggtttgggyggtttygggttyggygttttttatttygttggtttttttaygttygtygggttttttaggagtgtattagtatygagtgtaaggagtygtttttgttttyggtygaggtaggggttgtgggttttagtagagaggtaaygggygaggtygyggtygyggagtatayggtggatggygtyggaggttgttgygaagtygyggggatagtgagtttyggttgtagygyggataygggyggtagygtaggygtgggtttgatgggtatyggtatggtaggtaggttttggtttgtygagtggtatagggatttgatygggatttygaaggttttatatttygggtttatagggatttyggttgyggttgyggyggtygyggyggyggttatygaatttatgaygttaaygtgyggttatayggagttgaygaygttgttaagttggtygggtayggggtagtttaggtggtgtatgayggaygttaagggtagttttttagtttgtagtaygtttttgtagtttyggttaataatgtttttaatggtaaaggggtgtttgaagtttgaygtggaygttgyggtygyggyggtagyggyggyggtygagtttagttygtagggtgggaattgagataggygttttaygttgtttatygyggttgtygyggtygtygtygtygtygtygttayggtygtygttttttgtattttgtyggggtgagayggttgttgaggttgygattgttggggyggttgttgygggggttgtgaygggaggtgyggaggyggttgyggagtagtaggyggttgttgatggaaatagtgtattatgtgyggyggyggygggggyggyggyggyggyggttggggtgggtggtggtgatggtggtggtgtgyggtagygtggtgatgatggtggtggtgggggtggtggtggtgatgggggtgaaggtgttttttyggatyggygttyggygygtttttggtgtttttygygtgtaagtgagtatggtyggygygtagtattttgaagygtttgygaygtygtaggaagttgtygttttygaatatgttttygtagtyggggtgtagygtttagaagttatttttgttaggttggtygggttttygyggaattttgatgaagtagtygttgaaggagaggttgtggygtaggttgttttgttagygttgtgtgtgttygyggtagtaggggaagygttttatgatgaatttgtagatgtygtttagyggtagtattttttyggtygagtgttggattgttatggyggttagygagatgtaagagtagggyggtttttggtygttgtaygagttttttttyggtygyggtatygttttyggtttttttatygtttttyggttygtattggattatagaattttttygtatttygtttttggggtttggttgtttttattaatttttattyggtttttttagtttygttattttgttttttygttttttaggttttttttgttttttttttttgtttttttygaattgtttggtgttttygattttggtttttygggtttatttagttttyggaagttggtaatttttggtttygayggttgtygattggygygtatagtygygggyggagtgtattaggtttatygtygttttttttgygttttttttygggtggttaaagattgagtgttggagttggttgtagaggagagtggtaaggggtygtgttttttttyggtttttttgttttttttaggttygagggaaatttagattaagatggttgggaggaaggtttgggtagtagagattttggttttttaaatttgagtttgygtttgttgttttggaggttagtgatagtaggatttttagtgttttggaygtaggtttttggttaggtatttagttagatygygttggagtttttttttttttggagtgaaaaattagggtaaggagagagaagattggtttttagggygtttttttttttttygaggttygtagygtygtyggggttagaagagaygygtagttttaggttgtygttgaggagaaaaaattttggtggtttttgaagyggtagygttygtaggttttgttgaggagtgtggggygtaggattttgggagygagyggygggttggagagggygtttgygaatgttgggtgagtgttggtyggggaggtttagtygttygygtygtagttgtygtttttttttygggtttgttttgaggaggagaggygayggtagtggtagygaygygtttttttggttgygttttgtaatggttttygagaygtygagattttygtagttagygtttygagattattatatgatygaggttgagggatttagtygtygtygtygygtttgtagttgaagaaggggtaagaaggygtygtgtttygttttygtttttttttttatttygtttygggygttttttatttatygygtttattattygttyggtagtttttagttatttttyggtgyggygggtggygtaggttgttygtygggagggggtatagtttygggtgtatttttygtagttgygttttattygggttattaagtaygg

SEQ ID NO: 6897 - DNA, 704 bp, synthetic construct
  misc_feature 1..704: note = Description of Artificial Sequence: Synthetic polynucleotide
  source 1..704: mol_type = other DNA
yggtaggggtygtggaagggtagygttagttaggygttatgtagttygygtatgaagtttagtattttttgggagttgtygtyggttgataygaagattatttygaagggygygggtygtygygtttyggttattagygtygtatagaagtygtagagtagyggygtgaagtygyggttyggygygtatygggtygtygygaagtatagtgttattattttgttttgtagygtygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttygtttttgttygtattatygggygttggattttttaagatttgttttagatgygtttatattttggttaggtttygtttgtggttggagtaattgtgttygygtygataatgagatatttagatattagagattttagatatttgggygatagygyggtattygtttttgggagyggggttagttaggtaattttaagtttttaggtttttgtatttttttttaattgygtttygtttatatttttgygtttttttattattgygtttygtttatatttttygtaagttttttaattgygtttygtttatatttygt

SEQ ID NO: 6898 - DNA, 950 bp, synthetic construct
  misc_feature 1..950: note = Description of Artificial Sequence: Synthetic polynucleotide
  source 1..950: mol_type = other DNA
ygtgtaattttaagtagyggtttttygggtyggggttgygyggtygtygttgtgttggtttttaayggtgggagggtattatttttttgttttgttttygttttttagaaggttgtttyggggtttttatttttygtttygtttyggggatagtggttygtttgttatgygyggtagttygygtyggggtyggtattagtagygttygggyggatgtagygagtttayggaggggtatgtttttaygtattaagtataatygttttaggaatgattyggtgatatyggtygatgattttttttatagtttgtyggtgagyggyggyggaggtaaggtttyggyggygygygygatttyggyggyggttttttatttggtgttyggygaggygttgygtaaggygttygaygatgggttyggtagtttgggttatttgttttataaggtgttttatttgaaattttttagttygggttttygyggtttgtygtyggtygttygggagygggygggygygyggttttygggtagttgtagygygtttagtttggtygtttyggayggtagtgygttttyggygtttygygtttyggttatgagygtygttaggaagggtyggttyggygaygagtygttgtttaggttttttyggggggygtygtaygttagygattaggtgttggggttyggagttatttaygtggttaaggtgggtgygggygygggtygttttgggggttgggggttttggggttagttyggggtagatttttttattttttgaagttyggggtgyggggygttttygygattgttaygttagaggtaagtaaatgygtattttttagtaattagttygtttgatagyggtgaggagggaattataaatgygtttttttygtatttattgggaaaaggtttattattygggtggttygtttygtttygg

SEQ ID NO: 6899 - DNA, 4861 bp, synthetic construct
  misc_feature 1..4861: note = Description of Artificial Sequence: Synthetic polynucleotide
  source 1..4861: mol_type = other DNA
ygyggtttttgtttttttttttttygattttttyggggttatttaaaagtygattaagtygtyggttttttagttgtttttatttttttatygttttttttttttgtttygtttgtttttgtgtttttygttaygttatagttygttggtttttaygttttttttggtttttttgygtatatttyggtggygtttttggtgtttttatattattgtttggaattttgtttggtttaygtygtttgtttttgtttttttttttatttgtgtygtttgattttttygattttygtttttgggggttttgtttttygaatttttyggttttttttttttagggygtgygtttygtttagtttttttyggtttyggtyggtyggttttttttaygtggtttttttttttttggtttttttttygttttttttttttttgggttttttttttyggtttagtttaggggttgggggtggyggygyggggyggggyggggyggggyggtgaygyggggttggtygggtaagaggygyggyggygtggggagggggygtagtttygggttygatyggtygagtttygygygtttygttygygttttgygttttygttyggtyggtyggygggggagggggtatgagtyggygttygygygtygtttygagttgygggtyggtttagagtttygygygggtttygygtyggagttaagtygtygtygtygtygtygttaaatygygggygtagtagtgggygtygygatgtagyggtygggggagtygggygtygygygtttyggttygttygagggttgygyggattatyggtygtatygttatygtagttttatgattgaggagatttttayggagttattygggtttaagggygtygygttygtagtygtygttgtygyggygggygagttgttgaagttyggygtgtaggygttgttggyggygyggtttttttatagttatttgggtaygtgtggyggtygyggggtygygggtygggtttggygggagatagygagttgaatygygggggygtttygagtttttttyggtatygaagtagtttygggaagttgttttgggagygtaggttttgggatygtttttyggagttttttaggygggaggyggagggtgtaagttttaggttttatagaaattaggtttygtgttygygggtygttyggggagggtgttygtttttttttttattgttttttttyggtttttagttyggggatttygagtgagtatttttagtgtaggygtattgttaggttayggattttygtgggtggaagygattttaggttaygggygtttgggtttygtygtagagggatggtygggagtggtygyggttgtttaatttagggaagtyggatttttggggaggaggtttgygttttygagggttgggtgttgaygygggtttaagtyggttyggagttttygggagttttagygggygaggaaygyggttttggtygtagtgyggatttgtttyggttttgttttggggttagaggtttgattgtgagtagttgtttggttgttttttttggttttaggtyggttgggtttttgtagggtttgaayggtttgygtagatttttttagtttttgtttttttttttaatttggyggggtttgttttgttttgatggtgttgtttttatygtattttattttygttttgtttttttttatttygttttttaatygtttgtyggtyggtttttttygttttttttattggggtyggtttgttttttattttttattttttttttaygggttttttgttttatatttatttgygttttgttttgtttttttygattttagttaggttaggattygtattttagtgataggtttgtyggggaagggaggtttttaygttgtagtygggattttagttttttaagtygttttttttgtatttttttattttttagtyggtgttttttagtttggagayggtagggttagygygttttttttaagtttagttgggattyggttattyggttatttttygtttttatttgttttgttgttattaattygtttgaagygggtatataattattttaggattgaagaaaatggaaatatttgtatggggaagygtttgaaaatagaaaaygtgaataataatttttaggtttttagggtattttggaattttygggaagtatttaatttyggtttagatgatttttggttatygtatggttgttgtgttaygtayggaagagtaaatgtgtaygtttygtgtatgttttttttttaaygtagtaaggttgatttggttggagtaaaygttatttttttaggattagttgtygttttttttttggtttttatttttttygaaagataagatatatttygagtttttygtagttgtaaatatgtttattaggaatttygagattttagaggtagttgaggtttggggaattttaggatagaatayggatagggtygaggagatatttttttttaaatttggggaayggtaaygttgaggagggtttttatttgygttatyggygtygatyggtagggygtggaggttttgygttgggaggtattggttaagygygagtattttygyggtaygtggtgyggtagtttttggggtagaggagygyggtygtagtttattygggtttttatttttttttttygtagtygtgttgaaggtygagtaggyggyggtgtttaagtttttattggygtygttgggttgtttagggttgagttttgygttgttggyggtagggttygggttgttyggygtygygggtgygttatatttgtygttygagttgtagtttygygggaagttggaggyggtaggttttggggagttaggtattaaagttaagaaggggygtyggagtygtattgtgtttatygagttgtagttgatgggtttggagaaaygtttygagaagtagaagtatttttttaygtyggataggtagggyggtataaggttggggttagygggttgtgggagtgtggttatttgttttgttgagggtgygttttgttttttttagaatagattttgttgagtttttgggtttgagttagttgtaggtgaagaygtggtattagaatyggaggatgaagtggaagaaaatagtgagtgtgtttggtggttttttattttttagttttttgggttatgtttyggtgtatgtagagttgtttttttttttttttttattgagattttgtttaatttttygattttttyggtgtttggtaygtatyggaatttttttagttttttttgttttttgggtaagttaatatttygttttttttygyggtatttttaggttttttggtagttttatgttttttaggtygggtygttttttaggyggtatttggataaatggtygttatttttygggatatttttttattatttttttatatggattttgtattttttagttttatttgggtttaagttttttygggggtttttagtttaygtgttggtttatttaggtgttggyggtttttygtgtaggtgttgtagggyggyggtttggagttttttattaagtttaaggggyggtttaagaagaatttaattttaaygagygagtagtttattgagtaggagygygttaaggatgtagagaaatyggyggaggtgtygggygagtttagygataggagtygygaggattgagggyggtatayggtgyggggtttgggatgttygygttattygtagtttttttattyggyggaaattygygagtyggttttttygygtttaagaagtttattttttaagtttttttattatgattttgaatgyggataattggggttaaaygaggaaggatatagatttaaaagttagatttaggttttagygygtttttgggttttaatttgggagattygtatttagttyggyggaagttatagtttttattttgagtttygtggygtagagygttttaygygtatttaygtttygtttttygtttgtatttttatttygtttggggtttgttttttyggtyggggagtttttaggtatatattygtttttggaygtyggggatttagyggttgggtttaggttataayggtttgagattgtttyggggtaattygtyggttyggtttggaggtygggttttygatgtygttggggtttttatttttttttgygaagayggtgattttttttttaataaaatattttatgatataatygggttyggtggagtagtttttgaattygtagggggtgagggtgggggtgggggtgggttyggtaagataagyggaaygygggtagttgttttttaaattttttttttttyggttttgtygaaggtagttgtgttttttattattaagttygggttaggtayggygggyggttyggtggttgtaggattttaggaatygtttttattttgggygtgaggggttagtttgaattttatttttttttttttgttagttagagagtygttggtaggagyggtttggtygtatygygggtgtttaaaggagygggagttagaggttygtygtagagttygtttyggaagtggttyggatagagagtygtttyggttgttgtttyggttttttgggatttgaaggattagttygtgyggtttttgagatggtttttattaattttttatgaggyggatgggaagtygaggaygtaaggtttggatagagtttttttattagygyggtagttygttygygggtttttgtagtagtaatggttttttagagtttttatatttttygtaggatatttagggyggyggygt

SEQ ID NO: 6900 - DNA, 999 bp, synthetic construct
  misc_feature 1..999: note = Description of Artificial Sequence: Synthetic polynucleotide
  source 1..999: mol_type = other DNA
ygttgggagtyggggygygtttttgtttttygygttaggagaattattttygttttyggagggagttygttttygtgagggtygtttttagtttyggttygtygtttgaagatagtagtttygggaatygygaygatagtatygaattggagattaggaagttttggtggaaaaggttaaggagtggtgtgtaygyggagttygggattygggyggggatagagygggagygygggygtagttygttagygtyggyggtagagttttagttagaggttgygaggggtttaataggtygttaaaggtgtttttggttagagatgttatagygygtatttaggtaggaggtataggggattttttataggggttgygggagttggygttttttygttttaggtygggagttgagaggggttttagygtttaggtygattgygttttgatygggagttattgygtttagygtagttygagggygttgagttyggaggatgyggygyggggygggggtttygggagtaatagagattgggattygagggttyggttygygttgttgtttaygtagygtttttattttggaaagagtgtttttygygyggygggtyggtttttttagygygtatttggggttgtttttgtagggttattttygtttttagggaggtttaygttygtyggygaggaaggatggtgagttttggtttagygggaaggttggaggaaygtaggttyggaggaaaaagttttttagatttgggttattaaygaaggtttttatagggattattaggatygggaygtygtgggtagaggygttatgttttttgygttatttttttggggatygygygttagttygtggtgtagggtygagttttggggttgtgagygygygtttygttttygtgygttggtggaaagyggggtgttygtgygtgygtttgygagygtgtgtyggttgtaatygtagggagygtaaataggtygttaygt

SEQ ID NO: 6901 - DNA, 1750 bp, synthetic construct
  misc_feature 1..1750: note = Description of Artificial Sequence: Synthetic polynucleotide
  source 1..1750: mol_type = other DNA
ygygtaygtattttagaggttatttagattatgtttygtygtttgggygtttaagttgtagtygttttttgtgtgtaggtagtagttgtttggtaattttygagttygttygygtttttagtatygtagaattagggttaggtgttttagtggttgtagttaagttaggtattttgtttagyggyggttgtataggagtagaatygagaattygtygtttaattttatayggggtgattgtygagtgtttatgttagyggttttaattttttttaggtggaggagtgggygggaggtaygatttgggggtttttaggttgggygygttggygatttygaggtygattaggttatgtatttttagttygtttgggtatttaagttgtagtygttttttgtgtgtaggtagtagtttttaggtaattttygagttygttygtattttttatattttagaattagggttagatgtttttgtggttgyggttaagttaggyggtttgttttgtagtagttgtataggggygggaatyggtttttagttttattttyggtggttgtagagggtttttggttagaggtttygagttttggtagaggaggagtygggtgggggtagggtttggygggtttttaggttaggggtattygygatttagaggtygtttaggttatgttttattatttgggygtttagttataggygttaggtaatttttaagttggttggygygtttagtttygtagaatyggggttagatgtygttgtggttgyggttaagttaggyggtttgttygyggyggttgtatyggggtaggaatygatttttagttttattttyggtggttgyggagagtttttgttagyggttttattttttttyggaggaggagaggagygggagttayggttaggygggtttttaggygggaagggatgygygtttgygatttygggatgttttgygygagtttaggagaattygtaagttagyggygtttgygttygagttgtagtygttttttgtygtttaygygagttygagagyggttttyggagttygggttagygtygagttgtaggygygygtttaatygttttgttgggtttaygyggtttgagaggtyggagygtttaattgttggtaygygagtaayggtttagttaagtttattyggtttgagaggtyggaggttgygagtgtygttgttgaaggttgtggtggatygggttggatygyggattttgagttatatygyggggttgggggtggattttgggtttgggggtggattgttggtttggtggtggattttggatttaggggtggatagyggggtggggagggggatygyggatttggaatttggtyggggtggaaaggttaygaggagtygyggyggtttagtagygggtggttggygtttgagaagtygttattatgaggaaattttttagtttygggagaygtttgggttaggygtttttgagttttatggattaagagtaygygggtygggggtattatatyggggattgggaattgyggaagatttatagggtggttattaagggygaygtygyggaggtggagygttgtttgattygtaggtttygggatttggatgttygygatagaaaggataggtagygggggtttagttygyggtgggagggggtttttaggttttgtttgttygtagygtttgaggygggggttttggaggtygtygggttttggagtygyga

SEQ ID NO: 6902 - DNA, 391 bp, synthetic construct
  misc_feature 1..391: note = Description of Artificial Sequence: Synthetic polynucleotide
  source 1..391: mol_type = other DNA
yggtgttggagygaggatgygtagatygaggtagggaggygggggtgygggaggtttygyggttgygygggygygtgttggtggtttyggyggaggtttagtttyggttygygttygyggygttttygttgyggttygagyggtttggttgygggatttgtgygtayggatggygyggtygtttyggtagtattygggggtttgggygtygttgtttttgttgttattgayggggttygtygtttgygtagttagtttygyggaygayggtgygggttyggggggtyggggatttyggggaygygygyggggggataygggygtygaygaggyggtgtygygttaygattttttttayggtattttygygggggagttttaygatttgygt

SEQ ID NO: 6903 - DNA, 817 bp, synthetic construct
  misc_feature 1..817: note = Description of Artificial Sequence: Synthetic polynucleotide
  source 1..817: mol_type = other DNA
ygygygtygtttttttyggagttttygagttgttgaggagtttggattgtgtttgtttttagtgttagatgaaagggygttgaggtttttggtygttgtttygygtttagtttygygtaygtttttttgygagttyggtygtttagygttttttttygttygagtygtygtttgygtttyggggtagtygttttgtttttagygygatgtggtttygtttggttttttgttgttggggtttggygttygtttygggttgggygattttttagtagatgttttygtygygtaattttagttttygtttttttttygagatygygttyggggttttygggagtattttygygtygttygtttttggygaygaagyggyggggagtagagtggagyggttgggttaggygtttyggygaygygtgyggttgttgygggagtttagygagygtttggagtttgtttttttggtggatgattygtttagygtgggygaagttaattttygtagygagtttatgttygttygtaagttgttgttygattttttygtggtgtttayggttaygygygtggttatygtgattttttygtttaagaattaygtggtgtygygygtygattatatttttattygtygygygygttagtataagtgygygttgtttttttaagagatttttgttattttttatygaggtggyggtatttatattaagggygttttttagtaagtygyggtaaggygttygtttttttygattygggttttagttttygggtttttygatttatygttgtttgttygtttttatttygg

SEQ ID NO: 6904 - DNA, 814 bp, synthetic construct
  misc_feature 1..814: note = Description of Artificial Sequence: Synthetic polynucleotide
  source 1..814: mol_type = other DNA
yggagtaygggttaygtgttttaggtttygggaattagtttttattggtygagggttygyggggtygttaggagggttttttaggttttttttagggatggagtagttaygtttttygagtgtgtttattttatygatggagtaaagtgaggtttttagttygttyggatgtttttgygtygttygyggggtagttttygtatagataygttygtaagttttygattygttygttattygygtttagatattygygagtttttggggtygtagggayggtgtagygttygtygaggygtttttatttatttgtgattattgtyggagatttttggttttttttygttygtagttatatttgtagygtgaaygygtttyggggtagttygaggtyggttyggaggygtagttgttygtttygttygttgaaatagagygttyggttyggygggttyggtttttyggtggygtttttygtttttygttgttgtygtygtygggggaygygtayggttttttaggtatygttyggyggyggyggyggyggyggygaggygyggyggtygygggtygttygggtggygtaggtggtygggtyggyggyggggygygggggtyggtyggttygygggttttttygggttyggyggggaygttyggttagttygtagtttagygyggygtttagtagttttaggtgtagtatttaattttagagtygtatgttygayggtttttttygtttttttttygtttttgtatygttattyggagttgttagttttgggagtttyggygtttygatttttttygt

SEQ ID NO: 6905 - DNA, 1429 bp, synthetic construct
  misc_feature 1..1429: note = Description of Artificial Sequence: Synthetic polynucleotide
  source 1..1429: mol_type = other DNA
ygygagggaaggattattaaatttaaagaygygygtgttygtgtgtttatatagaygtgtgtttyggygtttgtatayggtyggygygtaggtatgyggaygtttataygaatatataggtatgttttattgaygtatttggggtatttttttttaaagaaagtaaggaatgaaaatttaatttgagagttattagggtttatttggaggtygtttaaggggtagaaaaaatttgtaatgaygttagagtgtttgtttttggtgtaattttattttygggagggttggatataataygtttggaaagttygaggggttgttttaggatttgggggyggggggtggggtatttagtaatttttgtygygggttgtttaagaaaygtggaaatatattttgygattttttatttttttatatatataggtaygygatttygtygttatttttyggattagtagtttaygtttaaygttgggtygattttagatatataggtagtygggattttygttyggtgygtttgtttatttatttttttgygttaggttgggaygygtttygtttgtaaaaggtttaaaygtatttttygtygyggggygggatttaggggtttaggtttyggggtttagaggygggtaattttgttaattttttttagyggyggggaaygtygygtaatygttgagttttgttygtygagattaaataagtagaggaataggttgtaaatatatattttgataygtgagtgatatttaygyggtgygagaagttgtagttaagggaaaggtaaggggtggggggagygggtatygataggtayggaattttygtaggygtyggaaayggyggtttttygattttttttttttttagaaagtggtaaygaatgtttaagtttttygaatttgttttttgtgggaggtgataggtgaayggaatttaggtttggttattttygtygttgtttatttttttattatttgttttttygtagataagtagattyggygtataatgaggtagtagtttttagtyggttatygtgattaatttagaataaaagygttttttttaygttttttttaataaaggggttattagtttyggygtttttygaaggttgyggggttttyggttgtyggttgyggagttgtygygygtaaatttttyggggttttyggggttgtyggygttayggagtyggggtygyggagggaggaagygtaagtygttyggagaaagtgaggttagattyggygggggagaggggagggagtygggyggtygyggaaggagggtgattgattagtgygyggtgttyggygttttgtttygttattagaggyggttaaagtagggttaygtaataattttagaatygttaattaattgaygttgtaggtaattattttattgtgygygt

SEQ ID NO: 6906 - DNA, 7708 bp, synthetic construct
  misc_feature 1..7708: note = Description of Artificial Sequence: Synthetic polynucleotide
  source 1..7708: mol_type = other DNA
yggaggggaaagygagtttyggaaataggygtagtttgtggygagggttyggtggtygagttgaatttyggggtttygggagattyggtttttgygggggaggtttttttygaagtygttattggygggggagtagagaaaaggggaaagaaggggagtggagaaaaagggaaaggagtyggttttaagtagygaggtygaggtyggttagaggtaagggtagggggyggyggygggggaggtagtygtggggtttaggtttggtyggygtttygaatttttttattttygtttttagtgttygggggygggtygagattttttaggatyggattyggggaggagygaggggtygaggggagggggaggattygggttttttttttttttttttttttttttttttttaattaggtygatttaatggagttaaagagttygtaaaattatgaataatttattygtgatttgttattaatttatygggtttygagtttttgtygttgggattgaatttgtaattaaatttgatttygttttattttattaaagaygagattgtaggtttaattgtttaaataatggattggaattaaattagtaattaygtygttaggtatatatatataaaaagttggggttgggggaggtygggygttyggtyggttygygygggattttygyggtygyggygygtaaatttaggygtaaagtgygyggttygggtttttygttygtttttgtygtygttttygtatttttagttygttggtagtttttttyggggtagggggaggttttygttttatyggggttygggttygaggggttgygggaagaggtygttgyggtttygtttyggaaggatttttygatttygyggttygyggttttgttgtaagtttagygttyggygtttygayggygttttttttttattyggtttttagttygtygttttttagtaaggtgtygtygygtttyggagggattgtttttagagtaagaggttttgtaaggggtygtygtggttgggttataggatgtgggatattgttataaataagttygtgttttygtggtyggaattttgtaygtataygtataygattygygttygtatatttygttygygatygtattttttagggttttygttttttagttttagttgtttygyggtttatattgyggttattttttttttgttagtgygggaggggagggaagggyggaygttagatttaggaagattgggttgggtttygagaggtyggggagatgttttttttttttaatttagtttygggagtttygaaagagttagtygtatagttatygtyggygtatygaaygtygttttttttaggattaggagtttyggttaaggtyggagaggagggtaygggaataaataygatatatatagagatagagatagagagaaaggayggagagaayggaaaggaaaaaaagagagagggaggttagagagaaagtgagatggttgaatggagggtgttttttgtagaggttaaataaggtttgaaatttagtttttagtttatttygttggggtaaayggyggttgaatagtaaaaagtagaaataaatttttgtattttttattttttttttgtataattttaaaatyggygtygaattttygtgtttaggaaaataatatagttttttagttattaggtgttttggagtygagtttygygaggtgttttygagtggaagttgatttatttgataaatagaagyggtttggtgttgggggagtyggtttgaattyggttttgtttttttttggggggtggtaggagaggagggatggaagttttagagagttatatttgtggtagtgtttttagtaaattttaaattygygttatygatyggtttatygttgttttattatttattaaattgggggttgygttttttttttagtttygtatatagggatataygttttatgattttttaagygatttygttggagygaatattygttttttatttttttttttatttaatttagattttttaagatgaaaataattgattttttttygtygtagtattttttgtatagttttgggtttgtttttgtttttgtttttttttgtttgtgtattagattaaagggaaaaggaagaagaatataaaatttttaaatttaattttgttgtaaaygaaagaaagaaaataattgtatataaattttagttyggaagttyggagagttataaattttttygggttttgtagatttygggtagatgttgayggtttatttgtyggaatttagaatttttgtagttgttttgagtagggaggggygygggagggggtagagttttttygggaatggtttggggtttaaagatgtyggaaattygaattaagttttttattttattttattttattttattttggygygaggttaggtttgtttyggtttygttttygttyggggggttygttttygagggttayggtttttattttagtaggygttaggaaattyggaggaaaaagttygggaaaattgagatttgtttttaaaggaggatygggtygagtaaaaggaatygtagtttttgtttttttgagttttttaagttygagttttttaagtttgtygtttttgggatattttaygaggttaggtygtattttaggtygagttyggygtttygggttatagttagtttttttttttgggattttygtygttttgtttygttttttygttgttttagttttyggtttttagtygygttaatttaaaatttgtttggygttagygtygttttgttttttttatttttgttattttttgtttagtaaagtggggtaaaggtttaaattaaaaagttatttttaaaaaaataatttattagagataaggttttgtattyggagtagtaagggattattgtatttttttttttygttttagtygaggaygtatagtttggaagtttagggggttaatgttttttttgygaggtygttyggtgtttaaggttygttatttgtttagtatatagagatttaatttagttttyggtygtygaggtygtatatttttttttaattttatgggggygtttygtgygtygygtatttattagygttgtaggtygttagattygtatyggggttygggtttttaygttttttyggtygttttttttgtatagtgtttaygttattgtagtagggaagatttagagggttggtttttgttgygtttagtttygygtttttggtygtygyggttgtagyggtygtygttgttaygtyggtatggttgaagtgtgyggggtattygttttgtagtagygtttygaagtgtaagyggtagtagattaggttgttttttatgtygaagtggtygttygtggttagtattttgttataygtggtgtaygtgaagtagttgaggtgataaattaagtttygagygygtattattattttygaggtygagatgtttaggtggtagygggygtagygttgtatagagaagygtttgtagggattatggagggaggggttgtgggaatatayggttgggtattttttttttttttttttaggtgtygttgttgttgyggggggtaattttttttttaagaygaataattyggtttttatttggaggatgggggggagagagaattagattttgatttaggtttggttttgttttaaaatagttttttttaatatatttatgtttatagagatttttattttatttagagttttygtaagttttaggaaagtttttatttgggagtggagggagatatttattatttattttttttttaatttttatttttttttttaaattagygtttgggaattttattgatttttataatttggaagaaatatagagatagggaaagagagagagatatagaygtagagatagagatagagagaatatatatagattttaattttaaaattggggagaaggagaaatagagaatttggagtttattagtgattttggttttttgattttggttattttttatttttatttttttaaaagatttggaaatgtatttatttttatagttttttttttagttgtgttttattttagtttgggttgtttaggtttgggggtgtttgtttttataatttyggattaatttaagaaattttaaagagagaggggagtaaggattttaatttaagtttttttgtggtttaagtttygagtaggagggtagtttttgttttttttttggtttttttatttygtagatttttttaagagttttttaaattgttgttttaaaaggttattatttaatttgtggtggtttggagaatttggggggggagygggggagttttgagtagtgaatttttttttgggattaaayggaaaggagagggttaaattgtaagattgtgtttgagattggggggaggggttttgaggggtagttgggtgggggggttatttgtagtagttttttttgtagtagatgttatygtttttgttgaaataggtgagtttygattttaggttgagtttgtattygtagtatttgaggtagygtatgtgttattgtttgtttatygttagtaggtagtagyggttygagattttgttttygtagtyggygtatagygyggygyggttattgttgatggayggtatggtttgygaagggagggaggyggaagatagtagygtttgygttagttagyggttttttygtygtygggaaatyggtatttataattttttttgtggttttggttattttgaaygyggagggggttgttaggatatgyggygygtttttttttattttaaaaggtttatttttatttttgggyggtttagaatttaggtttgtttgygtagttttygttagttaygggtttaggtygggtttttggtttaaatggttttggtgtttattttttttttttttagttttttttgtttttttttttaaaatgttygggttgtgtttagggattaggatagttattttagttaagttttttaagagttttttttaaattgttttttaaatgagttattygggggataaggtgattattaagttattttttatatagaattttttttggagagatagyggagtttttgggttttagttttagtgatttttggatttttagattagaggttaaggttaggataagttagttaatttttggtttttttgttataygggttggggtttttttgggttyggggatgaggtaagtggggtgtagggatatttttaaagttygtgggtgaaggataggtttaatttaaatatttttttatttaaattgattagtagagaaggtttaatygaagaagygtttagaggtygggaggatattggygtygttgtttttgttttyggagtagagaagtttttttygtgttttttattttygyggttttttaaaggttatttttgggttygttggtygggtagtgtttgttygtttggtttttagggaggtttgaggygaggaattggttatttggggttgggttygyggagttaggtgtagagatttaaatggagtttttttyggygagggttaggtyggagtttgaatttttagttttggtttggttaagtttgattagttaagggtttggggaygygattaaygataaatgttggtttygaagatttyggtttttgaaattgygttgggggttgaggaggattttygattgtyggaaagttgggagyggtttaagtyggttggagttttaatgtttttagttggttygtttttttttggygtygttygyggygtygttagtaatyggagtygagaggtggaggagagygyggggttgtygatttyggtatygggtaaggtgagaagggagtygtttygggtygyggatgggatttygtttttagttyggaagaaaygtttttttttatttttagggtygagatttyggttttaattttgttttttttttgygttttagtagtygggtttttttygaatygggagttatyggttttgtattttgatygaggatttttagtatttagtttygtgyggtaygaaggaygttttttaaatttyggggagtagaggygttgattggttyggttttattttagtttttagtttygattttatagtygygygtttatygtttyggtgtygtygyggtygatggyggagttgatggygggagtttygtttttggttttgyggtttatttygtygatgatttygtgtatttyggggttygatagattgtggaatagtatygyggygggatyggyggggtygggggygyggttttttygagggagggtttgtttttygttttagttgtttggygtttttggygttaaygggttyggtgtatygttatygyggtttyggtttygttygagttyggttgagtttttaggtygggtttygggtttygggygttygyggggtaggaygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatygttygttyggttttagygttyggggygtaaagtaagggygtaaattttgttygaggyggygayggttgyggtyggggtttattttgaagtygttaggtgttygyggyggtttagttgtttggattttttttttttttggggtgygtttttagtttaaggygatttttttgggygttgagtyggygattggagtaggggttttttygaagtttgygagtygagtygagttatygggagaattgaagaggaggaggaagaggaggaggaggaggyggaggaggaggtggaggaggagaaaaaagaggaggagtagagtgggaggaggagtygtyggtygygggtttagtygygygtaatgttttttaagygygygtttagtttagtttyggttttgtagttygygttagygtaagttttygygttttttttatagtygygtttgatattaygttttgtygtygtgttattggtygttyggygttttaggttttggtagygygtgtttygggaaggygggagatttaagagggaggggagaggtaagaggagtagaggagagtygagatggtgggagttggtgggygaggttggagggygggggtgggggggaggtagggaggagggagagygyggggtttggagtttttaagataygaatagttttttgygatatttttagaaaggaaaattaaattttttattttaagaaggygtagtaaggggatgttygttttattgyggttttttttyggtttggagtygyggttttaggtattygtttgggaggttygggaaggtaggtttgtggtagagttgtaagagttttyggtyggtygttttttatygagtttygttttyggttygggttttgtatagygggttgtaggyggtygtgtaagttttttgggtattyggtagagtttgagtggygagatyggygagagttgtgattttyggggaggggggttagttagtatatttaygttttaagttygttagggtttaatttgtagtttagygtgtagtttttygtttttttygg

SEQ ID NO: 6907 - DNA, 3969 bp, synthetic construct
  misc_feature 1..3969: note = Description of Artificial Sequence: Synthetic polynucleotide
  source 1..3969: mol_type = other DNA
ygttttttttgygagtygygygygtttgygatgygtaggttgttttggatttttyggggattggggggatttttttgggaagttaagggggatattttaagtgtgttttgtaaatygtattttttgatgtgaaaatyggtatgygyggtgyggtygtayggggagagygygtgtttgggggtggggggtatygtttaggaaagyggagttatttygggyggaaagygattttygtagaaagygtygygygggygtygttgygtgttygtygtttatagtygtagttaaagagaygtaggyggttttaygyggtttggtttatygtygtttgtagtgttygyggygyggggygtttygaggttgggtttatygtttttttygygtttttgaagatttttygggttttttygaaggagtattgtttttttttgtattttttttttagggagttyggtygtagtttttttaggaaygygttggygygtyggygtyggtgtaggaygtygtgggtttttttttgggttaygaagattgggaaatgygagtttygtgaagygtttatygygtgtttygtttagtgtttyggagatygttttayggtttaygyggygggggtatygtaggttttygttygttttggaggaggggagyggygttgttygygggtttggttgggtgttttttttgtygtgttttygggttagttattttygtygtttatttttttyggtttggtttttttgttttygggggttgatttygagggygygttygggggtaygygyggaagtygggtygaagggggttgygggygtygtygygtaaaygtgaggttgygggtygatgtyggygaggagaaggyggygyggtttygggtgtygggtaattttttggggtttaygtgaatygygygtggaaattygtatagtygttygyggaaatttaaatttttygtttttattygtatygygttttyggyggttagattygttttttttaggttttygttttggttygaggygyggtttttgttyggttttttygatagygagtttygggttttttygttagtttttggyggttttgggtttttgtygtttttttygttttygtttggggtttttttgtttttygygatttttgagagttttagatttygygyggatttttttggggtyggttttgagagtatagtttttygtygtagtttttggttttttygtaatttygayggttatttgtggataaataggatygtygttttgtttatgggaagayggggttggtgagggttagagaygtttagggygaggtaatttygtgygtttagtttygagtaggtygttttttaggaygttttatagtygaggggatygttattygggagygtygtgagttgtgggtattaygyggtggtggagagtgattttygtttyggggyggtygtgttgttygaatttgttttagttygygaggggagaygggtttgggggtaggygggagagggaggtttygggaggaggygagyggggttgagaggaygygygggaggggttttggagaggtygtaggaggygygtttyggagggaygatttttgttgggaggaygaggttttaggtggaygttgtgggtyggtgggtaggagttygagttttgtaggagyggtttaaattggttattgagygyggaagaagggayggaaggtgagygttattgggttaygtggggtygagagaaaggttattgtttgttttttttaaaattagttttataygtygaygtttttagagaattggtttggtttggaaggaggttgaggatgtaggyggggatattaaagaatygggtttaaggaggtgggaatttayggatttygagtttttataggaggtgttttgggyggtaggagtgggaggggaggtttatgtttttgtagttttygatatttaygttttygggatatttaygattttygggatatttatattttygggatatttaygtttttyggatatttaygtttttgggatatttatatttttgggatatttaygttttygggatatttatattttygggatatttaygttttygggatatttatattttygggatattttygttttyggaatatttatattttygggatattttygttttyggaatatttatattttygggatatttattttttygggatatttatattttygggatatttaygttttygggatatttatatttttgggatatttaygttttygggatatttaygttttygggatatttaygttttygggatattttygttttyggaatatttatattttygggatattttygttttyggaatatttatattttygggatatttattttttygggatatttatattttygggatatttaygttttygggatatttatatttttgggatatttatattttygggatattttygtttttggaatatttatattttygggatatttaygattttygggatatttatattttygggatatttatatttttgggatattttygtttttggaatatttatattttygggatatttaygttttygggatatttatatttttgggatattttygttttygggatatttatattttygggatatttattttttygggatatttatattttygggatatttaygttttygggatatttaygttttygggatattttygttttygggatatttaygtttttgggatattttygttttyggaatatttatattttygggatatttattttttygggatatttatattttygggatatttatattttygggatatttatattttygggatatttatattttygggatattttygttttyggaatatttatattttygggatattttygttttyggaatatttatattttygggatatttataattttygggatatttaygttttygggatatttatattttygggatattttygttttyggaatatttatattttygggatattttygttttyggaatatttatattttygggatatttaygtttttgggatatttatattttygggatattttygttttyggaatatttatattttygggatatttttattttyggaatatttatattttygggatatttaygttttygggatatttatattttygggatattttygttttyggaatatttatattttygggatatttttattttyggaatatttatattttygggatatttaygttttygggatatttatattttygggatatttaygtttttgggatatttatatttttgggatattttygttttyggaatatttaygttttygggatatttaygttttygggatatttaygttttygggataygtatattttygggatattttygttttyggaatatttatattttygggatatttatattttygggatatttaygttttygggatatttatattttygggatatttaygttttygggatatttatattttygggatatttaygttttygggatatttaygttttygggatatttaygttttygggatatttatattttygggatattttygttttygggatatttatattttygggatatttattttttygggatatttatattttygggatattttygttttygggatatttatattttygggatatttattttttygggatatttatattttygggatatttaygttttygggatatttatattttygggatattttygttttygggatatttatattttygggatatttattttttygggatatttatattttygggatattttygttttygggatatttatattttygggatatttaygttttygggatatttatattttygggatatttaygttttygggatatttatatttttgggatatttaygttttygggatatttatattttygg

SEQ ID NO: 6908 - DNA, 2490 bp, synthetic construct
  misc_feature 1..2490: note = Description of Artificial Sequence: Synthetic polynucleotide
  source 1..2490: mol_type = other DNA
ygtgaattygagtttyggttayggtygttattygtttttatttatttttaygttgtagtgygattagttattygygtggtattygttaygatttagttgggtttatagataggagttgtttttttttattgtaggygggtgatttaaggtttttattgttttatatttgtttagatygyggggtattygggtttygtagttttttggtygygttyggggttyggggagtygggttgyggttggggggtttggaggatgagggygaagattygagttggattgyggagagggtgtyggygygggtygggtttggggggaggataygatygggttttygttttyggatatygtaygygtygatatagaggggtyggttttyggttttggygyggygggttggygtagggyggggtggyggttgaggggttygggttttaggtgygtttyggagyggtttyggyggyggtgygggggggaatagggaggtaggatggggggyggggaggygggaggggggagtygaggttttygygtygttagtttygygttttygttttttygttttyggttygagyggtygttatygygggygggyggygttgygttygggtgyggtttttygtyggyggyggyggygyggtygagaggtgygggtttygygygggygggaygyggggygttgttygtaggagygattaggtgggygtygggtygatygtagtygtygtygygttttttttygygtttygggttttggtttttygygtttttttttttyggatttygttttttygttygaggtygttttttygtttygggttyggtttttyggagttygtygattttygttygaggttttttygttygaygtttyggtggtagyggyggttygggttgygtttttygttgtygtygttgttgyggttttgtttttttyggggagggggtttyggyggttttgygttttygggttttyggtttyggygtygtygtttttygttttttgyggttygggttttygtttgggttygattttgyggggtttygttttggygtttgggtttttgttyggtaggttttygygygttttttgttttygattttygggttgggygttttygtttttaggtttttttttygtgtttttgtagtttttyggtttygttttttyggggtttttttygtttyggygtttttgtttgtygtttatygttgtgtttttggttttgygttagttttttttgggtttttttttygggttttygttgttttttygagtttttgatttaattttttatttttygtttttttttttttttttttttttygtttttttttttttttttttttttttttgtttttttgtttttttttatttttttttgtgtttygttttygtygggttttttttagttgggygttttagtgtttgtgtttttggtattttyggattggtttygtgtttgygttyggtggygtyggtygttgtttttygttagagtttttttttatttttggttttttyggattttgtttttgtttttttygtttttgtygggtttttagaatattygggtygggygttttagygtttttgggttttttggygtttttttygyggttgagtttattttttttttttagaatyggggttttgtttttagataaaygaattttaatygaagygtatygaattygagggttttagatygggygygayggggttygygygggaggagtttttyggayggggygggagygtggggtttggtaggggaaggtygggygyggggattgtatyggatttatttygggaygttgygyggggygttyggtgggtgtyggyggtagygtttgggtatagagaggggattaygygaygggtyggygatagyggttggggyggyggtygyggggattttaggttgtyggttttygtyggttttttttgattygttgttttttygtaggyggaygtygygggtatggattattygtaygaygaggatttggaygagttgtgtttygtgtgyggggataaggtgttyggttattattayggattgtttaygtgtgagagttgtaaggtgagyggygagygygyggtaggggtgyggtagaygggygttgyggggtttygttgatttttagttttygtagggtttttttaagygtayggtgtagaataataagtattataygtgtatygagagttagagttgtaagatygataagaygtagygtaagygttgttttttttgtygtttttagaaatgtttgayggtggggatgygtttggaaggtgygygtygygygggtttygatttttgattttttatagtttgagggggtagggggtgggggtgggagaggggttgaggggatagtattattggttttygygaaggtttttygtgygatattagggtttagtygttgtaagagaatygggygttggygttgggtgggtttygggyggggaagggaygt

SEQ ID NO: 6909 - DNA, 5370 bp, synthetic construct
  misc_feature 1..5370: note = Description of Artificial Sequence: Synthetic polynucleotide
  source 1..5370: mol_type = other DNA
yggtyggtttagygtaggatttygggataayggatggtaattgggggtygttyggaggtttttaggattttattagtgttygttgggttgggttggttygttttagttttaagaygygtagttttyggaatttttggagttgttyggtttagtygygtatagagtyggyggtagagygggygygggtygggttyggtagggggttgatygggttygagtgtygggyggtggyggggaaggaggaygagaagygtttattgttggtagttttgtttgtagtatagttttygatttyggaagtagtagttggtggtgagggtttgttgataygtygygtattgtaaatatttttygtgttaggaygattygttgattygtattaggaagyggtyggagatgggtygttggtagttttygtagayggygggatgygggtagtyggagtttgtagygtatagggygaaagttyggtygttagygtygttyggtttagtttyggygtttyggtygtatygggtttatagttttyggtttygagggttygggtygttygggattatygtttgtygtttgygtttttyggatygtygygttaggggtygggyggtttyggttagttygttttagttttygggtttyggygtggagaggtygygggtttygagttttggttyggygttgtgtttttttttttttyggagaattygygtttygtgttaagataaatgataaygagtayggygtagggtggtyggttgggattaagataggygaggtgaggttggggygttygttggttgataygttttayggtggygttygtggttttttattttygatttttttaaaatttgtggtttgagtgattagggagaygttttttttttagaattttttttattttaggtgattttgygttttttttaagttygttaaggtgattgttaggttttttattatttttgttattygttatttattatatyggagtggtagttttagaatttaagtttggaaaggatggtgggtggygattggagttgttttgtttttttaggaygtttgtyggaggygtatttgyggttttttggygattattttaggagttttgtttttgttttttttttatgttttgtaaatttattttttttattygttggttttaaygttygtgtttatagtyggaygaygttttattttaygttygagattattygggygtttygatttygtatttatttagtagtatttttagagtggygggttyggggygtagggygtgtttttttattttgatgtygtttaatattttggygtagttygtttgttygygagggaagtatttttttagygattygggatttgttgttatatttatgggaygyggggygygttgyggatttygtyggtygggttgttygttygtyggttygtttattygtttttygttgtygyggttttggaatyggggaggygyggttttygtagggtaggggttgygtyggttttyggygatygtggagyggygaygygttggtttygggtttyggygtygtgygggygggtyggggyggttgtagttygygtygygttttttyggatatttgtagttaygygygtyggtttttttgttatttgtttgttagtttyggaattyggyggyggyggttgttgtagayggagtygyggggaggaggyggyggyggyggtggyggtggyggyggyggtaggygggggagggggtgggggtgtaggggyggtttygygggtygyggggggggygygyggygtagyggggtttygggyggggygtagygggtygyggggtttygggygygtttttygygttattttagtgttatggtgygttygttgagtygtygggtttagagttggggttggyggyggagggataygggtygttttatttttygaaattttttgatatttgaatttygyggtyggtatttttgygtygggatgygtygtyggttttaygttaaatagtgtygtttygttttttygygygtttyggggtttygygtttttggttygygtttygygtygygtttggtttygagtttaggtttyggtttttyggttyggtygtttygygggtttttygtagaagttttgatygttttygaaataaatttttttgttttatttttttgaaaaattgatttgggagttggggagygaaggttttttttttttttttttgttttttttattattaatattttgtaaagttttagygttaygaggagtggtttygagygaggttagattgygyggayggtagggagygyggyggtttygttaggggayggygtyggtygggagtggtygtttgggaattttygattgtyggtygaggtaggtygygggggttgagtyggagtttttygggyggyggygtttgttyggggtygtttggttygyggagagggtyggtttttaggaaygaaggaygggggygggtagaaggygaggayggttggttttggattygtgtaaggggggtttaggtttaggaayggggagtgagtttggagtgtgggtgaggggtttgggaaagtttygggtttggtagagattgggygggggattgagtygatgggaggttggggtttygggatygagaatgggggatattgggaygataaggaaggttaggtttgggtttaggygatygagagtttagaggataattaaggttggaaaaggggttttygggtaggggtaggagtagtgggtaagattygggttttttagggtttgtagtgaggggygttaggagggagtggtggttttagggtagyggttttgaagaaattaggttggttgttaagatyggggttttttggygggtygggtgttyggttaggggtygttgggaygygyggattaaggatagtgttttagttagtttgggtaaagtggatttyggtaaygggaygygaaagttggygagatggagttgtygattttygygttagtygggtttggtattygygttyggtgygagaggttatagygtyggatyggttgtttgyggttygtggtttttatygaygygyggtttatyggggagtaggggggyggttgyggttyggggtagyggygggttgatttttygygattygttgyggggyggtttyggtttttttyggagygaggtagyggygyggagtygggygggggyggagggtatggggggygggttttttgatttygttggaggygaaagggyggatyggatttggaatttgygggaggtttggttagaagtggttttttgygtygyggggtttygyggaggggttyggttttgtggaggattagaggttttygttttattttatttgygtgtgtgtyggtgggtatttgtgtgtgtttgtgygtgtygggttttygtttttgyggtttttgttttygtgtgttttttggttttgtatatayggtatgtgtgtttttgtaattttttagatttttaggggtgaatttgtggatttgtgtttgagttttttgtattygtgtgtatgtgaatgtgtgggtttttygtgtttgtgtttggggtgtgtgttygtattattttatgygggggtttaagtttttgtgygtgttttagtttttgtgttgtgtttgygatttttttttgtatgggtgtttttgttagttttgygtatttgtgtttattttyggggttttgaatgtttttgtgtgttygygtgttttttagtgtgtgtgtgtgtgtgtgtgtttgtgtgtggtggggggttttgtgttttygtgtatttttaggygtttttgtgtggttaggtyggggagagtggatagttaatgtggagttttttttttatatttyggttttttttttgtttgatttggaaattttaggtttggattygygaagttgggttgggtttgagtygtttttttygggtatttggggygggggygyggttgttgtagggagaagtygggygggtaaggtttyggygtatagagttagagtttygaggygyggagygyggttyggggtyggygggyggattaggtattttttgttttttgttggtygyggtttatttttgtaatyggggttgggygattgtttgtaggygagagttttygttttaggtttagatttttttttttttttttagggtgtatatggtaatattttttygttataggttttgtatttttaatttttggygtaaggttttattttttttttattttttttgtgtttggttttttttattttatagtttttttttttttttttttggttgaatgagggtttttgygatttagttttttaggtttttttaattygggttggygtttagtgtygatttggggtygttggttgtgtttagaggygtatttttyggattattygaaggtttggttttaaggtaggaggatttgtgggaagtatttttttygtgtygygtttggtttgttygggtgygtatgtatttttagygtttttttygygtttttgttagttatattttaygttattaaggyggatatagggtggtttgtygttatgyggttygygtttagataggggygttggttyggtggaygttagagtttggttgttttttttggtttggggtggggttgttgagtttatattttttgggtttttttgtatgtttttttygttgtttatttattttttttatatatatatatatatatatatatatatatatatatatatatatatatatatatatatatattttttttataggtttygttttttgttttttgtttttatttttygtgtttygtgtttttagttgagttggtyggtttygggtttttygtaygtagaygygtaggggttttagatttttttagtataatyggggttttygygtttttttatygttttttttgtygaagaagygaagaagyggtygattggayggtatagtaggggtygaggtttagagtyggtttttgttygtaggyggygaayggtattttgtttygttaggtttttgygggtgtgattygtgattygtagattttttygggygtttttggtttatgaygygggggttgttygttttaygtaggyggtttygggatgttttttygtttagattttagyggtagaaatagtttyggattttttttatttgggggaaagattgagtygggggttyggaattattggaagaagygagaatggaaagggaggttttggagygggggtttyggttttttttagtttgyggaygttttagttttattgagtttygttttagttttttygtttttttttttagggttttgtatttttttttttgygttattygtttttttygagtaygg

SEQ ID NO: 6910 - DNA, 3120 bp, synthetic construct
  misc_feature 1..3120: note = Description of Artificial Sequence: Synthetic polynucleotide
  source 1..3120: mol_type = other DNA
yggayggatyggyggaygttgygggttyggtygggttgataggaattatttgygttgttttaggtygtttttyggtttattgtttttttgaattyggtyggttttygygggtygtttgatgtttgtagggttatagattttygtatataaattatygtygyggggttgggggtggggyggaggygttgaaatttaattygtagagtttgtttygtygtygtttttttgttttttttttygttygttygaygttttttatttatttttttttaaataaggtttattttttttgttaaaaaaataaagttggtattaagtgtttygagggagaaagttttttttttatttttgatttggaaggaagggtyggttgtygattgagtygggattgtagagggggttttaggagaggaygggygggaggtgagtttagggtttttggttttatyggttttttttttygttttygtttgttygttttatatttaatggtagygaattttatggttttyggttatgttttgtttttttattygttttgttyggaaagggttttttttatyggagttttyggtttttatgttgttagagatggaagtattattttttgttttttttttttttttataaaatagtttttgtttgtygtttttaygaggtgatattttgtttttagttygattttttttgygttyggagtttgggttyggygygtaggagattgygtgtattttggygttttygatttttgttagggygtayggggattttagagyggattttttaygagttttaataggaggttagggagtygggatattagagataaattttttygaagttttttttyggttttattgattggagtttttgggttgaaattttaygagttttttatttttatgtttatgaggggagtaaaayggagttttygggggtaygtaggtttygtttttgggtgttggttttgtttttggtttttttagtyggtgtagtgattyggaatagygyggtygttttttygaygttygyggttttttattgygtygaggygagygttayggttaaagtttaagtttyggygttygttgygtttgtyggagttttgtttgttygagtaggtagyggggtttaggtayggyggygaygtygaagggttagtyggtagatagggttgggtttttgyggttagagygtygtaggaaagttttgtaaayggtgggaygagggtggyggyggyggyggyggaggtggygagaaaggygttaygggtttggyggagaagagggttttygtgggggtggaataaaggaatttattttyggaagaaaggggtygagtatgtagtygggaatggttaattttggagatttgtaggagtgygagygttgygatattagttttagggatttaaygaaatttgtttygtygagggttttagtttggtatttttattyggttttttttttttggttaatttygttttaatgggggtggtgggtgtgtattyggagtgttattttttttgggaagaggggatagagtaggattygtgttttyggttagaggaggtaaatatattttattaattttttttttatttattttttagtygtggggttattgtttttattttttagaygttgttaattaaggtattygtaaaattattttttttttygtttttayggtaaygtttyggtttttgaggtttaagygygttyggaaaygaaaagygttagggggttatagggtyggagtttttttttttygtygttttyggaaggggtggaggggatayggttgtaaggtgttyggttttttttttgtgtttgatatgaataaggggattaggatggtaagttttygtygtttatttygtgggataaagggtttygyggtttgagyggtatagtttttgattaaaygatagagttttgttatttagtattattttaggtatttgtgttygtgatataattttattagaagataaaatyggygaaattttttttataatgaaaagttatatttaatggtyggattttttttttattttttttttyggagtttgttygttttttttygttgttgttggatatggttygtttataattggtatttaaagtattaagttygggagaaaaayggggtttagggtttttgtaatttttttaaattgtttttgttygaaatttttatagatataagtttgttaagagtaaatatttgtggattgatataattatattttttttttgtaaattaaatttaaaaaaaaaaaaataagataaaaaaaaatttgttattygtygttttygggttggggygtaggagggagggggttggggtyggttttagtattygygtygggaattyggttttygggtygtttggttgtttttaggagttgagggatttygtaygttttttaggygggaaaagggttttagattttttttygtaatttttaattttttgtttttttaataaataaatttttygaatttgttgtttttggttagttygagggggtyggtaggagggtttggggaggggygagggttgtgtttaataaggaatgaaaatgttagtttttttygttagttttattttttttagygggagtttgtagtggttttaaggagaattattggttttttttggatygygtaaggttttatttggyggggtatttygattttagtttaagagagttttygagttattaagggttttygaaaygttgagaagttygaaagttgttgtagggttttggatttygggttttagtttagygygttttaggatygaatttttttataaattagttgttgggtgaaagggttgygttttagaaagggtaggatygtgtgygygtattagagygygyggtttttaaattygggttaaatttttggtgatatygaaatttattaatygtygttggtgttygyggttyggttgyggagtttaggagtttatgtatggtgttattttatttttagtaaagaatatgttgtaygaatygtygagaggtgggtttggaggggtgygygggtggaggtygttgaaagtygttttattygygtgttyggaygtygaaggaagttttttygt

SEQ ID NO: 6911 - DNA, 3120 bp, synthetic construct; identical to SEQ ID NO: 6910
  misc_feature 1..3120: note = Description of Artificial Sequence: Synthetic polynucleotide
  source 1..3120: mol_type = other DNA

SEQ ID NO: 6912 - DNA, 7861 bp, synthetic construct
  misc_feature 1..7861: note = Description of Artificial Sequence: Synthetic polynucleotide
  source 1..7861: mol_type = other DNA
yggattttyggtaygggttgggaggagtttagaggyggggtgagttttaggttygggyggtttagagtttyggtttagggggygtttaggttaggagtgttygtygtttttagttygggtggaagyggygayggtyggaygttygagttttattygygattagygtttttygtyggtttttgygtttttttgttttagttygygygtattttttatatgaggttgttgtttttgtagatgtttaygtgtttyggggygattaygyggtyggtgaaggggtttatttyggttttygttttgatttaygttttggagaagatgtygaggttttygttagggatggagttttgagygatgattattttygtaggtagtattaggttggatagtttttgtatttttgyggyggyggggttaggaaaatyggttagagttygaggtagtygaggttyggttttttttttttygtygggatttyggtttyggttttgtttagattagttaaatttaagtyggttttaaatttagagaagttattygggtgtggaggaagtyggatgtgyggaggtttaaygattttttttttgtttgtaatttggagatttttygtgttttggaaagygagtggtgygttggggattatttttagaagtgggtttttagttttttygygaatttttaaagtattygtaattttttttattttttgtttyggataagtttaagaattaatgagttaayggtagygagyggttttatgtatagggaaattgaggttaggttttgtaaggaggtgaaggttaatyggagattttttygtttagtyggttttygggagtttattgtgtgtttaggttttgggtattggtagaggagtygggtygtgattagygttggggatagatttygggttggtaggtgttggaggtgttaaagaagtatyggtagtagttggttaggttttgygttygttgtgtgatttygggygygttygagtttttttttgtttttaggttttggggtgttagggagggyggygttygggtttagataaatttygatgttatttttttgggyggggaggagtygyggyggtttttagtttttygagggtttttttgtygggtatttgyggtagggttggaagyggygaggygtataagggyggtttttatgttttataaggtttttttttaagttatttgggaaaatattyggygagygggtyggttgaaaggggggggttaaayggtgtttattgyggygyggygggtaatttgttaygttgttaaagtgatygtatttattyggttttattygaaagaaattgttaattttaaatttattagttttggaagaatgttgtagtagtaaattgtagtttaatgyggaggggatttgtttaaaaggggtygaggaattttttttataaaaaagggggattagatggttgatatagygtgaatggaagtggaattagtttttayggtaaattaagagaggaatagaaatygtaaagggggaaaagagggygaygygtagagatgttagagttagggaaagatattgtttgygggttgatgaatgaggaataagaatttgagatattttaaagaaaagaaatttttttygttttttttttttttttttygtttttttygyggtttttttttttygttygttttttttttattttttttttagtttyggttgttttttaaagtttttggtttaagtgggaattttygtgggttaagtttaagttaattaaatgaatttaaaattttttttttttgagttaattgttattataygtttagtaaggttgtaaatgtygggaattygttagtttaagygtaggaggggaagggaggggtyggygggggygtyggggtygagygayggggtygtyggggtyggtttttgagtygggtgggttgyggagttgtttggtggttygygttttggtttggtttatggggaaattgaggtgtatygagygtygggagagtttaggttggygygagtagtagygaggtygggtattttagtygygtttygygtatygttaggaygggaatgggggtygtygggaggagggattgygtygggtttygayggttggatttatygtyggagaaggattgygttagtatttyggyggtgaaggttgttttggggttggygtggtggtttttgttttygaagagttgtttttygagtaygttgygttagyggtygtataggaagttgtgtaggatgtyggaggtgataatttyggttagygttagtttyggygtttttagttyggttttgagtattagggttttagtygggagtayggagtttattatgggyggttyggagtttttyggygtygggggayggtygggtygaygggggaggtgggygggygagaggggagtttaaggggygagaggagagygttgygatggagaaggaattagagtagggggaggayggagaggaggaggaygtaggagggagygggaggtgagggggygattgggaggaaagygaaygagggggagaggggaagagagatggtgaaatttgtagagatggtaaaggyggygyggagggtggagagaygygggtggaggyggaggygggtgyggggggtgtagggtgggtgagaggygggtggttgtagggaagyggtagtaaggggtttaggygygygttagtttttygtatattyggtyggggtygttttttttttggtaaaattttagygtttttataggagtygtagtgatttttttaattggttattaatgattttttgaygtyggaggatagatttgttgtattyggttgggttygaggagttttygtygygagagygygaggggygggggygygyggatygttttaaatagtatttttttattttttttttttttttttggttttttttttttttttttgttttttttttttttttygtgggaagygtagggtagggagggaggtttagtyggttttgaggagaggaggggayggagaaggggagggggtgyggygaggttttttaggattttagggattaggttagataagaggggaygtttggtttygggtttygygttttttttaggtttgatttatgtttatyggtttggtttagttyggygtttatttttattttgttgtttyggttggtyggtttagttttgtatygtttttttttttyggttagagttygygttttttttttttttyggttttgtatttttygggtygttatagtygtttygagttygygygtagttttagttgttaygyggattttttgtttagattgygttgttgaagtyggygtttygttttataygggtygygttaattyggtygttgtgtayggtygggtgygaaattttttygygggtttayggggttgtygaggyggggtygtagyggtygtyggggttggggttggtttyggtttgagatagttttatggaaggttaggttttyggtttttgyggggttaggtygggggtygagatgggyggataggaatygttttggtagtttgtttttgggaaaagaattttttaygggatatagggggattgaaaggggtttygagattttttttaggtgggagtaggygtgtttgagagygaagttttttagaaattgtaggtagtttygygagaggttttagtgygggttyggtttgyggttyggtttttyggttttttgttgagttgtaatttygggaagtyggtggygttgyggygtttttttttttttgttttttagtttttttttttttttttgtttttttttttttttttttttttttttttattttttttgtttattattttaggagtagatttgttttgyggyggtttygaggtatttyggagtttagygattttttttttygaagtaggtagttgttgagtttagyggaaggtttygttttttgtaggtttygyggttttttagtgttagttttaagtttyggattttaggttttgatatgttgggtgagggagtttattttatttgtygtatttttggtttttattattagtttataattttagatgtygttaatagaggtgtttggattttttyggygtgggttaggtttayggattagttttygttggattgtgtggattttttagattttttttttagygyggaggatttgggtggaagaatagygagttgattttttatgagygagattttgtttaaaygtttgttggtatagaygtttttttattattyggaygygttttggttaagagggttttatatttggygtttagattttagatttttggtttttagtttttgttagtagttttyggtatttttygttttygttgggaygtaaagggaggaaggyggyggtagttggtttttagattttgygttygggttygttygaggttggagtttaaggaagggtatatttggtagaaggtaggatygttgggtagggygttagtagagggtagygttgttgaggagggaggtgggttagggtygtygaattttttatttatttttygaygtagtttgtgggtygtatyggttttttggttagagttygagtttgagggggygtatggagttygatggtttttgtaggggagttttatyggggtttattttttggtttttgggaagatttaggtggagaggataaagtgttaggagygagggagaygaygtyggggagygttgttaggagttaagygttgyggtagtttttaagtttygaaagygattttagtttttttaggatattaaagggggataaggattgttgtgtgttttgtggattgttttttttttttttgggtttyggtgtttttgtttgtgtaatggtttgagttggattttgtgaattgaggtttttttgtttggtttttttttgggtaagattattttattttaygataatttygaggattttgttttttttagggttaygttttattgygggaagtttttaggtttgtgtatttttygtgttggggtgtagygtttgggttttgaatttyggtttagagttagaggtttggatttygttggygtagtgattaygggttyggattgyggttagggagttttatttttttttttyggattygtaagttyggagagtagtattgggagtygggtagaagyggagygtagaaygtttttttagttggtgygtttaaatttttatygygtttatattttgtgtttttagtttagyggtaaaatttatttggattttygttyggggaaaaaggagttygtaggtagygtttagttttaaggtgtattgaaatagggagtaagattttgtgtttatattttttygggaggagatttygaggggaaatatttygggtttttttagyggatgattygtgttattttgttatttttygyggggtttaggygyggaatgtgttygygtaaaagtttttttttttyggtygggtyggagtttttaggtttygtygtttttttygttygttggtygttatttggygatttttttaatatttatgggygttaatagagaggtttttagtatatyggtttattgtgggyggttygtaggatttgaataggtttyggtttttttttttyggygyggtttttygaggggtygggttaggagtgaatggtttygtttttygtttygygtttttttttttttttagggagaatatttttattttttttttygttgtygtygtygttygggtttttatttaygyggtttyggtttygggyggaaygaattaatttgtygyggtttttyggaggttattttygtygttygggtgttttttttttttgagtttaygggagtggagagagggtygtygyggtaggtygayggttttayggagggatattgaaggggaagtggaggagaagagtaggggygattyggaggggtggttgggtyggggygggtaagatagttttagggttyggtagtygttyggggttggttaatttttagttgttgtttygtttagggyggagygtygaggggaaggaggtygyggtttaagttyggaggttygttygttttttttttgaggtattagygygygttttttyggttyggttgaggtatttatgagaaygggggygtgtgggatagtttagggtttygtaygaygttttygttttygtyggtgygtyggggtttagtttygggagagttaggtttygatagtgygttttagggggaygttyggaagggyggtyggtttygyggtttttgygttttygttttggggttygggtttgggtgygggggaggggggtgygagtyggttaggyggggttaaagygtaygggttttygttttgttygtttygtyggtttttagaggygtagaaagaagtttattgttygtygagaaatatatttttgggggtygagtgaaagttygttttttttttgaattttagaagaaagttttttgttttygtttttyggagggagagatttgttttttttttygggagtttygygygtttttttttttygaaatatttgtygggggaaaatttattttggagggtagatygygttygttttaagtttggygaatttattaaaaagatattagyggygggggtaggtttygygtaggtatygatyggtyggaatgagttygaggaagaaaaggygaagaatgygttygygtygygtttagaygtttattygtttygtttagtttttgygttttagtttygtatagggagaggggttttygygtygtttygtattgtttgtgagtttygyggttygyggtttagtygtttttattygggtttttyggtatagtttttyggtaatttttttttgtyggtgttgygtttygttttggttttttttgygygtaggttttyggtygtttttttttttygttygttgtygtygygygtttagtattygygttttttttttttttttttttttttttttttttttttttagygtttttttttttygttggygtttygattttttttttagtttygtatatttttttygtttttttttygtaygtttttttttggttttttgagttttaatttttygtagtggtttaggaaatttttttttygygtggggttygygtygtttttttttttttattttygtttttygtaagayggtttagggttttagggygttttygtyggygygtataaaggygyggttggttgttaaggygggtgggggygaggtygaaaaaaayggttttaatagaygtgattyggggttaggtttgygyggggttgtyggyggagtggyggtttyggtttagtgaatggggatagyggtttttttttttattttatttttgtttttttttaatgtaattagtttttaaggttygggagagataaaggygygtttyggggygtttaygtggagtgygtaggygygaagtyggygtttygatyggtaggtgattggtaygygagtttttttaggygtttaggggyggaggaggggaagttttttttttgygtttttygaatttttttttatygtttatatttyggtttttaggttagygatgttagygttatagtttaggttgattaaggyggygggaaygaygggagagaygtyggggatattaggagatygggyggtgggagagatagaggygtaggtttttggaagtagagggggygagataggggtygggggagattgaggtaaggygatgtygaggtggagggagtagatgaaaggtygagtyggagaygtaggggtataaagattyggagatgaaggaagtagagggggagaggtayggttttygaaagagygg

SEQ ID NO: 6913 - DNA, 1434 bp, synthetic construct
  misc_feature 1..1434: note = Description of Artificial Sequence: Synthetic polynucleotide
  source 1..1434: mol_type = other DNA
yggtttygyggygaggggtttagaygaaggaaaygtygttttaggggygygygggyggagatggagtggtttaggttgggggagyggggagtagggtygttatygttgygtyggttygygaygtttgtttttgttygttttgtttttygtygtttttttgggygattygggtttygygyggygttygtttagttyggggtttyggattgaggagggggaggaggaggaggaggaggagtygygttaaggyggtyggygggygtatttaygtyggtgttgyggtttagygtttygtygtyggtygtygagagtttggtggtgttgaggtttattagygagggtagygtttgggatatttagttagtgattatggttatggtgtttagtaygatttygattttgagtagyggtatygatatygygtttygagttgtttttagygttygtttygagttggtatyggttttygygtttaggyggtttttaggyggygggtatygyggygggtaggggygtttggttgtgttttygygttttttyggttygtygtygttygttygtygtygtygtygtttygygygtttyggttatygtygtgtttttttygggygttagggaaggtggttaggtggtttttgttygtygygttttgygtttygygtygttygttttgygttttgttttgttyggttgygttttttygggttttttygtygttatygggaagygtygttyggttttgagygttgygygggttgygygygggggtygyggtygggaggyggggttyggtygggygggatygaygtaattygtttaggaaatgggtggattttttttttygttyggtttttygtygttttttggttgttggtagygaggtttgtaaattttagttygtttaggagttgggattagggtgatatgaggagayggatatattattatttttagattataaaatattyggyggyggygyggggattttagttgggggtayggttygyggttttttygtttyggggttttttttatttttaygtyggggtattttttttygattttygtagagggttygttttggggtaaaggttgtyggtagagagayggygtygttttgtttattggagttttttttygyggtgattygagggttttagttagtttgggtygtygtttgaaatttagtaggtagggtaggtttygaaaagtagttagattygygagggtttttagygttaggggggygtyggggtatyggtggagagttaaaggygtttttgygattttagggtagtygyggtgttttaaggttttgtttgggaggaagggagttaatyggtatttttgatatttgtatagtaaggygggggttggggtggtttgtygtggttygyggtgygtagtgagggttttgggagggygtatattygg

SEQ ID NO: 6914 - DNA, 5053 bp, synthetic construct
  misc_feature 1..5053: note = Description of Artificial Sequence: Synthetic polynucleotide
  source 1..5053: mol_type = other DNA
yggttyggtattttgyggtttyggtaygtagttttyggygttatatttattttttttgygtttygggttgagttttygtygattatttgttgttttygaggttaaattttagyggygggaggattttgttgttttttygatttttttttygggaattttagtttttttggygtgtgttttagtttaggtttttgtttttgggtygtttyggygtaggaagttgyggggtygggaygaaygttggygggaagttttgatttgggtttttttttatyggtgttygttttygggtygggtaygyggggyggtttttgggtatygtaggtttyggygtaaaggygtttagagttygtagtggttygggttggttttygygattttyggtttygtttygtttygyggtttygtttttyggtygtttygtttttygttyggttagaggtttygggttttagggyggttygygggygtagygtttagtagtattyggagtygtttggaygtyggttyggggttattgyggggtggygtygttgggttygggaaagttygggattggagagtggygaygtygggyggygggatttatggaggygygyggggagttgggttyggttygggagtyggygggaggygatttgttgttagtattgttggygyggagggyggatttgygtygaggtgggtgttygggtygagtggttgtatyggggagattaggagatttttaggttttttygggtttggtygyggaggttggtaggagttagaggatttgggygggagtgggygygaggatttyggaaygttygygtttgggygttttagtttgtatttgttgtagggtttttggtttgggttgttagggagtgagtgaggttgtggtattgygttgtttyggttagggagttttygggggtttagggtgggtttaggagatttttgtagttyggagttagttttttgggttggaggaggygtagggagtagtggyggggtagtgattaygggataggagggtttttaagaaggtygttttagtyggattttttttaygttttagyggaatagagttagatgtaggggttaaggtygagttgaatttygatygtyggttttttygaagttaggttttagygtttgygtttatagatattygttyggtttattttygtttagggttygtttgtaggaaaaagttttttttttttaggttttttagttttttggtggtattattttagtttttagtattttggtttttagggaatttgggtagtttttttygattttygggttagttggagtygtaggatggggaaggaggtttyggagttagtggggagtgagagggatyggtyggygggaagggggttatatttaggttgtgggggttygyggttttttatttatttatttatttttygayggtttttgggaggggttggtygygggggttggggggyggagagagggagggaggaaggaggattgygygttygygttygggagagttggtyggagygggygggttggygtttaggtttygtygatttygttatttttgatataggagttttygttagggttggagtygttatgtagygtaaggttggggtygygggygyggygyggggtgggttggggyggtttttgttygaygygggygtyggyggygagttgyggtygaggygttgttyggttygyggtgttgaattygygttgtgtyggtttgtygggtygtttygtttygagtygggttttygtttgygatygttgtttaygatggggatttygggygygtagygggttttygaygtttygtattyggagttgyggttttgtyggatgyggggygtatttatygtyggtttttygttattgygtggggaggygtagtttagtttttttygtyggaggtygagggagtttttttttggtgttttttatttattgggagatgggttggagtyggyggggtttatagttagggaggygggtgtaatatgttagtaaatttyggtttttttagygggtattttttttttttagagattttttttaagtgaagagggagtttttagtttttgatatttggaaaattygtttatagattygaggtttttatagggtatttttggatttttttagtgtggtttttttagggggtttgtagtatygaagtggggtgtggggggtagaagtagygggaagttagaygtttgagtaattttgayggtgttgggggtatttaygtttgatataaaggtagtggatyggtttgtttagtttatttataagtaattttgyggttgtttaatgatggggaaggtattgatatttatttyggaggtttgtagatagggttattaggtagggtagttatatttgygaggagtttttagaaagagtggttatgaygtttaatatgaaggagattygatggggtgttttagttttaggtgatggtgaagattygtttttttatgttttttgtygggttttagagagtagatttttttggggtggggtttttatttgagttttatatgtattttttttggtattggtaatattttgtaattgagtatttagtttygtgaaatggtttgggttgtttttttgtttatatatatttttagatygatgttagtttttttttagtttttgatataggatgyggtgtttgtatattttyggaatttgyggggttatttaagttggttggggaagagggtgtgtagggaaaggaggatttttyggtagttttgagttttgtgggtyggaggggagattggttygygttggggtgggaaggtggttttattgttttttggtttaygaggtgatttagaattttttygtgtttatagagatttygttgtgygttggttgtgattagtatattttggatygttttatttttaaggttttggatygttattggtatagtaagtgttttaagtgtagygattgttataygttattggtygagygttgttttagtygaggggagagygtttattgtaaggaygatttttttaagtgagtttygaaattttattttagtgtgggagyggagggtaygtttgttttagggatttttttttttataattattaaggttaggttttygaagtttgygtttttygtaattttagtttatttttgttatttaggtagggtattttgtggtttggttaaattaagggtggggtttttttatgggtgttttttgggtggttgggtttggttgggatattagtaagtattatttggaaaaaaaagtaatttattatttaaattatagaagtagttattagagaagatatatttttatttgtaggattttattggatttagttttttygaaattggtgatgttttagtttttaatgttggtatttagyggttttggtttagtggtttttatggttttagttgtggggtgtgagggattggttttagatgggtttttttttttyggatttatttttttagatttagtatgggttttgtaggtaatggyggttgggtttttygaggtttttttgagattgaggttttttttttagtgggagtgggtagttttgtttyggyggttaggttggygattattttgtagggtyggatagagttttttttyggggtygtttttttaggtagtygtttgtttttttttaattygttyggggygaaatgagtttygygttttygygttgagttyggttttgtgygtttygtaggygtttygggattaagtgygtygygtgttagttgggtatttygtttaygtaggtggtgygtygygtttaggatttygtgtattatttgtattgttttgtttgygtygtgtgtaagyggtagttggttaygggygaygagttttattttatggaggatagtyggttygtgtgtaaggyggattaygaaatygttaagtagygaggttagtygaggggaygaygtttttattttttttggtttgaaaaaaatggggttgaggttaygtttaggggggygttyggggaaattttttttttaagygtttattaagggggtttgggttagggyggtgtaggtagtaggaagtygaggtygggaayggyggagttayggatagattygygtttygaatygtttygttyggttygaagtgtgyggtttttygtttttggtyggaattatygttttaaatttttggtygygaaggttgggttatatttatatttttagaataaaggggagttygyggggaaattagggtgtttggagaagggagttaaggttgaaggygggggygtygtggaggtgygattttagggaaggygtygttttygttttygyggtagaattygtttttygtyggygttttttttattttagttygggtgttgttygtttttgttaatygtttttagygttygygtttttygagaagtttgtggggygggatgggggtgggtatttgaggtttygaygttttygygtyggtyggggtgggagggttgggggttyggtyggggtyggaggggttgtygygttttatygttygttygtygygtagaggtygaggttayggttaagyggtygygtaygattattatygttaagtagttggagaygttgaagagygtttataatatttygtttaagtyggygygttaygtgygygagtagttttygttygagaygggtttggatatgygygtggtgtaggttagygttygtttttgtttttttttygttygyggttttgggggttttygtagagtygggyggtygtttatttygtttygtttttaggtttggttttagaatygtygggttaaggagaagaggttgaagaaggaygtyggtyggtagygttgggggtagtattttygtaatatgaagygttttygyggyggttttaagtyggataaggatagygtttaggaggggtaggatagygaygttgaggttttttttttyggtaggyggagggatygyggagttyggggggggaygagygygygtyggyggggtygtaggggttttagggagttygygg

SEQ ID NO: 6915 - DNA, 6343 bp, synthetic construct
  misc_feature 1..6343: note = Description of Artificial Sequence: Synthetic polynucleotide
  source 1..6343: mol_type = other DNA
yggtagggygggayggggttgyggtttattatggaatagtygtataygtgaatttttttgttttgattttggtgggagatgygttygtygtttagatatttatagtygtagttttgtttttgtatgtygttygatattttgtygtagatgttygttgggatgggagggyggttttaggaygtgttttggtygtttttggaggtygygggaggaatttttagtygaaggggtttgaaattttagttttgaatagttttttttttaggagagaygaagttttttgaggttgggatagggatgaatgagygaaggagggtggaatyggggagggygygggaattgggagattgttggggagggtgttaggtygtgttaygtttttttygtttaggattttagtttgggttaaatttagtaggggtaggattyggagtagagygtagttygttayggttygtagtttygttttygtttygttagtttygtttttgtttygttagtttygttttygtttygttagtttygttttygtttygttaggygtgtttttggtatgttygtaggtttygtttttattatggtatttagtttatttgtagtygygtaygatttttttgttttttgtagtyggagtttyggagyggggagtygagtggattyggattagtatatatttgaagaygtygtyggagtygatgtttatattaggaatgagagygaggttygttatygttatgttttttttttyggagttttttttttttattygattygggggtygtttgtattgygggaggygggttttgygagagygaygattaatttygtyggggaatgttttttaaggtttagygttttagttaattgtatygtygatygaggtaygtgttgattaatygtaatttagttttttgtygttttgyggtttygttagtttygtttaaaggaaaygtggaatygggaatgggtggtgatgaaatttagttaayggagaagtttttttttagyggggttyggtggtatttttggaayggggtagttaggyggttygygaggttggggtaaygagggaggtttgagggatttgttagttttgattttttgtttygtaygtagttygaagattatttttttygtggtttttatygtttaaaggttttttttttttttttttttatygttygaaggtttttttttttttygttttttatygttygaaggtttygttttttattttttttatygttygaaggattttttttttttttygtttatygttygaaggttttttttttttttttttttatygatygaaggttttygtttttaatttygttatyggtataaggaggtaayggtagtygttatatttaagttttattttatttggttygaaagtttttgttttttggaaattatttyggtttaggggygttttyggtyggtttttaggggtggggtygaatgtagaggttttggggtagggggygyggggygyggyggygggtgggtaagygggaygtttggtyggtgtagaygygyggggaygagatgggygtgtygggtgygaaagtaggagyggaggygggggtgtttaattttttttatttggtgtttttttttttggtttygaagtagggttggggattttaggagggtttttgygtttggtttttatttttttttygtatattttattttttagagagttttgggygyggattagggtgtatttgggggataggtggaggtygggtygtygggtttgygtttttaygttygtagtayggygtgyggttagagygggtgtgyggggatttttygggataggttaagttttttygggtgggtttttaygtttattaattagtttttttttttatttgttygtattaygttttgttttttaggtttttatttgggaaygtttygttttttggtttttttttttttagttaggtgttagttttggttaggtttaggtgttttgttttttttgtttaggttttttgttttttyggttgggagatttgtatatyggtttgaagatttttttgyggttttttttagtttttgtagggtttagattgtagyggttggaggygaagggayggtagggygygtggygtggttagtgtgttggtttygattagygggaaygtattgygtatygttygttttgtttatygtttyggygggaygygttygygtatayggaygtatagaggtygattagggtgttttttagygaggaggtaatatagtygygggaggyggggyggggygtgtttaaagtgatagattgggttttggttaygtygggtttttggaygaggggaaatyggagtyggggaggttttagygagagtttygyggatygayggggatyggatttttaygggtggggtttgtgtagtagtgattttttygagtgaaggtagagttyggyggtttttaggtttatttygttttttagyggggagtatygagggygaggatygattttttttggggattttygagggygagttgggagagggaggaggttyggaggagggagaggggttgttgggggtgggaaggygaagggtttgtgaggaatattayggggaygaagggtyggggggtgggggtttgggyggagttggaggtygaattgagyggagtttggaaggttggggaattagaggyggggtttagaagaagtyggggtggggttttggyggggttygggggyggttttgggtgggtygggyggggtttgagtgggtagggtagggttygggttagygtttgggttaggtttggtgggttyggygttttatatgatgtygtttagtaggttggygttggttatttagtygagygygygyggttyggaggyggttatgattatgtatatgaaggggyggtyggtgygtyggttygtggggtagatggtggtgggygtgaagygtttgttggtttygaygaattygtaaagttgttygtagaygygygggaattygtggygtaggaagaygtygygtagtygtagttygygttggatgtggatgaaggttatttygygygygygtyggttygtttygtygttttgatttaggttygtygtgttyggyggtggygttaggattagygtttttatgtygggttygyggtttygygtygggggyggtygygyggggttgtyggtygttagygttattttggygaatttgygtattgttggttygtggttgygtggygygggygygggtagggtyggtgttttyggtggygyggtgtygggttttayggttayggataygttgagtaggaagtattttgtyggttygtagaggygtttagyggtygttagttygygygygtagttgtttaggggygtygygtgtgtggttagtttaygtagygataggtaggtgggggatagtagtagtttttttaggttaaagygtaggaagttgtyggtygagtttggatttgggaagtttaggaagagtaygtygyggtygygygataggaagtygataygygygatgygygagaaagygyggtgtatygggtygttgtygyggtaaaattgtagtaygtggyggtataygttgtttaygyggtygtataygtagygygttttgtgggygttttagttttygyggyggtataggygygagtagtagtaggtgtagtagttgtggtaggatttgaagtagaggtaggygttgaatatggtttyggtgygtyggtagygygtattggagtaggttattaggtygttttygtyggygttgggttygggggaygygtyggtygtttttttyggggtygygggtttttyggygttgtyggtygaggyggggggygagygtggyggygttagygygggggtttyggagttygygggtygygagtttagtagtyggygtagttgggggtttaggtagtyggtygygggttttgaggtttggtyggyggtgggtygygagtygatgattaggttygtgatgagttygtttagttgttttaggtttygttggyggttagaggtggggtygtygggggtygygtggggaggtggtygygtgyggttttygggtaatttttaggttttggygttygggygttyggtggygygtaggttattgttagtgatggtgatttygggygttaygtattagttgyggtttaggttttygttygygyggttttttttygttagygaygtttyggatagggatagtgyggygtagygtttgggagaggtggataggtttaygaygaygggygggygtyggttttygggggataygtttygyggttttygtatttygygttttagtaggttttygtagttgyggtygyggtttaaygggttttttyggygyggtttyggggttagaatgttgttttaggagygygagtagtggyggttgtyggtggttagtyggggyggattggtgtyggtgtygtygtgttaggaggygagtaaygggtyggggttagagggyggtattatttgtagggtgyggtayggtygygggttttagttygtttaggtygggttgttgygygggtgygggtaygttygagttaggaygttaygttygyggtatttttygaagtttttygtgtaaaaggggygggyggtggagtgggttyggggtttttyggggatatagyggggttygtagggtaggtygtaggttygtggagtttttttatagtaggagygggagggyggtttttggattgggaaggtgygtattttttttgygtagtagtygtttatgygttttggattgggtttygagagtttttyggayggatagggtttggggtagtaggygtygaaggttgggtygggattggttgtaaagttgtttyggaagttttggggtttttttgtatagaagaattgggtggggttyggyggggtggtgaagggtagattgyggygttyggygtagtttyggggtttaggtaggggttygtygtagtagaaygttyggggattygtatagtatgagtygttgggygtyggggtgygygatagygttatgtggyggggttygggtatygtgaggtygtggaattgyggggyggggygggtttagtgygyggtttyggtgggttygtaggatygygagtttygggtggygtgttggagtattgygtygtttggtttgatgtttaggyggtagygtaygtggggggygggattygygggtggttygggyggtgygtagyggttygyggyggygtataggggygygaygyggtyggggtygtttygttgyggttgtaatttgatgggatgtagttygttggtaagggygyggagygtygggtaygygggttttyggygyggygatgtttyggttygygtygtaygttgggtttttygttttyggyggggtaatatyggyggygaggygggygygggygttaggttygggggygygyggggygtatttttggagygggygyggyggygtggttyggtttygygggttygggygygyggtatagyggatttyggyggyggtggtttyggtagggtttttatggtyggttygtttagygtttttaggaagtygaagttgyggtagtggygtttgttgaaaggygygggtttagtaggtygggttayggatygtttatatggygagtatttggaygygggtttyggggtygttattttgatgttttggtatayggtygatattagtaggttyggagggttygtaygggttattttaaaagaggtttttaggttggyggttttagtttatattgttttgyggggtttttgttttggggggagaygygggttagggyggtttttttygtagtttaggtttygttatttttttaygttggttyggtttatttggggygtagygggyggagtagttttggttgygggtttgggtygagaaygygggygttttttttatgtyggggttagaagtatttgygggaggaatttagttgtttaggygttygttttgttygttttttygttttttttttgygatggggygggygggttagaaaggtttagtygtggttgtggttttygyggygggagttttygygtgaagttttagggttttttttttttygattagtgayggyggggtyggttygggtggattttttttygggtggggtaggggagtgggggygtggttttggggttgygttttttggtgttygtagttggaaggaygggtygtatttgggttttatttataggtgttgttttaggagaygttagtgattgygttttygttatagygtttattgtagagygattttttygatygygtatagtggaaggyga

SEQ ID NO: 6916 - DNA, 1089 bp, synthetic construct
  misc_feature 1..1089: note = Description of Artificial Sequence: Synthetic polynucleotide
  source 1..1089: mol_type = other DNA
ygttgaggggtygtatttattygygtaggtattagtaggtagttttggygttygygggaggyggtygggggygggggtttttyggtgtttatygtygtttttgyggttgggttygygtttygggtyggtygagtttaaygttaggatttygttygagttttttagggtttygttaggygtygygttygygttygygtttttttgtyggtttyggttygggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggttggaggaggggagygygygtttttattygggttgggtygtygaggttygyggygtatygtggyggyggtgggyggaggggggyggggggtatttttttttttttgtggygtaggtgggygygttttggatyggtttgaygattttttttygtygttttatttttttggttaaaggtttttagtttttaattagggatatttttagtttatagtttygaagttatgggtttttttyggttttttgaagtygttatatttgtgttagtyggtygygtttttagattttttttygyggagtttttttagtatttggagaygtagygtagggtttygaggayggtttggttyggagaaaagatatygaagttttaattttttttaatttygttttttttttttttttatttttttttttygtttttaaagttygggggttttatttttttttyggttygyggagtttttygaattttgyggggattyggygttyggyggtgtttttttggggygtayggggttggggygggagygaggagattaggtggggaggggattttagattttagaygttaggggagayggygtttttygt

SEQ ID NO: 6917 - DNA, 1020 bp, synthetic construct
  misc_feature 1..1020: note = Description of Artificial Sequence: Synthetic polynucleotide
  source 1..1020: mol_type = other DNA
ygtagagatygtagagattaaggaggygttygyggttgtagagttgtagagygggattttttygagttgtttgtgttygggtagtyggygygtaattgagttagaggatagygtattttttyggygygggtyggtagggtttttgyggtyggtaagttggtttttygggtggttatygggattttygagtttaatggygggggyggyggtaaaatygataatattgtagagattatttttatttttaayggagtaagtgttygagttttaggtggygaygttatttttttttagtattttygttttygyggagygtttggtattttttttttgygtatttttygtttttgattgtttttttagtttttttttttatttgttttttgtttttgttttgyggtttttttygttttattttttttttgttattttttgttttttaatagtaggtygggattttyggagatgyggtgtttayggagtagttgtagggtgagygggagygygagygggagggggagggagaygygggyggygayggattgggtagtagtttgtygttggtygtgtttttaggtttttttagttttgaggygttgttygtttaggtgggggygttgggyggyggttagtagttgtagttyggtttttgttgtttgtyggtgtttttygtggttttgggtatggtttyggattttatttttaygttggygttttygttgtattgttattayggggtttttttttttaatgtttttggttgggagtagttttttaatgttagyggygttagygtygttagygttgttttagtagttagygtygttagtygtgtygttattagtatygatttttygtgtagyggtttygtttygtyggattttaattattgttttaaggattgggattataatggtttttttgtgtttattattaaygttatyggttaggtgaggyggttaggygggtygygggtttgggggygggtagagagyggygagggyggggttttaygttygt

SEQ ID NO: 6918 - DNA, 6343 bp, synthetic construct; identical to SEQ ID NO: 6915
  misc_feature 1..6343: note = Description of Artificial Sequence: Synthetic polynucleotide
  source 1..6343: mol_type = other DNA

SEQ ID NO: 6919 - DNA, 1109 bp, synthetic construct
  misc_feature 1..1109: note = Description of Artificial Sequence: Synthetic polynucleotide
  source 1..1109: mol_type = other DNA
ygatatagggtggygtgtagggagygtgttttggtattaggygggygygagggggtagggygtaygttygggataygttttagggaaatygtttttgggtttggtagttgaatttagaygtygagtgtagttygttyggtgygygyggygttttattgttagatttyggaaattagttgttagggtggggtygygttttggygayggttattyggttatttttgtygttttygttttttttaagagatttttttagygggttaattttttgttygggtaaattttttggtgagtttttygttttttttttttygttttttttttttttatttttgttgtttyggttttttagttygttygygtygygttttatygttttygtaygttygggygtaygtttttttygttygggtygttttttggtttttygygttyggtagttagtgttttatygygtygtttygygttagggttygtttygagagtygtttttttttygtygyggtyggygygggtttttyggttatgygttttygagttttagtttgygtygtygyggygttygggttttgtagttttttgttgttgttygygttygggtaygygtgtttygygggttgygtttgtatygattygtatatygtggattgtygygatygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtaygtttagyggttyggttaagttygtgtttttygattttagttataataatttgatttagttgggygtyggygtttttygttyggtygggaggttggtgaagtttagtttggttaataataatttggtgggygtgtaygaggaygttttygagattttggagtygttgtaggtgttggagtttaaygataataatttgygtagttttagygtggtygttttggtygygttgttygygttgygttttttgygtttggaygggaatttttggttgtgygattgtgatttygt

SEQ ID NO: 6920 - DNA, 1109 bp, synthetic construct; identical to SEQ ID NO: 6919
  misc_feature 1..1109: note = Description of Artificial Sequence: Synthetic polynucleotide
  source 1..1109: mol_type = other DNA

SEQ ID NO: 6921 - DNA, 1384 bp, synthetic construct
  misc_feature 1..1384: note = Description of Artificial Sequence: Synthetic polynucleotide
  source 1..1384: mol_type = other DNA
yggaagggattygtyggttgygtttygtttaggttggtyggggtyggtgtgatygtgtgatttygtgtatattgygttygggttttygtgaatgatagtagtttgtaatttttagtyggagagtagyggtggttatygtygggyggaaagggttataagttagaatgtaaagygatttygtttygggtgtgggggatttygggttttyggttattttygaggtygggygtgttttgttygttttttttygttttgggygtyggggygattttattttgygttttaagttgggggttttttatgttygtygtygtygagtttttygtygtygaggygttggtygyggttttygggttygggtyggggtygtygtygtygtttagtttygttagttttyggttggtggtygtgagttyggttygtaggttggttattttttggttggtygattggatygttttatygatgyggagygygagttgtttattgttttttattatgtttaggattttggtttgggggygagagaggtgataaagagttgtatgatgygyggggggygygyggtygggtattttyggttttatttgttgtgtttttygyggttyggtttygttygygtttygatttttaggtatyggtagygtyggttttttyggtataggaatgatagyggygtttttagttttagtygyggyggtggygaggyggyggggggaggaggyggaggagaaaaaagaggaggagaaggaggaggaggagtagygatygtygagatttyggygggygggygtygagagttgttttaagaaggatatygygygttattaggtattttttaaatggagtttattattygtygtyggttygggagggggtttyggtyggaggttgggggtatttttggtttttygygttttygtatttyggagatatatttttygggggggyggaggyggyggayggtagtygggagggggttaaggtggygtttttggygaggggtaggggtygtttggatygaggtyggttttttgtttttttttttgagyggtggggtagttttygttttggagaattggtgtttygagtygtgttaaggttggggaggtgttgggtgttyggaagagagggtgtttggaaagggggttttagaggggagtyggggtggatttttatggaagggagaygtttgygttagtttaggagtggagttygtgttttatyggttttttaaattgygagtaygaaatttttagaggggagttgagttggtgtttygygtgttttttattttttattttttattygtaggttagatttgygttgtttattttaggagggagygtttatttttttyggygtgggtygttggtgttttygt

SEQ ID NO: 6922 - DNA, 1384 bp, synthetic construct; identical to SEQ ID NO: 6921
  misc_feature 1..1384: note = Description of Artificial Sequence: Synthetic polynucleotide
  source 1..1384: mol_type = other DNA

SEQ ID NO: 6923 - DNA, 835 bp, synthetic construct
  misc_feature 1..835: note = Description of Artificial Sequence: Synthetic polynucleotide
  source 1..835: mol_type = other DNA
ygtgaagtyggygttatttagtttttttygttaattgtttatttttttyggttattgtttttygagtgtttatygagtgttygtgggttagygagyggggtygttggaggaaggggygggtgtgtttagggttggyggygggttyggggtttttgggaggaaagggtygttygtttagttttttttyggagtttagagayggtttyggyggygygggtatataggggtatatagygyggggyggagggagggggtggyggtatygttygtggagggygygggttygtttagtttttygtatyggygttttttygygyggtgtttttttygtatatttataygtatttatttttatagttatatattttagtatttgtaggtataaaygtttgtagggatatattaygatatagatatttaagtatatataggtatyggtttatagattygtttttgagttatatataggtatyggtttaaaggtataggtaggtttatagattggtttttgagttatatatagtttagatttagatgtatatatatagatgggaaygttygtttgtaygtgtatagatatayggatatattygtatattatygyggggtttygagtatataygygtttyggtagaygtttatagatataygtagggtygggagygtatatatatagatataggtttatatagatagattyggttttaaaaataygtattygtagaggtaaaggttagygtataagtaygtatagatatatygataggyggttttyggatatygygttttttgtygtatttayggtttaygtaagggtttatatayggttttaygg

SEQ ID NO: 6924 - DNA, 2248 bp, synthetic construct
  misc_feature 1..2248: note = Description of Artificial Sequence: Synthetic polynucleotide
  source 1..2248: mol_type = other DNA
yggttttygggttagtttttygttgttatygtygtttagttagygttygtygygtgggagtygygaggttaggtttygtagayggygggttttyggtttygttgttttyggygggygygttttttttagttggttyggtygttgggttgtygtygttttttagttygyggtgttagttttygygttttaygtttggttttygggtttygtgttttygtagtagaagggattggggtyggyggggygggtggggaygtttgggaagygaggagagttttygtttttygggygtttttttataatggggttagggttttttttttygtttttygygtaggtgtgagygygygagtgtgygtttyggtaagtgtgagtgtgaagtgtgtgtgtgygggggagtgygyggagggagygygggyggygggyggygygggaggygggaggtagggygtaggggagggggttgggagggagagtgtgygygygtgtaattttatttyggggttttgtgygagttygggygatagtatyggyggyggttggaggaggagyggtyggagaygygtgtagttygttygttagagttyggtagtyggggtaggtgggagttygygygggagtygagtygaygygagtyggagtyggagtygagttygagyggagttygggyggagtttaggagtttygttygygggtagttygtgggyggtagttaggyggggygggygtyggyggggyggttttttagtaagatgtgygyggygtygyggggygttttttatttgtagyggygttygggagtygggyggttgggttaggyggygttttyggggttgttgygygttygygtttagagttgtygttttagggagttygttayggtygygtttygggtaygttyggyggygtttaaygatgatygttttttggyggygttttyggagtttggtttgggaatattgggtygggtttttygtgtgygttttttggatttyggattygygygggatgttttaygttattyggatyggtaagygttttttggagtygggggttttygtgygttygggagggggygggaatgagggggttttttaaygygtttyggagagatttttttaattttttttygagttgttgagtygatyggtgattattaggagtttttttttgtgaggataaagttttagagtyggggttaygggttttatttattggggaggaggtygtygggtygtagtgggygaggggtttttggygygtttttgggaggttagatttggtatagtgtggygaaggtttttagtgygatttygagtygagggygtatttygyggtgattgttagtatgaatygtagtygatygagttttgygatygggttttttygtagagtggggattttggggaaggygttaattttttttttttgtttattttatttttygygggtttttygtttttatttttggtatagttygagtagtygtagygaggtygtagggtatagattygtatgaygagggtagtyggtttttttttttggtggtygtttttggtttyggtggtatyggtttagtttygtgttatggggygggggttgggggagtaggatttygttgttygttgtagttggtttttyggggttaaggtttttttttygtttggggtagtgtaggtagagggaagggaygatggaggtygtttagtgyggttygggtaggyggtttagggaygttagyggtttttaaagttagttygaattttttygtagttggyggyggttggyggggttgygygyggtttttyggggtttyggttttttygygttttttttygtyggagatttttatttyggtttttaattttgttgtggtygtttaaggtattttgtaggtttgagygtygygtatgtttygggtygaygatyggtagggttgggtttggtygggttaagayggagtttttattatygtaggttttgygttygttattaggtyggatatttgggtygtttgggtttattyggygttagtattagygtttggtattaggygagtyggatttygtygagttagggttattttttttttttatagtttttttttagggyggattttgggttgttagyggygtgaaagaggtgtyggaatyggtgtygggtttggttttygtatttgagatttttttaggaggyggttagaaatttagygggtgggtttttttttgggyggtygttygggagtygg

SEQ ID NO: 6925 - DNA, 3541 bp, synthetic construct
  misc_feature 1..3541: note = Description of Artificial Sequence: Synthetic polynucleotide
  source 1..3541: mol_type = other DNA
ygaggttggatagttttyggtttgtaygtyggatttttggagagttygagttttttttttgagtttattttttttttttttyggggygtgattttattaygattatagtygatgagtygtttaagttgggagaaggagygagaaggttgtagyggygtaggttagatatttttgggtttaaygtttatttttaattagygtttttgttagtagygtttttttyggagttatagtttttatttygagattttttttttttggaatttyggagygyggtygggtattaggggttygygtaggattgtagaatygttgtygttygtygttttagttttagttgttygygyggtatttatttgggttttagtgttygggagaaggtgtgttygygygaggygtgaagttagagttygttygatttygttygtatyggaygygtttttagggtagaggaggtyggyggagttgtgaygttgggattagaggaaggagaaggaaagtygagaygggtygggtagaygygtygaggagygtttagtgtaygttggtagtygygggaggygaggygggygyggtgagtagtygygtyggaatygagtygygaattygygtygtttygygttygtagtygttaggattygygggaattttggttygtyggtagyggtattgaggagggaggggygyggggttgagtygtttttyggagttygagygtttttyggagtyggtaatttttgttgttygggygggatgygggygggaatttagttygygtggaatgtgggatyggtygggttyggagtttttagygttgggggaaagyggggtttatatagttaggaygagagggggtgyggttttagggttattttygygttattttttaygtggyggtygygttttyggggygtgagtgtgtaygyggayggtaggggggtygtgaatgaagttttagyggttaattagtayggtyggygygygggatttygggagygaygtttaatggagagttttgggtggtygggtagggtggygggygggygygyggggygggggtygggtaggggaggygggaggtagtttygygggtagttaatgggyggygggyggggtggggtttyggagygtygagygggtyggggttttaagtyggyggagygaggyggyggggttygtagayggagyggagyggyggyggyggygyggygtagggygyggggyggtatggttattatygygtagtatttgtygyggggtttyggtggyggagtygggggtatygggtygtttatgtattyggaygttgyggyggyggyggyggyggyggyggtygyggagygattgtatgtaggggtygygtatygygaagtgtagaagttgatgtattaygagtggttgggygygggygygggttatttygtgggtttagygtatttttagtggttatttaygggaggaggyggyggyggygattgggtyggyggttygtatttagaatayggtaaggtaggyggyggyggtatyggtygagtygaygayggyggyggyggyggaggtttttaygygygtttggtgtattagggggyggtttaygygggygyggtatgggygtagggtagtatagygtattatttgggttyggttatgtygttttygttyggggttagygggggttattagttttagtygttygggttgtaygygtaggyggtttattyggggggyggyggyggyggtttggtygggatgttggyggygggyggtggyggygyggggtygggtttgtattaygygttgtaygaggatggttaygaggygtagttggagtygtygtygtygtygtatttgggygtttayggataygtatayggatatgtataygygggyggtttgtaygyggyggyggygtatttgtattygggygygggyggyggyggtttatyggtgggygagtattyggaygaggatgygtttagttyggaygatttggagtagttygttaagtagtttaagtagyggygtattaagttgggttttaygtaggtygaygtggggttggygttgggtaygttttayggtaaygtgttttygtagattattatttgtygtttygaggttttgtagttgagttttaagaatatgtgtaagtttaagtygttgtttaataagtggttggaggagatygattygtttagyggtagttttattaatttggataagatygyggygtagggtygtaagygtaagaagygtaygtttatygaggtgggggttaaaggygygttygagagttatttttttaagtgttttaagttttyggygtaygagattatyggtttggtagatagtttgtagttggagaaggaggtggtgygygtttggttttgtaatyggyggtagaaggagaagygtatgatttttgyggtyggygygggttattygtttatggaygatgtataygygtttggggagttagggtttggygggggyggygtatygttatttttygygtttttatygttttygtyggyggygttgtattattattattattatatattgttyggtttagtgtagtgatttygygggtygggttttygtyggygygttgtagggygygggygygtagttygttygygyggtttggattttttttgttyggttgttttggattttataaaaaaaaaaaaaagtttagaaattttygaataaaattaaatattyggaygatttttttyggtgagyggygaagatagttyggtaggttgygtygttygagtttygggagagaggagygaagattyggaattygttaatttatttygggtattttgttygtygtttgttttttgtttttattttttygaygattttygtttttgttttttygggttgttyggggtyggatttyggtagyggtttttttaaagygataggtaaygtagtgyggggttagggatttttygggagagaggaygaagygaggagagttttttatttttttttttygygtggatttttgagtttgygggtttagggtggggggttgttattttattygttataygtttttttttttttataaggatgygttttatttygttttttttttttttygggtttggttttttayggtttttatttattygtggagtttttyggtttttggggtttttttaatttygttygygtttttaatttaaatygtagtatattgtatttatyggggtttyggaggggaggtygygagagtygygtttgtgtataaaagtaggaaatagttaaagttttaatttagtttaatttatttttttttttatatttttttattttattttttttttaaaaaaaagtaaaaaaaaaaaaaaaaaattaataaaaaaaattygagtgtttatttttygtttygttttattygagtttyggtttggttttyggttaygtyggaggggtttgygtttttatatatttagaygggaaggggtttttgttttgttgtagatygatygtygtatagygyggtttttgtttttygygg

SEQ ID NO: 6926 - DNA, 1513 bp, synthetic construct
  misc_feature 1..1513: note = Description of Artificial Sequence: Synthetic polynucleotide
  source 1..1513: mol_type = other DNA
ygtaagaayggtttagygaattttgtgtaggggaggygtygaggattggagaggttttgttaagggtttygttgggyggaaggygygygtttttttttatgggaaagatagatgtggggttaatgaaagggaggtygagaggygyggggayggtyggggagaygggggygtggyggggagaggaaagttttyggagaaagtygatyggattatygtaagygaggtatgtagyggagttyggaggaggaaggygtyggggattggggtagggttagggygggaygggggtggggggtgtggggggtattataggtagttggattygagggttttgagttgaaatttaatattygtttttggaaggatygtttttttttttttttygttttttttttttttttttttttttttttttttttttttttttaatttttaggayggagttttgygygggagaggagagggtttgaggggaggagaaaggaatagtattgagaggggttaggagtttaggaaggggagggaagggtagtygygggttaggggtgagtttgygggttaygygygattttyggagttttygtagtttttttagtgtttttatttttagtttaggygagtttataggattygggtttttgtttttttttygttttttttttgtttttttttttgttttgtggtttttttttttttttttagagatatttgggagttgtttttaagttttggggygtttygyggggttttgttaagggtgygtgtgagagagggyggyggagtyggygtygggtgttaggggtygagggtgggagygggagttygtggttttgygttttggagtygaggattggaagggggttgggttttttygtygtttgggygtaggtygygygtygggaaggtagtttygtttgttttaggggtgtttgygtgttggttgttgttgttyggggygaggygtygtagyggygattttagattttygggygygttgagtgagtgygygygtgaaaatygtygtatygtygggggtgygagtgtttgggtygaagyggttattttagygatttagttttayggttaygttttygggggtttttggttttaggtaatttggggtaagygttttagttttygtttttttttttttttagyggggtygtygtagattttagttttgggagtatygttttgtagygyggtyggygggtggagayggttggtttttaaattygttygtttagtttaatygtttyggyggttttttttagttttygaggtttttttgagyggtttggagaggygtygagygtagtttagygttygtttgtttattygtttyggttygggaagggaattttyggattttgygagttyggggygttttygyggtttagggygggtagttttyggggtttggtygagtyggtggygttygggaggtygyggggatagtaygtagygygygtttttggatgtygtttygtagygaygtttyggttygtttygt

SEQ ID NO: 6927 - DNA, 3541 bp, synthetic construct; identical to SEQ ID NO: 6925
  misc_feature 1..3541: note = Description of Artificial Sequence: Synthetic polynucleotide
  source 1..3541: mol_type = other DNA

SEQ ID NO: 6928 - DNA, 558 bp, synthetic construct
  misc_feature 1..558: note = Description of Artificial Sequence: Synthetic polynucleotide
  source 1..558: mol_type = other DNA
ygtgtttggttttyggaaagtgyggaygagayggtgtgggtgggttaggagttatttgtaagggtgtttgtaaatygtgaagtttagaggagaaygggagaaggatggaatygagyggagaggggaggtgtatggtaagaatttygttygtttygggttgaaggggagttgtgggtyggyggttaaygtttgaaggagaggggtttygggtggygggaggyggttggggattygygtaggttagygtgtyggttttttttagtttatygttgtygtygtyggggttgttttaagggagttaagyggagtgggagygggtttgygygtttttgttttgygygtaggggygggggggtttaggayggggygtttttttttatttatatgttgatttaggatttttaagyggttyggtttaggatatygtttggaaatttagtygygtgggagagggygattttatttttaatttttttgttgtgygtyggtttagtttttagaagttagyggayggyggaggaggtggttyggttttttttggtggttttgygttttygg

SEQ ID NO: 6929 - DNA, 7244 bp, synthetic construct
  misc_feature 1..7244: note = Description of Artificial Sequence: Synthetic polynucleotide
  source 1..7244: mol_type = other DNA
ygtatttgttgggtygtttygggttttygagttttygtggttatatttttggtttttgygggattttyggttyggagtggggaaattttayggtgatttggttttaagygagaaggatatttgggttatygtttttttaaaagttaggtagatttgtatagtttatttygttttyggtttaatagaatttttygaaaattttgtttaaaggagttttgggagtaggygtttggyggtttttgygyggaattyggyggttgtyggygtttttttttygattttatggtttatttatttaggtgtagtyggggttagatatatttggtttyggaatttttaggtgttggaaggtggggtttgggttttgygtttttagaggatatattatttttgaagtatttttttatttttattttaygygggagattttygygggggttgatattttttttttttttaaatttatttatagattttagtaagtggtattttttgggagygagtaattagttttttatygttattatagattttgttygtgtyggagygttttygygtyggggtttggtgaattttttggaagtttttygttyggttttttagygaattatttttatttatttttttttttagttttagtttttyggtgggtattttttagggttttttyggggygttaggttttgyggttttygggtgggggttygttagtygtatygttttttttttatttttatttttgggtttagaagttgatagattgataagaygyggtttagtagtygtgttaggyggaatgggttgygttttgaggtygygaygattygggtygagtttgygygtttagattttygtyggtttggaggttygaaagagtaaygtagagaygtayggttaagagtggagggagaaygataggaaygtttattttttttattatttaaaygaattttttttattttgaaggagagagagaaaagtagagaataaaaaygagagtgatagaatattagaaattagagggaaaaatagaattagagggaaaaatagaattttagaaattagaggggaaaagatatagagataaaattagagttatagaaatygagggygattygttygagggtygyggtattaattttagatgtttgaaaggtaatagttttttaaaaaggaaataaaatttgaaatttgttattttttttgtagaaygagttgttttttagggtygtgatattaagataagaygagaataaggygaaagttaaaattgaaaattgttygagggggttttttagtagtgattttgttttttgtygggaaggtyggatagatygatgygygttttgagtttaagagaatttgyggagatatagaggttattttttattttygtttagaaaagaaaaaaaaaggggggggggttatttgtttatttgtaataaygataaaaagaattttattattayggaaaagaaatygagatgttgaaaagtgaggaaaagagagtttaaaaggggttgagggaygygaaaagaggggyggggagaggaaaggtttagggygygagggaygtggygggtatygataggaagtgtaattttattttttttygttgagtttttttttaaataygaaaatttttataaattatatttattttttaggatgattatygtattaggatttttaaaataaagtaattgagttttaaggagataggaggaaaaaattaaagtagtttttaattattttaaattygtyggatttgggagygygtygaaatatagtaggaagaaggtaggaaaaatygttttggtatttatgttttgaatatttttttttttttattttygtatttttgtttygtttttatttygatygtagtaattgaattgttatttgttttttatttygttttagggttttagagttatttgggaagttyggttttgttaagygttttaggttagtaagagyggtgtagtygagtyggygttttagaagtygagaggttatataagtttaygtagagaggygtatyggatayggtaattaggagtaatttataygttttygggygtayggaaattatttgttaggaaatttttaaygttttttttygtttatttttttttattttttttttggygygttttttttttttttagaggtaygtagtggagtttttggagtttygaatttttyggatattgtagaatgyggggtttttygggygygggttyggttaattagagygtygtttgttttttttggttaatggtaggygttatattgttgtttaattttgtttaatggagttttaaggattaataatagagygggygagyggtttattgagagtttggtagygtygggtaattgggtttyggttgygygtagygttyggygygtatygygaggggattyggtayggygagagttaggtygygggttttaattaygyggttygtagaygagttttygattyggatttttgaagggagggttggattgygttgygttttgaggggttyggaagttyggatatggtgattgaaggagggtgaygtggttagataaggggtygggggtaaagggaagyggttaagagttttagygtygttagtggagtygggaggygygtgtagygttagyggaggaggaggatttyggagtttaaggtaggtagttgagggtygtagggagagtagtgggtggagatttggtttgyggtttttgttgaggaggtttgggtttygtgggttttagggaygttygaagggtttgggagaggaggtaaygtttatagagaggaggtttgggattttyggayggagatataaggattttgtygygggttttggtagggayggggaaygygggaagtagaggagatygyggtagaagyggggagttgggtttgtttgggttttatggggttgyggygtgggagggattttggtgttygtttatggttagttgygaaggygatttttttggtttggtgyggtttgttgggttattygtgttttaggattttaattttgagattagaaygtaggagtttgygttygagaggggttttttgggattttaagayggggagggygtgtttgaygattttgtttttaaattyggaggggaggggagggtagtgtgaggtggttttygagaaagatttttttttygaaatgtttaatttttygtaggataygtttttygtttygattattattttagattgygaagttaaaaaattgtattataggttttatttaatttttttttttagtatttgtttgtggggtttttttttatatattttttttttttaggygyggtttttggatttyggatatttagattagttgttttttattgttttttttgtttatgaagtttatttttgggttgggtttgtttatatagaaagtttttttggtygaatttttttttttaatattttttagttttaagttaaattttatatatattttgttttttattttttggaggtttttatygtggaatttttggygtttatatttttaygggttttagagttattgggtttaattttgtttaagttgttttttygtttttattttgttttttaaagttattttttttgttgttgatttttttttttaaagtttttgttttaaattgtattaaaaataaataaataaaaagaaataaaatttyggtttaatyggtttttatatttgygtttttatattttttttttttttatttttttattaaattgatygttttgtttygggtttttttgttttgtttttggtattagtttaatttttgggttaaaattgtygttttaattttagtttygttaaaygagtattttttttattygttttattttaattaggttaagttttggggtattattttaatttttttaaatttttattatagttatttgaattagtgatttttatattttatatgtttttttattttttttagyggaattattaatttagataaaattttatttttagygtgtatattaggtttaagagtagttatggttagattggggtgaaggtgttagggtttataaggaggtttygattgtatttttttttagtaattttggtttttttagtttagttttygyggtttaaatttttttttttagtttgggttttttaaggyggygttttggtttagygygyggtgtgttttttattaggtttttttttttttttattttttttttygttaggttttgttatggagttgygttyggagttgtttagygtgttyggtgyggygayggyggyggyggtaatagygayggggtygtttgtggygtyggtggygtyggtggyggtagtygyggyggtygttgtatygttatyggtgagygtggtaggyggtttgttgygggggtygttattgttgttgygggtagtygagaagtattygyggatttttaagtgygygygttgtygtaattatggygtggtgtyggtttttaagggttataaaygttattgtygttggaaggattgtttgtgygttaagtgtaygtttatygyggagygttagygtgttatggyggygtaggtggygttgygtaggtagtaggygtaggaggagaaygaggygygygagttgtagttgttttayggtattgtygaggggttggygttggtygtygttaayggtattattttttygaggttygtttaygaggttttyggtttagtgtgygtygtygayggygggggatttggagygggagygttygyggggatyggaggyggagtagttggygtagggggtttaggtgagagygyggttaggtygtaggtaggggtagtaggatygtagttttggggtayggggtttaggggtttgtttyggtttagaaagagtagaattttygtgtttagtygtygygattgttagggtttatygttygtttagtttygggtatggagygtgggtatagaaatttttttttttttygtttttggagtatttgtattttattttttttttttgtatygggtygaaatgtataygttttaatttttttattygtttttatttaaaygtaggtaggtttttgtttttttgtttygttttttttttaggtggaaatttgygtattttygttygttttgygtttttttataggttttttttttttgtttttttttaatttttttaaggaatttttttttttttaattgatattttaggttttgagaygttttaggttttgagaygttttagttttttttttttttttygygtttttaaygttttttggataatygtttgttgygttttttttttttttagtttttttygtattttttttggttttttaggtttgtttttttatgttttttttttttygttttttattgtttgtttagtattattttttttttttggattttygtggttttttgtggggagggaagaaattaggttagagtygttgagggaaaggagggattygttttaaatttgggagggaagaattttttaggttttaattttggaaagggtggattagaaataggggttgtatttttgtttgtagagaagtttgggattttttagataattaaggygtttttttttataggttgtattgttagggtaggtattttttatatagtgggtttttttgtatagygtggttaggtagaagttatgttgttttttgtttgaattttggatttggttatttttttayggtagggtaggattggaagggtagttaagggtggaggtgttggggtatagaygtggggaaagtagtattgaatatygagtttatagggtataggtagttggggttttgaggagtatagaaagagagggagttttggggttagggttgtaggggtttagagyggaaggaatgttagagtaaaaagaaagaggggtattggagtttagtgaataagggttgtggggttgagggagaggaaattgagatttaaagggtygaggtgttgtgattgttgttttttagttaatygttttttaygataygttttttttttttttagaggttaagttgtagaagtttgatttgttttttaagaygttgttgtaggtaggtygttygggtagttygttgtygtygtyggtgaagtttttattattygayggygtagattyggggttygggaygtygtttttagaggtgyggttyggtttaggttyggagaayggygatggygagtttttttttggttygtttttagttygggtttttaaagaggtaggtggtagttgtttaggtagygttggttttggyggyggyggygaggaggatagttygggtttygttagttttttgggttttgaattyggtttagaggttgataaagaagagggtgaggtygygtyggygttagggttgggyggaggttygggtttayggtagyggaygtygttggatattttgataygygtgtttttaggttatyggygaggygttttggagttggtgttgtagggttgyggyggygaygtggtgtaggttatygagtaggtgttgaattattatygtgggggtttggyggtyggtttgggttttgyggygtttttagataaggtygtygtgggtgttgtagtagttgtagaygaygygtggtttagtygygtygaygtygtygtygtygtygtygtygtygtyggggggtttgggttgtttgygtygttgtaggyggggttygtygtattttygtattatagatttttgttggtyggygttatggygtttggggygttgggttygttgagtagtygttyggttttttygtygttgtagtttaaygttagttatttyggtgtygaygygggygtttattygttgggygygtygttyggttttagttttttgygtttggtttatttygyggyggyggygtatagtygyggtttggtttttatggygttttattttattgtyggtttggtgtttaygttyggttttygtttatttatggattaygtttttagygattttatgygtgatygttyggtygtygttgttgyggyggtgtataaggagtygatttayggyggyggtttgtaygggtttatggttaayggygtttyggagaagtagtagggygaggggtttggtagtyggtyggtttttaaataggaattttagttttgttttygygggttatygattttttttygtttagygttttttttgygttttggttgggygt

SEQ ID NO: 6930 - DNA, 824 bp, synthetic construct
  misc_feature 1..824: note = Description of Artificial Sequence: Synthetic polynucleotide
  source 1..824: mol_type = other DNA
yggagtygttaggagtgagtatttttttttygggatatttagtttygyggygtttttygygygttttggttttatayggatttgttagttttagggaataaaagyggagttygttygttttttattgtagtyggaggatgagtygagagggttgagyggagagtgtggttttyggyggttggaggtaggagaatatgttgygttygttygtygyggygtgagaggttygaggtgggygygtyggggtaggggyggtygygggygtttgttygtttagtgggygttgttyggatttggygaggtggtggtttgtaatattgtgttygtattgtttattgtgggtygggygtygagttttygyggtygygagggagttttttgggtgggaattggaggtagtgggggaaaagtttggagttagaagttaggtagyggttgtygyggyggttgtggagggttgtttgyggtatttggyggygygygttttatygygaagagygggaaggyggyggttgtagtgtgygtaaagttttgggtggygygtaaaggygtaggygagggtygtygtatagagtygtttaagttgtggtyggagygttagggygatttttgggaattttttaagyggaatttttygagataagyggtttttgttttttgatattttagtygaggtygagttgaygygtagttatttaattttttttgtttyggggaaataattttattygygtygaygattggattttggttggttgggtagygtygagattttyggggggtttagttttgtggttttgagtattttttygtttagttygygt

SEQ ID NO: 6931 - DNA, 824 bp, synthetic construct; identical to SEQ ID NO: 6930
  misc_feature 1..824: note = Description of Artificial Sequence: Synthetic polynucleotide
  source 1..824: mol_type = other DNA

SEQ ID NO: 6932 - DNA, 1415 bp, synthetic construct
  misc_feature 1..1415: note = Description of Artificial Sequence: Synthetic polynucleotide
  source 1..1415: mol_type = other DNA
ygtttaaaatgatttygggygttttatttaaagagaygttttggtttaggtagttygttggggtygaaggttttattttttttygatttatygggtttygyggyggaagttttygtttaggtaggggatgttttaggagggaaggaggygayggtgtttaaggaygtyggaagtyggggattttygtttttttygggtttyggttaggttattagtgttggttygyggygygggtgtttagttgygtttgggatattgygggtayggttgtggyggtaayggtagyggtygtygygtygtygaygttyggtaggattgagygtayggagyggyggaatttttygtttttttaygtgtagagtagyggattgagygyggatagggygtagtataggagttagttggtygtttgtattttttagggtatyggtagygagaagtygttggttaggtttatttatattagtggttgygtggttagtaggaagaygtagtagagtagtagtatygataggtygttgagaygtygttgtgttygtygygggtgtagygygggyggtaggggttgggtttgygtygggtgygyggygttatyggggttyggygygtgttgggygttygggaaggyggyggyggyggyggygtagtygggtaattggtgtagtaggtggaagttgagtaygttgattygtttgaygttgataygtaygyggygtaygatgtttaggtagtagtgtagtagtagagttgtttgygttagtagygtygyggyggttagtagygtygggtagtggattygyggtggygyggygtygggtygyggtgtttagggygggagtagtagtaygaggtttagggygagygtttaggatagygttagtatgttygtygtgtggygtttttggtatagygtttggtaggtggygggygttygggtgatgagtaggtagyggtttagggttaygaggtagtgggagaggagggatatygtgagttygaggtttagtagtttatttygtagtaggyggtagttgtttttagygtygttttagtttgyggggggtttygtagagtyggtgggtaggagttygagtatygttttttgyggtatttagagggygtagaygttgaggtyggyggygtagtygtttaygatgaaggygttgttggtggtttgtagttttyggaaggaygataygagatagatgattatgtygttggttagygtgttttygatggttaggttygaatataggagtgatatygggatgygtyggttygtttaygatttttttttttygtagagtagtagtagygagttatyggtggtggaggaggtggatgtggaggaggagttggttattttggttaattttttatatttttttygttagygtyggtttttggtagygygg

SEQ ID NO: 6933 - DNA, 1415 bp, synthetic construct; identical to SEQ ID NO: 6932
  misc_feature 1..1415: note = Description of Artificial Sequence: Synthetic polynucleotide
  source 1..1415: mol_type = other DNA

SEQ ID NO: 6934 - DNA, 3039 bp, synthetic construct
  misc_feature 1..3039: note = Description of Artificial Sequence: Synthetic polynucleotide
  source 1..3039: mol_type = other DNA
ygggygtttataggyggygygggtagygygagtttyggagtttyggaggtttgtgygttttgagtyggtatggatttygagtattgygygttttttygygtggggtttgtattyggtttttatgtggtttygggggaygagttttygggttygtagggaattttygtygttgygttttatttgtatttygygtygtttygyggttygyggttgattygtttttyggtttgygggtttttggagttttattttttagagtyggttaagtygttygttaagtatttgtaggatttygggttyggttyggtttttaayggyggttatttttaygagggtttygyggaaggtaaygygyggygyggggygtagygygtagttygatttttttttttttttttttattygggtttattygggtttttttgtttatttttttygttygtttattttttaattttttgtttttttygtttttygttayggtttttayggaagtygggttggygttggttygggttaggtaaaggttagtgtggggygggagggtgaattatygtttttyggyggygggaatggaaggygggaggtygagggaaggtgtagtggygayggttyggagtttagtyggggttygaaagtagttggatttgggaaggagagagtatgttttgtygaagttggattggaattgttatttattttgaagtttagattyggtygagggttgtggagttatattgagatttgaygaagaagygyggtttttgtgtttggygttttttgagggttttgaggttgggttttaatttagagtggttaaatyggggtyggttggggattgyggtttggttttggttygtttttttttttygggtttagtttttataggaagggtgttgtttgtgyggtagattggtatagtttggtygygattggtygtgtaatgttagggttgtttttaagayggaataattgtatttttattttttatattaagttggtttttttgtygttatgtattatgatagtygtttttttggtagttttggttttttygygttggattattatygttgggtagttaggagtagttttgggtagtttaattttttggygtygygggtttaygggtyggtgttttgtgttaaggtyggttggatygygtyggtattygagaatgygtttgaaggtaggggtttggtaggttgatyggtagttttgyggtygttygtygtattttatgatttgtaaggygtttyggttttygtattgtatttattttatttgygttgttatatttygtagtttaggtttagaattggattttttaagattygttttaattttttgtygtygttyggttggygtttygygggtttttayggagtggtygggtattttyggttttygtttagtyggggyggtgggaatgtgtaggggagggyggggaggtgtgtgtgggttaayggaggaaatgaaygagttygyggagtttygtgtttgtgttttttgaaagaggtttttttgataaaaattatagttgggatttaatgagaagtagttggtttggtttttttgattttagttagayggtagaggtygygtagtgyggtgagtatygttagagataggtattyggtttggtttagygtttygygtygggtaggagttatttttttaggttygygtttttgttaggygygtygtattyggtatygatagttygggttttyggattatatyggtgtygygygaattgtagagagygttggtgyggaaygagyggtygggagaaatttagtatttygggattygayggtaagggtggttttgataaygaaatatygagaaagaaaattaaagaaagygagygataattaagaaaaggggaagggaaattgaataaaataayggagagygyggygagaaygagagggtaaatggtagtyggygagttgggatgaattaaaatgaataaatgaggaaygaaygaataaaaaaagtaggagtaagatygaaygaaayggataattagagaagggggaaaggataaagagggagggagtagattaaataaaagaaaayggagtatgtttaaagygtagaatatattaaaatgagaataagggggtaagaaaattaaygattttagttgaayggaggataggttaaaygaaagggaggtaggygggtgygagtagagtttggtagagattttggyggtygttagtttttggygtttttgtyggtgtttaaygggttgttagygtttttgyggtagagyggatttyggygtagygyggygygyggtggagtttggttgtttgaggatagttagtttttagggtygtatagtttatttggtgggaagtggygggygaagagggaattygttttatttttyggtttttaaaataatyggttyggagygtttttagtttataygagtgagygygtagttgygttttatttgyggygygattttttaygaggttgggtagttgygygttttagagtttggygtatttygtttttttttygtttgtagttygtygttygygtagttttaggtygttttttgttgagagygtttagttttgttttgaatttaggttgygtgttggygttgttagttattttygygtygttygygtttggttagtttgtttygagtttggttttgaygtygaaataygttttyggtaagagatttttattagagttttgttygttgtygttgaggttttgagtyggatgattyggtygatygttaaagtygaggagagttttaagtttttagattygggttgaggtttttgggttaaygttgagaatttttaagaagggtatygaggttttatyggggttttgtttayggygtttatgtttattttggttttgagttttyggygggagttgtaggagtttgggttttagygagttttgtaggtygtttagtgattttatagtggtyggaggaaatagtgyggygygggataaggttgtagygaaatgtgaaagttaaggttggtttygygg

SEQ ID NO: 6935 - DNA, 1277 bp, synthetic construct
  misc_feature 1..1277: note = Description of Artificial Sequence: Synthetic polynucleotide
  source 1..1277: mol_type = other DNA
ygygtttttggggagyggtttatttatagtattgygagtatttagtatygttttagagtayggygtatataggtataaatgtagtagaggtttttygattygttaggayggygttttttttagatgggtattataygtaygttttttgttttagttatttygttttttagatgygttttttaygagggaggaagggttttttgttagtttygaatttagygaggattagttttaggattgagaattaaatatttatttygggygtgatagttttgtttygtttgttaatgttattgttaaggttataggtttgaggtygagyggttggggttggggtttttagttgygtaagaggtttttagtggaattgygttttgggygygtagttttaagtygyggatgggtyggataggtttttttyggtttttygygggygtttgttttygtagttaagtttaatttttttyggagtttttgggtttttttgagtattagaagttgaagttyggtgtttaattygtgygtaygtygttggggatttygatgygygaaggagagygggtttyggggtttygtygttaggtaayggyggttggagyggygagaggagttygggaygagygtagggtygggyggatgygggggtagygtygttttatattttggtttttagttttttttggttggggyggggttagaatagggaaagttgtagtggtyggttyggtaaagttaggyggggygyggttagygatttatttgttaygygtgggtagtygygtagattyggttygtgtatttyggtygagtagttgygattttygaygggtygyggaygtatagtttttttttygggttataggttttyggttggggttggggygattyggagttgygygtyggygtaygygatttygttygttttttattttttgttttattattagttttaatttggttttygttygtygygygttyggggtttaggggagyggygyggggatttaggttttayggyggagagagygygygggattgygaagattggggtygagtgtygttttttttgygttttggtagygtyggttttgyggagtagaayggagttgggyggagygttgygygtattgttttttygtttttygaaaggttattttggyggyggggygtygtgaygtaggtttgatttaygygygggtyggygttaatgygaggttttygggtagygagygaggttttgatggtygaygtaggyggagagggtgggygtggggygg

SEQ ID NO: 6936 - DNA, 2394 bp, synthetic construct
  misc_feature 1..2394: note = Description of Artificial Sequence: Synthetic polynucleotide
  source 1..2394: mol_type = other DNA
ygttgtaaatgygttaatatttyggttgttagygtatggygagygttttttaygtttattygtaggagyggygtttyggtygttttttygtttttagtttgttttgttttygtttttttttttttttyggttatggttatttttggaygtttgagttttatygtgygtagttttttagatttattygagtaggaygygtaatatttgtygaggygggagttagaattaygygttttttagttygatttttgygtygtttggttggattyggagygyggttattatttttgtaagtgygtggtggattgyggtgyggggtgggaggtaggaggygtggggtagtagaattaagggtttagtttaygaggggtyggaaagtygaaattttagtttagagtttagatttttttagttttggaaaygggagttttgttttygaatttttaaygtatttatttyggtyggtatattttaagagtagatttttgtttggtattggtgtttygagatttggggtttttgtgtttgaygatttttagaggtyggaataattgaaatttaaaaygygtygttatttgtygtttttattttatttttygttttttttttatgtttgaaaatayggttaygatttttaggttttygtttgggatggttagtgttggygagtttatttttatttygtttttatttagggtttygtaaatttyggtatattgtagtgtagtygatttggaggaggtyggygttggtgatttagtttgtgataaattggtyggttagygtaattatyggtgyggatatgttaagagggtttyggggtgggttttttyggggtaygattttaggttygttgatgatygttgtggtatgaatgaggttatygtattyggagaggtggatgtttagatgtggatttaggaaatggttttatttygaaagtttygggttagtgggygtgttttttggttagtgtttttaygttygygttagaagggtagtaggttttygtagggttyggygttttatttattygtgttttttttgttgtttttagtttyggaygagagtagtttggagattagttygttagattygtygtagyggtygttygttaggttygygttttygggttyggaygtygagaaaaggaagaagyggygggtgttattttttaaggygtagaygttggagttggagyggygttttyggtagtagyggtatttgtttgygttygagygygagtagttggygagtttgtttygttttaygtttaygtaggttaagatttggttttagaattatygttataagttgaagygygttygygttttaggggyggyggagtygtttgatttggtagtattygtygagttgtaygtygygttyggtttgttgygtygygtggtggtgtyggtgtttgttygygaygggtagtygtgyggyggyggyggyggtggygaggtgggaatygtygyggtttaggagaagtgyggygtttttttagtygtygtttgttttttgtygggttattttgttttyggtttyggttyggygtttggtttttttttygtttattagtatttagtatttttygttttggttttttggaattggtgaggtygtagggyggtatttggggttattttygattttggagygygttttgygattggagtagggtyggagtygaaygtttggaaygtttttygttygtttttttgtagttttatttttttgggygttagggtttttggygygtttttattagtygtygygtaagtatataygagggaygtgtgttagagtttttttttttattttttttttatygttagttttagagttagattttatgtttgggttttatttgtatatttttaaatagygatttgtataggaagtaagttatttttttaaaaaatagagtattttttttygtagttygagaataaaatgtgtggggttgggttttttgygygtttgyggggaaygtaggygggagtygtgttttttagatyggtgttygtatygttggttygttttttgattggttaagtggggttyggttttagttggatygaagggygggttgtagtttygatayggttttaggaagatatttgggggatggaggggtggtgatgttagggttgggygygggaagaaaaggagaggaggaagttgaggtaattttgggatttttgttagygggaggygttattggttttagagtgatttygatttttygttgggtttttagagttgttggygtttygaatatygaaaagttaattttgtggattaygatagggtagaaggagttttttyggagatgagtyggygaggttaggtgyggggygygttgtatyggagtagtttaggtygggtygt

SEQ ID NO: 6937 - DNA, 1627 bp, synthetic construct
  misc_feature 1..1627: note = Description of Artificial Sequence: Synthetic polynucleotide
  source 1..1627: mol_type = other DNA
ygtttygggtttggagggaggggaggtttttyggaaaggggtggygagagattttygttaygatttttaagttttttygygygygttggaggggatayggtgggygtttaattttyggygtagtagtaggttttataggttgtttgttggggtttggggaagtygaaattgygtatttygggattygggagtttttygtagygyggtttyggygtggtgattgggaagygtatattgtygttagttagttagtygtygtygtattggtttagtttygaaaatttttaggyggygtagaggtgtttaattttggttattayggygtygygtygtyggtaygtygygtgggttttagatagygttagtygttygggtaygaagaatatttggtttggggattatagygggttatygatygagggtagggtgggyggagaggggyggttgatatttaggaggyggagttggggtgygggatygtagaggtgttggatygagtttgggtaagaggagttgggggatygaggtaaaagtgtagggagggtttggagaggtgagttggagtttgggygggygggygggttgatgggggggyggtgttttggagggattyggagattttgttttgattttaagttgaggtttatttttygttttttatattttttagatttttttttaagattttgttttygtttygygttttattygttagygyggaggtgaagtagaaggygtygtagyggtygygtattyggtygyggggttygtagttgyggatttygggtyggtttyggtygtygtayggggygygtgyggtgagtatagggtagygtayggagttttygagtagttagttygygttatattagtttagattttyggtttaagttggygggagayggyggaggtyggggataagaggygttataggtaggagttagattgagttygtttggygttttttttygggtttttgagatagtttygyggggtttgggaagtgttgggttyggtygtttattttggtagagttgggagtaggtggttaggygttygttttgtttttygtaygtttgtttygtttygtagtaattgaattggtatyggtttyggttgggttggtayggaaatattatatttagggggtggyggggattttggggagggttagyggatgggagyggagggggaggaagggyggygyggtttgggagagggagttggggtttttaggggtgyggaggagatattgggaaggagttttgggagatttaggygaggyggattygttgttatataggaatggggygggagyggaagggttttattttttaagtttaaggttagygttaygttttygttttygatgtygttgatgagttygtagyggtatyggttttygttttttaggygtaygttygygatgattagggaggygtttagtygatgtttttttygtattttggygygtttttttaggggtttatattttygggygtgtagttygttggtgatgaggattagygtttttyggagttttttaggttttattttgttttagygtattttgtagttgggaggygtggtgtttaggaygtagggtagygtggtygtggttttayga

SEQ ID NO: 6938 - DNA, 271 bp, synthetic construct
  misc_feature 1..271: note = Description of Artificial Sequence: Synthetic polynucleotide
  source 1..271: mol_type = other DNA
yggttygyggagttagygtttttttygygtygatttygggtttygggyggtygtyggggggygtygggygtatttttygttgttaatttttygttygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygg

SEQ ID NO: 6939 - DNA, 884 bp, synthetic construct
  misc_feature 1..884: note = Description of Artificial Sequence: Synthetic polynucleotide
  source 1..884: mol_type = other DNA
ygtagtattttggygaatttttttaygtttttggtgaagttgtttygataaattygaaatatatgttgtagygttttttattgttggtygttgaaygtgttttgggattaaggttttagagagyggayggtgttygagtygttgttttagttgtgygtttgtagtttttttagttaygttaagtygtyggtgygygtttagttgttattggygaaggaygagatttggaggtagyggagggggaaaagtttttgygggattgggagagaatgaagattggaggygtgtagtaagtggtygggagagtagttagtataaagagaaggaagaaagaaataagaggagatgagttttaggaggyggttgatgttagygaattttgtgtygygttgttttttttyggagttagggagtagygagttttttatttagatygygttagtgygtttygggttttattagtttttattaggygttgtttttttygtttttatttagtttttttttttygttttttygygagtgtatttaagygttttygttttatttatttttagygtttttttaagtttggaggagygtttagagtagtagaaatagtaggtattttatatygttyggygtggggatttygyggagygtygttgygygtygttttttgatttgygtatttttttttttygtygtttagtttaygttttttttygttgggtgttagttaatttttaagtttagatttyggtagtttttttygttgggtttgtyggyggtttgttgtttttgtygaagggygttttygtttttagttgtgygagttgtaaagaggtyggggttttaggaattttggygtygtygtttattttagtaggttttataatyggygt

SEQ ID NO: 6940 - DNA, 1007 bp, synthetic construct
  misc_feature 1..1007: note = Description of Artificial Sequence: Synthetic polynucleotide
  source 1..1007: mol_type = other DNA
ygygggtttggttttaatttagtaygyggaggtttttttttttttagttttagygaaagggyggygggtgggaattattygttattttggtaatttttttttgtygtttgtttataatagtttgaattatatttttgttaggtagttattagttygattttttttttttttagttttygtttttttttttagygtttaggttgggggyggygtyggtgttagtttagtttagggygaagtttttagggtyggttygggtygggttgygggattygtygtggagygtaaagtgtttgaagttttygygygtattyggttttgtttttaaaggttttttagaaatgtaagaggttaggygtagaaatatatayggayggtagttttatgagaaaatgtagataaagagttyggyggtagggttatatgttttttataatttttaaagtygttattttaattagagttttttttgagttttaatgtttaattttgagtaaataagtygttttgaaagaagaattyggtttttaattaaaagtgtattaatattttttttttttttaattttygyggagtaaagtttygygygggyggaggygaggttaggtygyggygaggtygtttygggttygygtygtttygygtygtygygygtttttaggtgaygttaggygggttygggattagggtttattttgygtttttygygtygygtygtagagttaattaaaagtaatgttayggtaaatttaaaggtttttygttggyggagtygygttttygggttagtttgygagagagggtttttygaggtaggtgttggggatttatttgtgtgtgagtgtgagtgtgtgtgtgtgtgttygygygagygtaygtgtgagygtttgtgttgaaagggagagttttttggattttttggagatygagattgttttttttttttygtttatgtttttagtttttttygtatatgtattagtgaagaaaygtayggatatygtygt

SEQ ID NO: 6941 - DNA, 2191 bp, synthetic construct
  misc_feature 1..2191: note = Description of Artificial Sequence: Synthetic polynucleotide
  source 1..2191: mol_type = other DNA
ygtygygttttgttyggttttatttattyggtggygtttgggttygttttagttttttatttttattttagggtattatttattagggtttygtttygttttagttttaygtgyggggttttatttyggygttagyggttttttaaatatttttatttttatatattattttttttttattyggayggtagtygaatagggataaaatttatggygtatagttagtttttttygyggagtaygttttgtgttgttttagtygttggggttttttatttygggttatagttttttggygtttttygggtygaggtagtygggtygaggagtgtyggtgtggttyggttayggggyggggtyggygggagtttyggtygtygtygtygtygttgttgttttygtttgttttttgggtygttygttygttygtygttgggtgygttgtaygyggggggtagtygtggtgtagaggtttatgtagyggyggyggyggyggyggttgttgttgttgtygtygyggaggtagatagatygggygttgttatygtygttttttttyggttttatgtygtygtygttgtygttttttttttttyggygaggggyggggggtttyggttyggggtgggtattatttttygtagygtygtttttttttttgtttttygttygggygttggagtyggygagggtattygtygttttttaggagtgtatttttygygygttttgtyggagygagggggygggygtgggyggaygtyggggtagyggggatttygygyggttgtaagaggagggggtttttttaaggatgttyggyggtttttygtttttaggtgygagttgagtttgatygggagygagyggygygtygttatgtyggygtgaygggygttttyggttgttygygygggttttygygttgttttaygtygygtygtgtyggtatygggttgtaggatgggttgtatttaaagtattatttgtaaggygyggattyggygygagaatatygtggtgtaygatgtgtgygttattatygattagtgttttaygygtatygaggagatttygtttatygttttgygttataagattttttattttaaagttttygttygygtggttatgttttttatttttygttaygagatttgggtggtgggttggatttaggygtgtaattagatggagttttttaatatttatagygatttgggtatgtaagygattygtygygyggtaygggagyggattttgggtttttagttttgtttgttattttgatttttttttttagtttttttttattgttgtttttatygtttttttaaatttttttttygtttttttttttattttttttttttttaygtttttgttttagtgatagggygggtgtagggaggttttttgygaaggtattttttygtggtttgtttttgattttttagaaaygygaggagaaaggtgyggggygggaagaaygygataaggagggttygagaggyggaggtggggatggttggygagtgtttggygagttttagggygtygtttgtgttttgtggggtttttygggaagagtttgggggaaattatagaggagtggagtggagtgtygggggygtatgggttgtgtygygygttttttggagaaatyggagygggtttggaagagtaggtttygggtattygagygggagttggtagttttgtttttgttttygygattgttgaagtttygaatttttgtttttygggttagggagttyggaggygttttygtttggaattataagtyggatatagttgtttttttgttttygygttttttggattagttttggtggggagttggaaggtatygagtgygtttyggttaagaagggyggatagttttgtgygagtagygttyggttggygyggygyggggtgttttttatgttaaaggaaaggatggattttttgtttgtttagggtttttattttttaaaatttttttaattgyggtattggaagggatttttttggygtttatygtygaattttatyggygagttgggagttttttaatttttagtagygtyggttggtgygygtygggtttggttgttgyggtgaagattaaggatygtygyggttttttaatygttaggggtygtaggttaygggyggtygygttygg

SEQ ID NO: 6942 - DNA, 859 bp, synthetic construct
  misc_feature 1..859: note = Description of Artificial Sequence: Synthetic polynucleotide
  source 1..859: mol_type = other DNA
yggygygttaygtagggaggttgttyggggttggygygtatygagggggtgggggtygagttyggggyggatttttttttygatttttygattggaggatagggaggaaatggttttgtatygtaygatgaaaggtaggtaggagggttattaggyggggggtggtaggggayggaggatgtttagagttggaggatttygttygttttayggatatygttattttgttttttattttattttgttttttattttatygtagygtttggtttatttattttttggttttygttgttygtttaygttttaayggttygtagyggggtygttttattgtygtatttttatttygygttttgygygtttatttgtttaygaagttttygagtatygagtttttgtyggygttttggtygtttattayggygatttgyggtagttttagtaggtagttttgttttagygtygaaaaygygttttgtagayggtttattagygggattagtttttttatttttyggttttttattttgttygaggggtyggygattagttggtttttgttygtttttaygatttgatagggagtaggggtygygttgttttggttgttgttgttgygtygggtttagttagttaggttttggygtagaygtyggagttygtygttagttygtygtttggttttgatagttaaygattygtagygygtttgygygggygggtaggggygtggtttattttygygaygtttygttttygtttygyggttgtttygtttygggttttttatyggattattaggttaggygygtaygtattgtagtttagttgyggttagatgttayggtttttgygt

SEQ ID NO: 6943 - DNA, 791 bp, synthetic construct
  misc_feature 1..791: note = Description of Artificial Sequence: Synthetic polynucleotide
  source 1..791: mol_type = other DNA
ygygygattgtagttttggggggygygttyggaatygaaatggtttaagagatttgaggatyggygygtttttttttttyggttttagtttttaattttygttatagygtagagggggtagtgyggtgggagggggggagttgtggggttggggtttyggtttggtyggtgaagttttaggattygttygtttggggttaaggtaaggggtgyggtaygaggagygtagggagtttygagttttaggygtagatttagttgyggattygtygtatagttttggtgttgtaagygtggatygtgggygtaaggtttyggygggaggtattyggttyggtygyggtygggtttgtagggttttggygtagyggatttyggygygttttggttygyggttygtagggtttagayggggtygagatagttaagttyggttygttygygttaggygttggagttaaggttgaygggyggttttgaattatgtttggaggagyggygyggtttttagggtttygttgagaygygttgtagggttgttygggttttttttyggygaygyggttagtagttygygtygygtttttagyggyggtaaaaattaggagtttyggggttttgtygggygtyggtattggagggtaagagatgttggtttttttyggggtttattatttyggggttttatagtatttaygtgggatggggatttyggagtagattayggayggaaaggaayggtggttttattttttgtaaaagaaattttygygygtataygggtgtttygg

SEQ ID NO: 6944 - DNA, 586 bp, synthetic construct
  misc_feature 1..586: note = Description of Artificial Sequence: Synthetic polynucleotide
  source 1..586: mol_type = other DNA
ygggttgygygtttygagttgtaygggtaggtatttttttyggttttgttttataaggtggggagagyggggttggaygygggagggggygggggggggagygtgagaagaaaygaaatygygggaaggaggggatatyggygggttgggtagagggygaggyggaggttaagttgggtttgggygtygtygttttygygygygtttgttgtygggttygggttattyggagagygygggygattygggtttygygtttgttygtygtygtygtygtygtygtygtygttaygygtttagtttygggttgttygttggttyggtttyggtayggygyggygygggggyggtgggtgtagttttagttgtygtgygtttyggygtttttgtgygygagtttygtttagttttttttygtatgtttttgtgtgttttttttygtaatgtttttygtgtttygyggggggtgtgtggtayggttygggygttygtagttttgtagtttttygttgtttttttttttyggttygtttttgtygttttttgtyggttygttttttttttttyggaattttttttttttygt

SEQ ID NO: 6945 - DNA, 1678 bp, synthetic construct
  misc_feature 1..1678: note = Description of Artificial Sequence: Synthetic polynucleotide
  source 1..1678: mol_type = other DNA
ygggatygayggyggygtttttttttygtttttygtyggtaggagaggayggggygggagaggaaggggttagttgtggttgtagtygttatttttyggygttygggattygggaygtttagtygggttttgtagagggtgttttatttgggtattagyggtttttygtttttagttagggtatygaaggygygttyggygggatgtagygaattgttttttgtttygggatagtggagyggtagaaggtttaatttttyggttygtttaygttygtaaggtggaaaaagtggggtgaaatyggggaaatttagygaaattggggygaaagaagagagattaaagygtgttatttaygtgttagatggygaagaagatgagygtagygtatagtattagagatagtatgtagtagaaygtagygaaagtgaaggttatggtyggyggattttaattttattatataygttaagaagtttttaggagttygatgtttttttagaggatygtattttttttaaggagtygygtttgtaygtttttttttaggttagtgtttaggagggygtatagttagygaagygattygagggttagygaataagygttggattttygtaggtttyggygattttagattyggtttttyggygaagataggaaaaygtgtgtygagagtygttggagggaatygttygtaaatygaagaagaaattaaattagtagygaatatttgtaaattagtgttaagttgtgagtttttygagattaataygataagygatgygaygattttayggaggatygagggaggaggttttattygttttaggaagagttttttgtttttttttattaaatygttgaggagagaygagygtttygtttyggattttttygygttatyggggygtaaayggatagtgtttagygaggtgttygagyggttttygagttttttttaaattttagagtygggtagygttttttttygagagaaggagtttttaggtagtygggaggaggtaggtttygttggttttgygttttagaygyggtttttagygtagtygtgygtttygaggygygttygtttttaatygtgatttyggttagtyggttttygtaatttaagtgtttyggaaatygggggtyggatyggggygagtattggttttatttaaygggttaattttagttygggtggttgtagtagtgggttttaggttaaaygttgtagttygttttatttgttgttgtygttgtygtygtygtygtygtygtttttgttattgygagaattgtagyggtgygattygggatttttttttttyggygttttattttygatttttgtttygttgagygygtttttttyggygggyggagattgtagygtygggggttgaggaaaggtgggtggygaagygtygtygggygtttggtggtygttgtygtygttattgtagttgtgtaygttygtttttyggaggaaatttgaagttagtagtataagtagggttggaggtygagyggaggtggggygggatyggttggagtagggattttttaaataygtgygtttggaggaggtgggaagttgyggaagggtatggtgtgtgtttygygtttaaaygtygtagtygtttttttyggtttttgtagtttygtttatygg

SEQ ID NO: 6946 - DNA, 1600 bp, synthetic construct
  misc_feature 1..1600: note = Description of Artificial Sequence: Synthetic polynucleotide
  source 1..1600: mol_type = other DNA
ygagayggagttagtatttgattagygattaatagtggatyggygaggygggtttttaattagagygagatttttagaagttggatagtttttgtatttatgggagtatgyggygtagttggtagtgatttttaggaaatttyggtagtagtygtygtygygggtgtggtgatttygggttygtygtttatttggagygtttyggyggygtttggtttagaattatyggggyggatagttttttggagttgtaygyggattgyggaaggggatagtgagygggatyggttygtatttygttygygggttyggatygttggaagtattygggtttttttttttttttgtttttyggtttygttttttttttttygygttgygygtggyggtttygggttgygygtttttgtaggaggagatyggtattgtygtyggyggttttttttttaatygttagtttyggtygygygtttygtttygtttygyggaggagggtgggggygtttttygygtygggttygtttagttttttygyggttgttygggtygggttttttattggtyggygggygggaggtgaggggyggtagggttygtttttggyggttygygttygggaaggtyggtagtygagygtyggaggtygtggagagggygggtagggaggyggygggygtygaggagatgtagyggyggyggtggtggyggtggtggyggyggtggyggyggyggygtttggtttyggtygtagtttttgygtttygttygttttgggtygtttttgttagtttygygygyggttygtttttygtygyggttygtagtttgyggygttygagtttygagggygttttttygggygttgggttygaggyggttaagayggygggtyggtygggtayggggyggygggygttgtgttgygggttgygttggtggggggyggygggtygyggygygggtttagggttyggygtgtgyggttgggaggtattgtgggggygggygygygggyggyggtyggggttatggtygagggyggygggggygygyggaggagggygtyggygttgttygaggttgttygygygygttaygagagtttgtatatttyggaygaygtgttyggygagttyggttyggatagyggygggaattttttttatagtatttyggtygtttygygttttttttyggtygttttttyggaygaygagygygagttttygggatttttaggggtygtttygttatygtttygygtttyggaygtataggagtyggaggaggaygaggtyggygygggttggagygtagygttgygggatygttygttttygygtttygaggatatyggyggtaaggggttgttygygggtggatgtygggggyggygttggaatygggygygggggaggygtgggtgttggggygggygagtttagatttttygtgggttggtttgtgggtgttttttyggaaataaatgaggttgtaggagyggtgatyggtttgattgtttttgggggtttygaattygtgggtggagagggtaaggyggaggtygtggttagtatttttttagtgataatgtygtygg

SEQ ID NO: 6947 - DNA, 2394 bp, synthetic construct; identical to SEQ ID NO: 6936
  misc_feature 1..2394: note = Description of Artificial Sequence: Synthetic polynucleotide
  source 1..2394: mol_type = other DNA

SEQ ID NO: 6948 - DNA, 1160 bp, synthetic construct
  misc_feature 1..1160: note = Description of Artificial Sequence: Synthetic polynucleotide
  source 1..1160: mol_type = other DNA
ygtaggattygtttttygatggaygtgagttttatyggttygttggtgagattttttayggagygygattattttagattttttttaatygtttygtttattattaagtatttgagttgtyggagttgggggttgatgtyggatagttttygggggttgaygttyggtgatttttttatgttattgyggtygtaggygttaygggtaggtgggtgggtagggggagtatggatagagaggaggggattygtgaggagtagattttagggygagagtaagagygyggtyggggtttttygggggygagygtygyggtagagttygygttttttttttttygtygttatttatttattttttygggtagttgtttttagtgttttattttgggygtttyggggtagtgygggttggggygagtggygagggaaagaatgattgaaatttttygagtagttttatygygygygtygttttttttygagttttagattgtttagtgttttagttgtaaagggttatttyggygtttyggtttttygttygtyggttygtttatttaygttyggggygttatttatayggtaatgtttttgtttttgggtgygtygttgggaaattttygaatttttataggtaaagatagagtgggatyggtagtttttagatttgaggyggaggggtygygggtyggagttttttgtagtygttagtttgggaagattggagtgygttgtttatygagggtttgygtygygtyggtygtttygggtygttttgtgygygttygygyggtttgtattygagygttttygyggygtgyggtaygatgtaggygyggyggtttagttyggtgattttaggtyggttygygygttygtygtaaygattyggtagtygaggtagygtygygttttaygttygttatygtygtygtygttttagtatatygtaggygtgagtttygtygygatygggagagtttttttagttgtgygttttygaggtatttggtygggyggggaggygtygggtyggggygtataggggttaggygggggygttgttgtttatttttygtttttygggygtgygtttygtttyggagttygtatttygygttygygtttygtttggaagttttggggtatyggaygygt

SEQ ID NO: 6949 - DNA, 588 bp, synthetic construct
  misc_feature 1..588: note = Description of Artificial Sequence: Synthetic polynucleotide
  source 1..588: mol_type = other DNA
ygtaggyggyggygttttgtattgyggagtygygttttgggggagtagtatttttagtttyggygtttygtagttagatagttttttttagggtggtagtatttttyggttagggtgtagggattttyggggygaggyggtygygtattattttttattttggtaagggttaggatyggattgttgtaggygttgagyggggttattygggtygagtgtttttttatgatgagtyggtygtttgtaggagygttgtygtygatygtttatattttggggtyggttggagygygtttttttygggttygtggtygaygyggttttttgtygtyggggagtattagyggttygttttttttagtttyggttttttyggttgttygtygggtttyggttgtygygttgtttattgyggyggtygttttgtagygtatatttttttyggtygygtagttattttatatataygygygtatagttttttatttggaggttgttgtaaattttaaygttaygtataagtgtattttttgtttttatttygtagtttatttgtttygttttttttttygggaygtttagtttygt

SEQ ID NO: 6950 - DNA, 878 bp, synthetic construct
  misc_feature 1..878: note = Description of Artificial Sequence: Synthetic polynucleotide
  source 1..878: mol_type = other DNA
ygggaggygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtygttygyggggttggattgggagtttygtgygatttygggtttggygtttgggtygggggtggttttygggtttttttygggggtygtygaggttyggtttygatagttttgyggttgttgygagygtttttygagttttygtttygyggtgttygttttaggagygggygyggygttgtgtttttttatttgygygtagagggtygttyggtgaagttatggyggygggttaggggtaaaygagygttygagyggggttggtaggttttyggggygygggaggatygtgggattayggggatgaaaagttttgyggtttygaygygtttggagtaaatygtggttttgygygtttttgttttttttygtttttttttttttttttttttttttttttygttttttttaygagtttattttttgttttggtaattagtaaagttttttygttgygygtttttyggtatttttttttagaggygyggggygggagtyggggtgtygygattyggggttgggaygtaaggyggggtttygagtgtttygggygtttttagygtttagagygygygttttgttyggtatttaygtttttttgggygggttttagyggggggttgataygattgtygttygggatagattgygagygaaggattggttttaagaaayggttgtagtygygggtygt

SEQ ID NO: 6951 - DNA, 561 bp, synthetic construct
  misc_feature 1..561: note = Description of Artificial Sequence: Synthetic polynucleotide
  source 1..561: mol_type = other DNA
ygagtgggygygaatttttatagtagygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyggattygggggtttttttgtttgtagttttttgttttaatgatygggttgyggggaggggagggtaggtttttttttaggtttttggtttttgtygattygatttgtttatttgygtttttyggtagggtttatttgtayggggttttggaggtgtttgtgtagagtgagtaygaaggggaagtgttattagygtggtttygagtaatttggygttgtatggtagtgggttttagagyggygtttgttygygtttttgggggttgttttatttagtttaaaaattagtaaattaaygaatgagtaaagttggygtygttagygattagygtggattygygt

SEQ ID NO: 6952 - DNA, 1235 bp, synthetic construct
  misc_feature 1..1235: note = Description of Artificial Sequence: Synthetic polynucleotide
  source 1..1235: mol_type = other DNA
ygagttgagttgttygygaggttgyggtaggaggtttygttttttygggtagggttttttttggaggttttttyggttttttttagaygtattygygtygygtttttgtttttygggagtagtttttttttagtygtyggttttgggagttttatygtttaaaygggagttgagtttgtaagyggttaggyggyggtgyggttggtgttgttgttgatgttagagttagaaagtagttgtgattggatttaattagaygttgttgtagtaaatagataagttttttgygtgattggttttaaagtggttggtgttaaataattagtagaggygtaaaagtagtttttttgygttgggagtttagagtaggaggtagagttygygggaagttyggagtatttaggaygtygygygttttttttygttttttttgattagggagtagttygttttaggygtttagtygaggtttttagtttagtgggagtaagttatagagaataattygagagatagagagayggagygygtttttttgtttagttttgaaaagtgagtygttttygggtttgtaattttaagtttygtagtagyggyggyggyggttgtygggaaggaggtaggtgtaggtgtaggagggaggyggttttgggtttygygtttgggtttyggttatggtttyggttttggggagyggtagagggtttggagggttgagtagttaatttaaatgtaagtttaagaggaggaggaggyggaggtttaagyggaaaggtaaggatygygtggygygtyggtttttgtttttttttattttyggtttttttatttyggttttttatggggttttygggtttgttygttgtgagtagttttattttggggtgttggygggatggttgtttygtgtagggygttygggagtttagatttygtggaaatgtttggggtttttttttgtttagaggggatagtgagtagttaygttgygatatgtttgagggattyggaygaagtggggygagggyggygaggagtttttyggggatttygygygttttygggtttygtagtttttagtggtyggtygggttggtattgttttttatttttyggaggttatttygttttttagtgttaaaggaattatttaaaaaygggggaaygagttttygygttagttatttttatttaaattgtttyggaggaagggataggygaagttttgygatygt

SEQ ID NO: 6953 - DNA, 5964 bp, synthetic construct
  misc_feature 1..5964: note = Description of Artificial Sequence: Synthetic polynucleotide
  source 1..5964: mol_type = other DNA
ygyggtggttggttgtagtttaygtttttaygatttttgtagaaggaaattaygttttttttttttttttygtatttttatttttattttaagttttygggaagttttgygttggtattagggtaagygtttgtyggttttygggagttaagygaggtygygyggtttgggaygtaaatgggagggagtagtygttgtygttttgyggggttagggttattgggtaggygtagygygggttaagagtgggaggtttagggtaggggattygtattyggggttatttttgtygyggygygttttgygttttagtagtgtatagggtggggatttttygaggatagtggtgygtygaygggtttttyggtttttttttttttataggtttygttgtgtggtgaaggagttagaagaggygatttgggtgttgagattyggggttaaatygtggagagtgtttggagtttatattttagatttttggaygtygtagttagtttagtaggttttatttggagtygtttyggggtttaatygggaggtagyggggtgtaggygagagggttaatgygttyggttyggttggtttgaggagtttttgtttttagygatttatagggtagagagtttagggtttyggtttgatgtttttaatagttggggattggagagttggaggggtygtagatttaggttagagtttaaagtgygtygygyggygagtygttggatttttttgggttttaygtggtttttgtgttatatggagtgataggtyggyggaaggygttttagtygtygtttagygttttttaaggtgtaaggaggtaggatttttttatattggyggygtagggggttttayggttgyggaygttygttttggattttttagttyggtagattttttgggtggagaggygttttttagggtygyggygaaggagagyggtttttyggtaygttttttygtattttttttagattagtttyggttttatygtttaggagagggttygtttgaggatttttgtttgtgtygygygtggttagtttyggtttttttattttatggttggtttttagttttttagagyggatatttttttttagggatgtagggygaggaagggygggtggagttgygaatttayggggatttggaggattttttggttttttggagaggggtattatgagagggatttatgggatatagatttgggggattgggtaattttattttttttggtaattataaaaattttgagtaaaygtgtttattygttatttygtagaaatatataatgtaggtttatataggtatttttgygaggttttttagttaagggygtagygtttttyggaagtttttggttttgttattagggygttatyggttttttygtattggggatatttygtttgggttttgygtagtygttgtatttaaggttttgggagtttygygtttttttttaggygttygggataaagtgttygagggtttygtagaygtttagttttgttyggggtttayggtygtyggggttttttaayggatygtygagggttaygttttgttggggtgtgagygaygatttttttttygttttatgaggttygttattagttaggtgttttatgagaygtygtggygagtayggttatttggtagttygttygggtagttttaatttaattttttgtttttyggggtatttttttttygaatagtttttttyggtttttttagttttgtttaaggggtttggaaatgttygtagttttaagaaaggttttatttaagtataggatggggtggggygggyggggttaagattgttttggggattgaatttattttygtttttagygattttyggyggataaagygtaagtttgtgtatayggtygattgagttattggaaatttagtttaygaatygtagttagggaaaygggagtttgtttagttgtttttgyggaggggtgtgyggaaaygttygygatgggaattttttgtagattatgtatggagggagtttataaaaaggaggaaggggagygyggtggggaggaggtygygtgggygtggaaggttttagggttttgggggtgttygtttgtttaggygtagggaatggygyggagttggttggggaaggagtygattaygtttygtaggttaattggtttaagaaattttgtaagygttggaaaaggtygttgaaggagttygttgtaygygtaygtatatatatatatatatatataaaattttaaaaaaaaaaaaaaaaaaaaaaaaaaaagagygtygagtatgygtatagagaggatgttatattggaatgagttgtagtgggagtyggaggatyggagygggygygygagggaggyggygggyggggagygagygggtaagggygggygagygagtaagygagygaggtyggtgttttttygggyggygatyggggtttgggtttaygtygagggtaggaygaattttattaggtaggaygtygygtyggttgttgttttyggygtttaggttggtyggagagtagtttttyggttygtaggttgagtgygttggttaggggttttttttagtttaggaaaaaaaaggaaaaaaaaaaaaaggaaggaagtttgagggagttggggttggaggtggygggtgggggaaggttggggagggtgtaggggagygaaagagaagggtaggagaagaaagygattgtatttgagygaagttttaaatttttttgtgygttttaggttgttatttttgtttttygggtttttttygtttgygttttygggttyggaaaagtygagtygtgygggagttygttyggagttgtaaagtgtttttttttttygggygtagtttgttttttttygtygtttatttttttygtttttgtatttattttagygaygtagtygtygttgttatttatttygygttttygygtttttttygygttggggtttttttttttttttggtttgggtgggagaaaaagatggtgaggayggggaatyggagatyggtatgggggtaaaaatygtgtagatattyggaatygtttttttggaaatatttgtttgagtaattgaaataaaattggtagtagtagttttggagygtgttttagygaggatggtttttttgtttattattttttttttaaagtaatattttgttatttaggggtttttyggttgtttttttttattygatttttttttaaaattgttgatttgagttggttttggagtttattttttaatatgygtgygtgggtatgtgtatgtgtgtgtatgttttgtagaaattygttaaaatgtaattgtaggaattgygagatgtatttattgattttgattaggggyggtgggaaggggttggagggagttgggggattttggagggtgggaagtggttgattttyggtggtyggatatttatttagagtttgattygtattygtgtttttttggaagygttataattgyggggaaggagtttttagaaatygtgttagttttaatatggygggttaaggtggtttttaaaaattgaaaataaaggttttgaggtgggaaaaaatttagttgaagtttttattttttagtttygattttttttggttattttaggaagygttttagygaattaagtggggaaaaaaagaaggaatgggttgttyggtttttttttttygtggttagagtttgtgtgttaagtttattgttaggggggaaagggatggagaagtgtttttggttyggattagggtatygaaaygtaattgtygtgtgtgtttgtggattagtgtgtaggtttgygtgtgygtagtttttttgggtgtgtgtgttaaagagaattatttygaatgtgtgtgtgygttttggaattagattttgttatgatttgaygtgataaattgyggataygtggtgtaaagtatatgagggtagagggagtgatttattttgtttttttaggagaygagttagttttygttttgtgtgtgttggattttgygygggtagattttygagtaggtggggygaggaggtgtttattaaaaggattaattgtttygggtattgggtgtaatygggttgtagaygttagtyggatttygtgtgtgtagggggygygttgtatttaatagtgggtttttgtttttttttaygtygttttggggtgggaggtgggggatygggatygaagtttggagaagattaaagtggtggtggtggtggtggggtggggtagaagggygggagygygyggttttgggagataagtaygtagggtygaggygaggggttgttttttttatttttgggtttygygttttagggaaggtgggggatggggatagygtttggggaagaaattgttttttgttyggtttaggaattttttyggygtatyggagaggggtatttttttgttttggygggtatggaggtygggtagtygtygggggatgtgagtgggyggygaagtgygggggaaaggtyggygttttagggyggggaggatttgggagtggagttyggagataaaatyggggttaggtagaggagttagagggaaagttagtaaaygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtygtgttgttagtgggtgggggtygggagtaagyggtattggtttggagatttygyggtaggtgattttttttatttgggtagygaggttgaaygatggygataygtyggttaggaygygttygtggtttttttagtttgygtttgggygygttttttyggggtyggtttttttatgggtttygygaggtggggagtagtttaaaatggttttgtgttgygaagttgtagttttagtygygaatttttttttttgtttttttgaygtygtygttgataagygtaatttgttttaaggtttygaaattygygattttgtaygaggtygtgtygtggaagyggatgtatagttgattataaagaatattttatagggttttygaagggtttaagtttttttttttggtggggaggagggaggagtygagattgggtaggagttyggtygattatygttttggtatttaggggttyggggygtattagtagttggggttggggatttggatgygygaaaagtygagggagttttyggggaygyggatggggattattyggggtaatagttayggatatyggtgttygtggttgatggygtttgtggtgttygagaatttygggaygaygttggaaagtttgggagatygtttttaaatttttggagattagttygtagtttygttttyggaatttttaggatttttgggtttttaaagttgggtgggattttaagaaggtaaggygaggttygtggttttgaygatyggtygttygatttttygtttattttagttttttttattttgtttttttgaattttgtygaatygagtygggtttggggtttyggggtttygygtattaattttagtygygttttgagggttttygtagtatagtygyggttgattygaggttattggtgggaaattaatttagaygaggtygattttttttggatttggttyggttgtygt

SEQ ID NO: 6954 - DNA, 5964 bp, synthetic construct; identical to SEQ ID NO: 6953
  misc_feature 1..5964: note = Description of Artificial Sequence: Synthetic polynucleotide
  source 1..5964: mol_type = other DNA

SEQ ID NO: 6955 - DNA, 5964 bp, synthetic construct; identical to SEQ ID NO: 6953
  misc_feature 1..5964: note = Description of Artificial Sequence: Synthetic polynucleotide
  source 1..5964: mol_type = other DNA

SEQ ID NO: 6956 - DNA, 703 bp, synthetic construct
  misc_feature 1..703: note = Description of Artificial Sequence: Synthetic polynucleotide
  source 1..703: mol_type = other DNA
ygtttggggattttygtgttgggtatttygtaygttttggaygygygtagttttatygggagygaattttgtttygtttgygggtgttayggagaggggttgggaagtygagttagttttggyggygattgggggygtttttggttttttgggggggygggggygygtattgttgtttaggatygggyggygggyggtggyggyggyggtggygygyggtggtygtttagtattygatttagtagygygtyggggattggttyggggygygttgggygtattatgyggygggtygggygygggygaggggygggtyggyggyggggtttattggygtygggttaggttyggygygagaggygygagygggttatgggttgaygtygagggtttgyggygggggyggyggyggggayggggygggggttygttagttgygggygttaaggtygtttagtaggttaagggttttygttygggygaatgggaygttygtttyggggtattagtygtttgtagttagaagtttttyggattttttggaagygtaaaaaataaaaggtaatgtgtttttgtttttyggtygyggtggtagggaggygattgayggtagtttttygtttttygtgtttttaygttgggtyggggaaaagggaygygtygttgtttttttattgggggtttggagtygtttatttygygt

SEQ ID NO: 6957 - DNA, 1315 bp, synthetic construct
  misc_feature 1..1315: note = Description of Artificial Sequence: Synthetic polynucleotide
  source 1..1315: mol_type = other DNA
ygtgggygttygggggattygygggtattygggaygaggygagggygtagaaaatttggagtttaattagtayggagttgagttttygygttttaatttttaggtgatttygtgyggyggyggyggtagtagtagtggtagyggygatyggagttygtagtagtttygagygttttygggaggataggyggygagttyggygaatygttatttgttagtygatygyggygtttygygggtyggggtygggagttyggggygagttygaaygyggtttttttttygttygtygyggagattttgtygggtgggttgygggygtttttygttgtygtttgtgaaygttgtgggtgygyggggttgyggttayggyggyggtggyggyggyggygggagtygygagtyggggtygttygggttgtgtttygtttyggtagtagyggtggyggyggygtttgtggtttaggatgyggtyggggggygtattgttygttttgttygttagtttgttgttgttgttgttgttgtgtttgttttggtgttyggtagaygygttyggtygygttaggtaatttatttattygtyggtygygtttygygtygygygtttygtttggygttttyggatttttaagtygtttatygttttttttygggygyggagatttttggtygyggyggggagtagtttaygggyggygayggtttgagagtggagtgggggagggggtygtagggaggygatttttygatyggtggayggyggttggggagtagagggatyggttagggttgygggggttttagygygtatygttgtgggygaggtagttgtggagygggatttgtygtygggtttygtattaggattttatgttttttattttggtttttgttgttttttttttttygttttaaggtttttttaattttggggttggggatttggtttgggagtyggggagtgygagatttttttgttaggtaaggagygygatttttagttttttagttaatagttttyggyggggtgtagtaatttaagtttttttttyggttgtgtaggattttggtggaggaaagtagggaggttatttayggtattttygtagygttgaggaygtttyggagttyggygatygyggtatygygygttattaataggtatagyggygtttagygygggyggattggggttygggagttgygagtygggtatggggygyggttgtatyggtttggattygttgggagtaggtaggttgggayggygygagtgagtgtaagagtgtgygtgtgtttgaagagggygygg

SEQ ID NO: 6958 - DNA, 1316 bp, synthetic construct
  misc_feature 1..1316: note = Description of Artificial Sequence: Synthetic polynucleotide
  source 1..1316: mol_type = other DNA
yggggtttttygaggtygtttygtygtttaggatggagtaggtttggtttttggaagggygygygggttgtttggggaygggggygttttttttygygtttygyggtttttttttttttattgtaggtagygygygtttgtagygttttgggatygaattgatgtttttgggaaaygaaattaaatttttttgaagtttttagttygggttttttttgtttttygttattyggygtggtttagttygggygyggaaygagggyggggtygtggttatygyggyggaaaygattygggtygggggygggyggygaggataagggggttttgtgyggtattygtttagtttgygttttggggattgyggtygggyggyggggttggaygggagtggayggggttgggygygggttgggygygttgggtyggttaggyggygygttgatygyggttttygtgygtttygtaggyggggagttygtatygtygygttygggtygygagtgatgataatttaagaggtyggygygggygggygtgagyggyggaggagtygggygyggygataygyggttatggagygggagtyggyggggatygaggagttygggttttygggayggyggaggygtygagagggtaggaygygtayggtgygttttaatttgttgtygttttygggygtygaggattttgyggttggygyggttaagggygagyggygayggyggygygggtgtgtttagtatttggtygataatyggtttaagattattaagtataygttgttgttttttttgtttaagaatttgttygagtagttttatygttyggttaaygtgtattttgtttttatygygttgtttaatttygtgtyggyggtgaaygttttttagttyggtttggtattggygtyggtgttttttattttggttattayggtttttagggatttgtgggaggattatagtygttatygtttygattataagattaattatttgggttgtttggtttttagtaggtgagttgggygggygggygagygagygygyggtggygtagggtagggygtttygggaatttggtgttgggtatagtgattggtaggggttgggtgtttagaaggtagttttatttagggtggagggttyggttgygygggattyggtgtygatygaagttatagygtygttaaggtttttttgtgttttygtygtagttaaaggggygttttggatgyggggaygygtggggattttttgttatttygtgtyggggttagaatgattttaaggttagaaatygayggtygt

SEQ ID NO: 6959 - DNA, 1110 bp, synthetic construct
  misc_feature 1..1110: note = Description of Artificial Sequence: Synthetic polynucleotide
  source 1..1110: mol_type = other DNA
ygtttatttyggttyggagygtggttaggagagtyggtatygtagaaagygttgygggaagygggttttttttygtttattyggatttaygatttttagtaggtttagtttatttttttgatttatgtttttttatgtgtttttttygggaaggggygaggagggttagttggagtaattygggagaagtttgggaggattggtaggtttttttygtttttttttattggtttttyggaagtagagaaaaatggaagtygaggtagagttaggaaaaggygtaaaggggtagggttttyggygttaggagaggagtagagggtgggtaggygaygaggggaggaggtgygaggttagagatttttgtagtggaggygtygggagaattygaggtyggtgttttgttyggyggtttataaaggaaggagaaggygtygygttttygttatttgtgyggyggtttygagygttttygygggagttaygttttttagtagttttatttggattttttgygttatygtygtygtygttgtgggaggygatttggatatgtttttttggattattggygaaaagtyggttyggagygaagtagttagttttyggyggygggttttttttttttygttttygttttttygygttttgatyggttttgggggtygtttagggtttaggttyggtygttttyggygtagygtttygtagygtttygggattyggygttttgttgttaggygtttagtgygygggayggggtyggggtatygggygaagygagtygttygggaggygggaygygggggygyggttgyggtgtttgggagaggggagtttttagyggggtagtyggggtygggagagygggygtagygyggyggggatyggagtygygggygtygggaaaggttttygttaggaggggagggaatttygggagygygagttagggggaggygygtyggaaagygagagtgataagtagtttataagtygaaaagtttttygygggaggygygygtygygtgggtttygatttagtygttgygygtygtygtggtatataggttgaaaagtttgygaagttatagaagttaggttyggygt

SEQ ID NO: 6960 - DNA, 1655 bp, synthetic construct
  misc_feature 1..1655: note = Description of Artificial Sequence: Synthetic polynucleotide
  source 1..1655: mol_type = other DNA
ygggttttttatyggygaattgaaattggttygtgaagaagtggtaaagtaatataatttttgtagyggttaggtyggttttygggaatttygttatgtygtygtygttatttttttattttattygttagtttttygtyggtgttygggggttttygatgtaataggtaygatygggttaaaygttgyggatyggtttyggtaggattyggaggtttttgtaaatgtygttgygattttatagtagggaatygagaagaggaagaagygaaygygagtaggagygtagygtttttyggatttttgaggttttttttgtaatttgttatattygtagtttttattygatattgaataataatygyggggaggagaggttatttgtagtygaggttygtaaattgtyggttttattygggtagygttaattyggtgttygyggayggtgattttygagttttagygatgygttttattgggtttaaaatagatttaattttatagttagygtygttgtttgttttagatttattagggttggtyggttttgtaggaatttttttttgtttagggatggtttyggtaggaggtttaggtttgygggaaggaggttgatgaygaaattttttygataagttttgtttttttttttygttygaygtagggygygygttttttttygtagtyggaggaatgggtagttttaaagagttgagttttgggaaggttagggttgtagtagtttgaggttygaagttaggaaaaaaatgtgtttaaaaaaaaaaaaaaaaaagaggaagaagaaaggaaaagggtggagtgggagggagttaygttggaatttatygggagagggttttttygggtttaggaggaggtggttttaagttttygyggagttttaggagtttggtggyggaggaggygttgtygtygttaygttttttygygttttttttttatattttgaggagggaaggtagttygtaatttgttagatttgtygtygtatttttttttttttttttttygttttttttttygtttttttaggttttttttatttttttttttgaaatyggtagttygtatagatttgtttaatggttgtatttttttyggggttggttgaggagtygyggttaatagattaagtygggggagtttagygaaggggagggagagggttattttagtttygtgygttttaggtagtyggttgttttagagygyggggagaggggataggtyggggagttatygggggagygyggggyggtattttygygtygtyggggygttattttygtagtttgttygtaygttttgggtagtttygttaattgygttttatatttatttggttttygggtygttttygygttygattgyggggggygatygygtttygtttygattttggyggggtttttttgggtaygaaagggttaattatagttygttttttygyggaggttggttttggtagtggttagggagtggagaaagtaaattagagtyggttyggttatygattttgygaagttttttygattttagtttagygygggagggtggyggaaggtggtgtatygtagygtggttttygtygttgtygtygyggttttgtaaagtgttagygggggygaaagyga

SEQ ID NO: 6961 - DNA, 1655 bp, synthetic construct; identical to SEQ ID NO: 6960
  misc_feature 1..1655: note = Description of Artificial Sequence: Synthetic polynucleotide
  source 1..1655: mol_type = other DNA

SEQ ID NO: 6962 - DNA, 304 bp, synthetic construct
  misc_feature 1..304: note = Description of Artificial Sequence: Synthetic polynucleotide
  source 1..304: mol_type = other DNA
ygyggtgggtagggttttaggaggtagttttygttyggygatagttttyggggygtaatttttygtaggaygygtatttgttaggatagttattaagaggatgyggaggttgggggttttttyggggataaaattagggtattttaaggaattttttgygygtttaggtttgtttgtgaagttggtaggyggaggataatgggagtaggggtaggtttttagaggygagttygtttttattttttttatttgttttttatttttgygtyggtygtatttatttygttttttttttagygttygt

SEQ ID NO: 6963 - DNA, 1666 bp, synthetic construct
  misc_feature 1..1666: note = Description of Artificial Sequence: Synthetic polynucleotide
  source 1..1666: mol_type = other DNA
ygaaatygygygagtggtaggagtaggttaggtyggaggttttttttyggtttttaattyggyggtttgttttttttttttyggggygtttgtatagtagatatttgtagtaygggyggtygttygggttttygatataaggygttggtatttgagtttttgattggtaatgtattataaatygttttttttaggtttttttagagtaggagtayggaggttatygtgtttataaatttttttgtgttygttaygttttttgggttttgggygttygggtttttagtygtagagtaygtttgttygtgggaattttaatatttgtgtttygygaggtyggyggggygggggygggggattgggattattttgtttttttttagttyggtttttttygttttgttygtygttggtttatagagygtagygagtggaaygaattgggtgygtygtttttagaygttggyggaaattaaatgatgaggygaggtgggatattygtttttygtttygyggtygaygtttagtttayggtaaaggtattatayggtgtttygtttygyggygaygygagyggygggatgattyggtttgggttttggygtagttaaaggttyggttygttggggygygattttagttyggygygtatagtttttygagttttaggttggattgggtgyggttgtatttgtggagtgggtggttyggtgattgttattygggttagtgttgttagtagatgtgtatattttgggygggggttggyggtygagtgttattagtaggggyggyggttaggtagttattygtygttttttaagttyggygttgygygtagggtttggagtattyggtgttgagaygygaatgygtataaagagaaaagtgtttttagtgtttttttaaaatggggaatagggaagaaggataagtattatgtaagattgttattgttatttgttttttgyggattatgttgttttttttttygttggtttggttttgagtattgaaagtyggggagagggygtyggttttagagttagtygtattyggggatygtaggyggygttggttygggttatttaagttyggtagatgagtttttggtttgygggggatygggtyggaggttagggggayggtagtgtygtyggagggagygygtagtttaaggtyggtgtttyggtttygygygttttttttygggttygtagggaattygggttatttggggagtygggttttgtyggttaygttggtttttygyggttttagaattaattaaaygttttttttggttaagggaagttttgygtyggaygggggtgggggygtgtgggggyggtatgtgggtatyggaataattagttttatttttgygtttttatagaattygyggygtagygagaagtgaatagyggtygtttgaatggyggttttaaaaggygatatttgtaagygyggtyggttgtgaattgaattgagttaaatgyggygttygttygtatttgagtygygagttattagtgttaggygygttyggtygttygggyggggaagygygyggttaggtygttygygttgaatgyggtaagttgyggygyggtygttttatgggaatgtygttatttgtgttgttagyggtygggagggggtgygt

SEQ ID NO: 6964 - DNA, 5030 bp, synthetic construct
  misc_feature 1..5030: note = Description of Artificial Sequence: Synthetic polynucleotide
  source 1..5030: mol_type = other DNA
ygygttatagtggtttttttygtttagttaygygtagtgaaattttyggtaatygggttagttaagataygggatttgtatygtagttttttagtttttggagtyggagtygagygttttyggtagtttttttaattttttttttaaagtgygaagggaaaagtttygtttgttttaygattgtaaggtyggyggatttgggagtygygttyggtttyggaggattyggygggttyggggtttttyggtagyggtttttttgttaggggttaatagtagttttygyggtygggygggygyggaygttttttttttattygttygggaaygtggatatygygttygtaggatgttygtyggttgggatyggtagttaggaaatatgagaaggtttygttatttttgttttygggyggygygygtygggttgggtaaataaagtygagaygayggyggtggyggtggtgagygygttggagttygygtggagaatatgyggyggggatgggagtgygtttagtttygaggygggagagttagtygttttgtagtyggtygtyggtttygtagttataggtatagttttygygtygtygagttttagtyggttgyggyggaaygttaggttygttttggtttttgygttttgggygtyggtgttttttygttttttttttaatttttttttaaggtttggtggagaggygttygggtagyggttaaggttggtttaagggtttgygyggagtttgggagtttatttggtygygttttttttgttttaaaattattygtyggygttgggggagggggatatttttgtagggagtgattttttyggttatagtttggagtgaatyggggtaagtgatttgagaagaggygygggtggtygygygygggagttttgggagggttagtaagtgtggtttataygttttyggattttttgygataggatagygttyggatttttgttatygtttgtttttgagtttgttgtttgtagatttatagygygtygggtgtttgtgtttgygatttttgygtgggtttggggttgtyggggaagtgttygaggtggttaatttygtgatgatttygttaggaaaaataygtygtygtatttaggaggaygygttggggtggttyggagaaggtygggtyggggaagggtgttttgtataaataaagtagtatgaatatatatttttaagggtatgattttaaaagaaaatattaaygygagttttgattgtagaataggggttgtaagtaygaaaattttttttgatatttattatygaggttatgtgtatattttaggtaygtatttgtttgygygggaggaygtagttttaggggatataygatatttagtagaggtttgattttatttttttaygaatatagatygtagtygtygtttgatygyggtggttaygygtggttttaaatgttaygygtggtttttgttgyggtggtygaagggyggggygggggygttggygagtgtgggygtttggygaggtaaagggtgtgtgtgtgtgtgtgtgtgtgtgtgtgtgtgtatgygygygygygtgtgttagtggagtagtagtttatgtygyggttggaygggtaaagggggygttggtagygaagttgaggtygttyggaggaaaygggagttgtttygaggygygaggygaggagatggggygggygaagttygtygygygttttggggttgtaattttgyggtttygyggtygygyggatttgtttttgaygtyggtgygyggtaggtagaggtttagggttttygygattttagaggtgagttgttggtttttttygatagtggtagtagtggttygggaggtgygtygattaagttgttttttgttttgggtttttgatatttttatagtttttgaaagggttttyggagattttagagagaggygggtgtygaggggttaygagttygyggttgatattygygttgyggaagagaatggtattgattgagggttttggggatttgggttttggygttttggattttaggattatgtatttttyggggygygttgggggatgataggaagattttgggagagaagggggagaagtggtgttttygttttgaygttatttaatttttttttgtttttgaatttaattttatttygggggattttggyggatagaagatgygggggttttaattaaattatttaygatttagaaaataygaaaattttttaaatttyggtatggtttgggatttatgagttggggggttttgtggatayggttggtatattattttaaatttttttttttatttaattttttttgaygtttygagttggggtttttagaggttttagttttttgttgtgattgaagaattaygygyggttttaygtyggtygygtttygtagttyggagtatgttttttttagatttaaattgaaatttagaggttygtttgggaattygttttttttgtttttgygggtgaatgattttyggttgtagttttggggagtgaagggattggggggatygatygtttaggtaaggaagagggtaggtatttgttyggggaatttgtaggggygggggygtgtagttaattggggagagtygtagggtttttgttagttgyggyggygtygttttttttttyggtttygtagttyggygattyggttaagtttaaggttttgaatttgtaggggtttgagtatttttagttagtaagtaaygagatgtattttttttttttagaagtygagtttygttgyggagttttyggyggtttagtttygaggttttgyggtygygtygygygtttttattaatygatattatgaatattatygtttttaataagtttagyggtgyggtgttgtttgaggayggaggygtttyggagygggagyggggtggtyggttttatagyggtgttttggatagtttttaygttygtttygaggtgggtattttygayggttygttttttaaggataatttyggtttgagatatyggaggatygggtatgygtatttttttgggggttttgttygtttgyggttyggaggggtgggggtggtgagttgtgayggggtttygtggtaaygygggygggtggaygggaaagggttyggagttttttgggagtgtaggtttgtttttttagggttygygtatttttatgttaaggggtttttattttaaaatatgagggattaattygtyggggtagttttaaagagtttggtggagattaagggygttaggagttgtttttyggtttttygttgtttggatttyggagttgggggttatttgttttttttyggattgtgggtgtyggtgygyggttgagggygaggaaaaaggattgagttyggtgtagagaaataggygaagtygagtagtyggggagtttaggtttaggtttygyggattttttttyggttattygagtttttygttagagtttygyggttygtttggtttaaggagtygggaaggtygtttttygttagggagtttygggygtgagygyggttyggttgggttygyggygaattyggagggggaggtttygggtttgyggggtygggtttgagtttagyggggtgaggggtatgttggggggggyggtagtttgygggtgggttagttgtttagattgtyggtgagtggagggtaggttttgtttggttygattyggyggtttttygggygtttygtyggggaggggyggtygttttagtygtttttatttgaaygattgtattagttgtttgttttgyggygtygttgtttagtaaaatagagattyggtttygttaaaatgttattattagtygtttygggtggaattgtattttaaagtgtttaaagaggtagaaatttaggaggtttyggygtaggygygtaagtttyggggagyggttgggttygttggyggtygygygygatatttttyggattygtgagggagygtagygttttaggttaygttttaggtttttggttgtttttgttttttttttttttgaatgtgttttttttgaggtttttttattttatatgatgggatagagtttgtygtatttttaatttttttttagtygggaaayggttygayggtgtttttgggttttgtagtttttttttataaattattaatttttttagaaagtttttttttttttttaaaagattaaaggaaatagtttaaagagagtyggggyggtaatgtttttttgttttattttttatgtttagtyggygattttttttttgattataagygayggaaagtttttgggagtagataagagattttygagggaagtttygagagttagtygtatattttgttaggtttgttaggttagggttattygagggtgyggygttagygggtgagggaagggtagtagttagtttygttgtttagataygygattggaatagtagtattttttaaattatttgattttygttttttaaatttttaattttggggtattgggtttaaggtatttttttatttaagataaatttatygaaatgatttttttatttagaaattgtgtggtttttattttttgttttttttaaatattttgggygygygtaaagtaggggygtaaggtaggaatgygtagtttggatgyggggttygggtttggtyggggygtggagygttygggygggtaaaygygtygtttattagggtygttttttttttttatgttttagygttyggtagaatggygggaaggtgaggtataagyggtaggttttgtaagatatggygygattttttaagtagtggttttataagtatygtgataattygtattttattaagatygagaagatatttttggttttyggttygtagatgaygttagtgtaggtaattaggatttattaatattttgattygttttttygygaggggttgaagagygggaaygtttagagttygtgtggttttttaygtggygt

SEQ ID NO: 6965 - DNA, 2868 bp, synthetic construct
  misc_feature 1..2868: note = Description of Artificial Sequence: Synthetic polynucleotide
  source 1..2868: mol_type = other DNA
ygygtttygtattttagaggggagggagaaagggagtttaggygyggggggtggggttgggggagtaygagagagtttttttttaaataygtattttttygttttttygaygttgtagyggttttattatagaygtatttattgttttttttttaaaagtygttttaaaaataaygtaggaattaaagygagtttttyggttygaaatgtaygtgtaattttttatatagtttgggttgyggtyggyggtagggtygttgtygtttattattatataaataggtatyggggyggygtaggygggggttgttttttttgygttttygtygttttygggyggataagtttygtttttttygttataggaattgtttagataataataattagtagatatttygttgttgtaygagagggagagaaagtatagtatygtttygagataattagaaatataattaatttataaygtttttttaaattggaaaaggygattgtgtaattattattatatgtttaggtttygatttttygggttgtttttttttttttttaatttttaygttaggtagaggggtgtgtgttttttttggtatagtagtataaattaataaatattgtagttgyggtgtaagtagtagtttygygygttygtyggttygttygtttttttttttattttttttttattygagatttagagygttatttaagttttattattyggttttagygtttygtgygttyggtttaggtaataatttttttaaaaatygaaagagaaaagygygaggygtaygtatatyggtttatttyggygtagagatttygtttgtttygggagggggatttgtttgtggtgtttttyggtttttaagtttaggtaataatttygtaaatatattygtygtttagttygtttttattygygyggttttyggyggygttaagtgggtattttttttgttttgtttttygygtygtttygtygygtttygttaaaygtggattttattygyggggttygtygyggagtttttaggtyggggttttgggtygggtagygggaggygttagggaggaggggygtttagggattygygttttygygtttttaattttygttaygygagygygttyggttygygggttttaattttatygtygtyggtygaattttgttygttygyggygygtatagtyggygttygygtataygygygtataaattttaygtaattygyggtygtttygtttygtygtygtygtagttygtttgtygygygtttatagttyggttygagtygyggggttygagygatagygayggygtyggtyggggtygyggygygyggaagttattttgtayggttagygtygggtataagtttgtttygyggttttygggggtttgggygttgagggagaatygygttgagggggttaggaggagggggagagggaggygtygaagggtataagagtggggaaaagtgyggaaagaagtaatagtygttttattygggattagaaaagtggttagtgygtttyggtygttygttttgygtyggggatgyggyggygtyggygtyggttaayggtttagggaggyggtaggggyggygggagtygttaggyggagagagattaggtaagagatataayggtttagggagagygagyggtygyggygyggtttyggtagyggyggtagyggaggggggtagagagtattattttttatttttttattttattttgtygtttttgtttyggttgtttttagttyggttygttttttttattttygggggygtttyggttgtttagttttttttgatttygtygtttttyggtttttttygttatttatygttattgygtygygggttygtttgttttttgygtttatatttggggttattygttatgattttttygtttgtgtttaaatgttygagttattttttttttttttttttttttttttttttattttttygtttttattttttttttttttttatygtatttggtttaygatattttyggttttaygatattattttttttatatttagaggttttygttttayggtyggaattttgttgttagggatygggyggtttgyggtaatygtgggtattgttgaatttgaattgaggggygagggaaaagttttttttaggtgtggtggggagagggaggyggatgtygggaaatygtagggaygyggttagaaaggygaygggttgtyggagttggaaaggtaaagttggaggttyggyggygttttgttttygygttggttatattygtygyggttgttyggggtagggagggatttggttgattttttttgtattttgtgttttyggagttgttttttygagygtttagaggttttygtttgtttgttttttggaggtagggttattattagttttaygtttygygtgttygtttttygtatttyggggttaaggaaagggatygyggtttggatttttyggggagtttttttgatgaggggaagggtaggtttggggayggygaggataygyggygatyggagagaggttatttgattygygtagttyggatttttttttttttttttttagggaygtttggtttttttttaagygaatygggatgggaagtgattttaatgagattgaattttagttggattgaaagagaggttagaagtttygtttgttagtagtttttttagtagagyggaatgagtaatatttatayggtgtttgttttatttttttattygtattyggtttttatttgttgttatttyggttttttatattyggttygygtttttygttttttttttygygtagaatygt

SEQ ID NO: 6966 - DNA, 2678 bp, synthetic construct
  misc_feature 1..2678: note = Description of Artificial Sequence: Synthetic polynucleotide
  source 1..2678: mol_type = other DNA
ygagaggygatggygtttgttttggttagatttaagggtaagygaggttgygygyggttttygtagggtyggattttygagttttagggygtttttttattygggtgtagatttttygyggattttttygttttttygggttttattagttgygtaggaatggagttggttagagttttgggagyggggagggaggygtygttattagagggygtyggagttttagygttgyggtyggtgagyggttaggtttttyggtttagtttagtaaaggtttggggaygttygayggttgttttttttattggattttattgtttttagttttttaagagtagggttaagttagtggggttttyggttttaagtttagtgtttagggtgggtgggtgggtgggtgggtgggtggatggatggatggatggatggatggagtgtyggtttatagttatttaayggttaaagtggttttggaaaaaaaatgtatagaagatatttatttttattagyggagtttyggagttttygtagttttttgttgatygttttygtttaatgtagtygttgatygtttatttttygayggttaggattttttagggatagggaygtgtttttagggtaggtttttggatggaygyggygattgattttatttygttggaygttgtgttgggaaggatatagagaggtggttggggtagtttgyggttataaagygaggtttaaaggggygttttttttatttttaygttttttgggtgtygatttgtatttttttttygttatyggattggggttatttgggatgtttygggggtattyggagggttaagtatygtygagggayggtttygtgggaagagttttttggatttagaaggtagaygttagtagtattgttttaggagtyggaggtyggggtgggggagtttttagttttttgggtygtayggagttttttttgggtaaggtagtaagtatttaggtttaaaggatttatttatagttattatttattgagtattgtttgtttgttagataygatgtagagaatttygyggygtggggygggttttattgaatttttygttttatttygyggggtgggtttgtgattagtttattttattattgagaggtyggaagtataaaggttatattygtttttattgagagtygtyggygttttttgttttgtttgtataggygaggaaattgaggttyggttggtggygtygtgggtttggagttygagttaygttgattgtaaagaygggttttattttygtagatygagttttgtyggyggttgygtygtaagtygggtaggtggygagtttgagtttttaygtatagaaagtaggattttttyggttgttttgggtygttatygttagtaggtttttygttygggattaatttgtttgttttttattggtttttatttagttttygttatygaaaggtttygtttygtagttttttaygygygttttattttaygtttaaggtttttagtttttttagtggggttttgttatagggataataagyggttttttagtyggygtygtttaggttgyggattttattgtagatygggttagyggtgyggggtttagyggagtttgagaaggttaaaggtyggagygtattgygtttygggagtatagagggagyggaggaggggygaaggggatgggtggggggtgtygtygagggagtygygygttagagatttyggttayggttagtattyggtttygggttygttttttatygygygtttygtttygtttygtttggtttttttttttaaagygttyggygygygttttttatygtygtatttttatttttygttagtygtattgttygttyggygttyggttttygattygygttygttygttygttygttygttygttygtgttatgaaygttaaggtygtggtygtgttggttttygtgttgatygygttttgttttagygayggtaagtgygttyggyggggaggttttggygaggttttgggtttyggttttygttyggygtagagtygyggtttttttgtttgygttygtagtttgygtygttygatatagtgggggtggaggtagttygtttagttgggygttttggtgyggtgtygygtttaaagttttatttttgygtygagggtttgtgatttgtagagagygatygtttgattttaagttggttgtagagygaggttagtygggataattgggtaggaaygttttaagagagygttygggattggygygggaaggygygagggtggggagtygyggattttagatttttgtttgtttattttttatttattgttttttygttgygggttyggtttttataggygaatgggtttygaggttttgttgygtatagtgttggaggtygggyggtgtatggygagagygygttttgtaaagttygttttatgtygygatttgaggttgtgaggttygatgtagtygygtagttttygttttttgygaagtygattttttttttatattttygyggggtttttggttaggygygggygggttgygyggygtagttgtygggtttgtgttattygttaggtygygtttttgtatagtttygyggttygtagygaygyggatttgggygygygtttagtygt

SEQ ID NO: 6967 - DNA, 2756 bp, synthetic construct
  misc_feature 1..2756: note = Description of Artificial Sequence: Synthetic polynucleotide
  source 1..2756: mol_type = other DNA
ygttttygtaygtattaaaagggttaggygggttgygaggttygtygttttggttagatataggaygtttaygtaggygtatygtatygtatagattttgyggtggtttattaagtagtatatygygttyggaaygggagygygttaggaggtttaygttgyggagtagtagtaagaygggagtatagagtaggttggttagttttatgttaaggttgagttgtttaaagtttagygagtgtataatgtggtttgttattatgggttygagygygtaggttatygaataggagatgtyggygatggygtagaygttgttatagattgagatatggygtaygtttattaggaaggygagygtgggtagtagtgttgtgtygattagggttatgttaaaatagaggtygtatagtgagattattagyggygygaaggagyggtaggygggtaygatgtaygagttggygtygattatagttagtttaagygygtygtatagttattgtaggtgtgggtagygygtygttaggygtayggtgaggtagaygtttagtatatgaggtaygaaggtyggtagttaggttatgtttattttttattyggaagtygttatygtatgttttatttaygtggtaatggtgggttygaggaaggygaggggaatgttataggtggtgagygygtyggttattayggtaatgtaggggtttagtatgaggyggtggatgggagtgtttattggtaggttggttygagttygtgtagtygtygagaagggtttggttattgttagtagtaatagygygttaaagagygatayggtagttagtattaagaagggtaygygtttgtyggygaatttatagaggatgttttygaagggyggggttattaggttttygaagttaatgaaggttagygttaygtttagtgtaygattgygtttyggttttttygggtatttatyggygattatggttatgttagaygtgtyggygaaggttgagtttaggttttgtaggttgygygtygygaatagygtggygtagttttyggygaaggygaataggattgtagaggygaatatgaygtttaggtygattagtagyggtaygtygtagtttatgyggtygatgaagggttygtttaaggggtttattagtagttgtaggatagttttggaagtaaatagtatttygatttttaygttttygtttttygtagggtagyggggtygaagggttgagttygttggttaygtagttgtyggggaygtygaggtgttggtygtgtaggygttggtattggtyggagtgggtagyggtagggtgggtttttatatttygggagttygggtggggttttygtygttttygygtatgtgggygatgtagtygggtattatgggtaygatgattatgtatagtatgttgtttagtaatagygttaygtataygataataagtattaggygtttttgtygtyggggtttttgtagygtygygtttatagttttygatagtttggtggtygtygttygggtttggttygtaggtttygyggattttatgtttttatttygatgttttttygaggaygttttygttagggtygagygttggygtttygtagtgtagaggygagggtaygggatttyggggaggttgttttggtygagtagatttttttgtgttttaggtggtygyggagtttatggtttagygtttygggaaaggaaaggatttygttyggygaggygttgtagttatttttagtygatttygggattygyggttgttgggtttaggggyggtygggaagtygggygygtygaggggtyggggtyggagattgggygtatttygttyggggygygtttagagtagttttygtygygttaagaggtygttygygttggtygagggatatgttgttgtygttygttygtttgttygttygttagtttygtygttgygttttttttttttygygtyggtttttgtttttttygtygtttttttttttttttttttttttattyggggttgtgaygyggygagttttagttttygagtggtgttygggttatttaygtygtttatgttaatgygaygtyggyggggygggggtygggggyggggygtggtygggtaggggttygttttttagatgttttagggttggaggtttaggaagggttttyggtgtggaagttttgaattagtttttgggatgggygtttygygtyggtagttggttttttgtttttygttttttgtttgtttttygttygyggttttaggattygyggggttagygttygtttttttttttttggggaagggggygyggtagtyggtttttygaggttttttgggagaggygggagttagaggtttgygattttygttttagtttggatttyggygtatagygagtaggaagttttygaggtgagtygtygttgygtttatttgttttygtagttggattgtggagtygygttyggaggagygttggatayggatatttttaatttttttttygatttygttttttggttttttgtatatatattttygttaggaggggaggggaaggtttagtaattgtttggtttggttttgatttatyggttttttygtagaatttttyggtygygaatygyggtygggagtttgtggggattgagggtagaagttgtygygttttagtyggggtygygaatattagtttggtygttgtygttttttygt

SEQ ID NO: 6968 - DNA, 990 bp, synthetic construct; identical to SEQ ID NO: 6738
  misc_feature 1..990: note = Description of Artificial Sequence: Synthetic polynucleotide
  source 1..990: mol_type = other DNA

SEQ ID NO: 6969 - DNA, 829 bp, synthetic construct
  misc_feature 1..829: note = Description of Artificial Sequence: Synthetic polynucleotide
  source 1..829: mol_type = other DNA
ygtagygatttygygtaggtgagggtattggggagttygtggtttttttygttygtyggtttttttttattagtygttagttagggttttyggygtyggggaagttttttatagggttttaggttatttaagygyggttaaaygtyggyggttyggtttygtttatttgaygtagtygygygttygtttygatttattaggygygtagggttygttttygaaattygygygggttttygtagtyggtygygyggtttttagtygygaagagagygtygygtayggtggygtygttatagtygtgggtygtygygtttaggtagygttttagttgttygtaaagtttttgtagygtygtttygtyggggtttaygygygtyggttagagtagygtttatygttygagttttagattttaggtttygtygtygtttaygtttagtttyggyggtagtygtgggaagtagtgttttagaggyggttatagygtygttggttgtyggygygygtygyggaatttygyggtygagagtyggtyggtttagttgggyggggatayggyggtttygggtttgtgttttagttttagtygggttttttygygtygttgyggttgttgygyggtgyggtygtgataagttatagtaaatttgtttttygygtygttttaagttattaggaagygtaatyggtgtttttggggatyggygaagaggttttttyggagyggygtttagttttttaggttgtygggttgttygttttttatggtygtyggyggtagyggttttagggtttggygggygygggtttgatttygtygtatygt

SEQ ID NO: 6970 - DNA, 4119 bp, synthetic construct
  misc_feature 1..4119: note = Description of Artificial Sequence: Synthetic polynucleotide
  source 1..4119: mol_type = other DNA
ygggaaaggtggtagtygaagatttygyggttttttttygtttaggtatttygtttygtttttagtttyggttttgtttttygygttttgttggtygggtattygggygtttaggagttttttttyggggtggygygyggygatygtyggygggtttggtagtagygttagtygyggggyggttygggtaattygttygtttgtyggttygtttaygtgygtagagaggagygaagygygagtagtygtttygttygygtttgttgtyggtgggtgttttatttaaggggtyggygggggtygtaattygagttttatygtagggattygtatttgtataattyggttttttttygttttttyggatttagggttygagatgygagtyggattttttttygaggygtygttttgtttatggttagygygggggtygygggattygttagagygtaggyggagtgggttggygtaygtggtaagaaygtagttatttttttttgtttttttttttttttttttttttttgagaaataggattttgtatatttttgttggggtggggtatttattagggtgttaattttgttgygatttttttttatgttttttttatttttaattggaaaaaagygtatagygygagygagaaatttttttaaatgtgttttgggtgatttaagttagagagatggtyggtygttggatatyggttgttttggagggagggggagaagtagygttttagtggaagagtagagggagagatygttttyggtagttttagggttttgatygyggtgygttgggttyggygagagttggygtayggttgtagyggtygaggtaggtgagyggttgaagattygtttgtagygtygygttttttttayggygtggygtygtggttttygttygtttyggtttatattaagttagggtygtttygggttyggggtgaaaaagggataggataggtttgygaggttgattttgygygttatttttggttttygyggttttggagygggaaagggttttggggtagttygtaatttgtataaaygattatgaatgagttatgtaggyggyggtgygttggatttgggtattygggattagttttttgtggggtttyggataggttyggttatttattgygggttggggygtattgggaggtagaagttttgygtttagtaagttagaatttgttgttatttggattttggaaaagtttttaaaaattgttttgggaaygaaatagaagggtttttatyggggtttygtaaagtaaaaygagtgggttgggggatggggatggygttttgaaagtgattagagatgttttyggtygttattgaggatygygttgggtttatygaggtgttttttggggagggagagaaaatatttattttagtaygtgtattttggttygggtgygggtagggygyggttttggattttgggttatgggggttagggggattttgtggttgtagggatyggtagtgaaggttaggttagtgtttttatagaattttttgtttagygagttyggagttygttttgtygtygggatattgttggtaaygayggygygyggaygtagttaatagggaggtgtgtagtgtaaggtgtgtgagygggtgtgtgaagagggtagygggggygggagtgtgtagyggaagtggagygagtgtgagtgtgtgtgtatgtgtgtttggaggggtagggtgagtgtttaagtttttatttggaygtttttaygtagtygatygtttagaygygtygggaagggygttygtttygygtagtagttgaaggggggyggggagygygygggtagaggaaggagggtgttttyggttgaggatttttttygaagttttttatagtaattttgttttttttagggtttatttttttagttttaaggtgtttaaaatatttaaataaataaataatttaaatttgtttygttttygtttttgtataaatagaatagattttttaaaaaagtaataygtatttatttttattattagttatttttttttattaagtaatttagaaaaaagtagttagttttygtgaatgtatgtagtttttttttttttygttgtttttttttgtttgyggttttgagttgttaagaaagtgagtaggggtttgattgtagtgtttyggtttygttyggttttttttygaagtttaatttttyggaatggtttttaaataagggttagggaggyggagtygtyggtatyggattttygttttttttggaaagttttagagaatyggaattttttttygtttygggaggttgagtygtagtttggagtagttygtttttttgttgtggttgtgattgggtttatggygygttttttttttygygatttttgygtttyggatttaggttgtagttagggtygygygttygggattttagygattttygtygtttgygagttggaagtygygagttyggyggagttygygyggtygagttygtgtatgtaaattagttatgtgayggtaaaagtygtttggtttagttttgttttttagtttatatatgggtagygaygttaygggtattgaagatttgtttataaatatttagagtaatatttttygtttaattgagygaggagtaattgattaatagttyggygaggggatttattgattgttataataatattatattagtaatttttggttttttagtagtyggaatatagataggagagagttagtggtaaatagatattttttttattttttaaaaaatagtaatttgtttgttatttttatttttgttgattttttttttttggtgtgtgtggtggttgtttttaagtgtggagggtaaaaggagatattattttaggtttagtttaatttttttttaaaayggtttttttgatattttaggtagygagggagttgggtttttaggttgtgygaggagtaaatgatgatygttaaggtygtagataaaattttagtaatttttagtggttttgtgtattagttgtttgataatatttattyggtggaggatttygtygttaygtyggtgattattttttttaatgtygaattgggaggtttttttgattagatgaayggagtggtyggaggtaagtygygtgttttygtaggttyggatttgygyggttyggaggtggtggatggggtgtagtgggtgtgygggaatygtaggagaggattggggttttaggtggayggtgttgattgtattggttttgaagattggaagtgggtgtaggaggaatttgygatagttgagattagggygygygggtagatgygttaggtygttagtaaatyggygtgygtgygtttyggygygtttagtttygggygagygtagggatgggggtggaagaggygttttttygggtttygaggtttgygtaggttttttggtyggtagtatttygattttttttttttyggggtaggggtaaagtgayggtaaagttyggggttttyggggagagttgygygtttggagagtygagyggyggagaagygttaggggaaagygtyggtagtttttttttgggtagagtygatttygggaaaatttyggagygttttttttttgyggtttggaggygygtttttatttgttygtygttygygaagttgagggggttagtaaggygggggtttyggtyggyggaggtagygagtgggtggtggaggagggygygtaayggygggaagtagttttyggattgtygagggaggttygygggggtatyggygaygtyggtttttttggygatgttgtggaaagtygtttttygyggttttygygtttttttygaggtygggttattggttttgggttgaggyggggaygygyggttgtygggaaaggyggagaagattgggagggtayggaaatttayggatttttttttttatattttttattygttttagtagttttyggttgaagygtagygggagagggagggagaaaaaggtataaggygtyggggatggggagtagtygggaaattatttatttttttttygggtttttttttyggtttggtattattaygg

SEQ ID NO: 6971 - DNA, 1575 bp, synthetic construct
  misc_feature 1..1575: note = Description of Artificial Sequence: Synthetic polynucleotide
  source 1..1575: mol_type = other DNA
yggtttgggtttttgggygygtttgtygttgygygggygyggggyggttgttatattattttggtygggtttygaaagggaggagtggagtttgttygttttygygagttttygygygtttagtttttttttatttgttyggygtgtttagggygtttttagygttggaagtygggggygtttgttygaggygggagtygttgggttatgtttttgtttattaggtttttygaatttttggtagggtagygtttgttygtgttttygatttttttygtaggtaattygygygaatttggggttygtagagagygagygttygyggatatyggttgaatagtttggaggttgygygagggggygtygyggggagggataaaagttagtaataaagagtatagatttygtttagtagttgattgattygttttaaaatagtygtttttatttgttgtttttygygtttygtttttaggygtagtattygggtttgtagttyggtygttygaaagtgggygagtaggttgagtgttagygagtagagggttagygttagtagttygtaygattttggattyggtagtygtgygtygygtttygttygygtygttattagagttatygtttygggygygtttaattttttagggtygygggtatyggtggttgtygttttgtgggtgygtttygttattattttttygygttttgagaattaataaataaataaatagaataaataaaggygatagtygttgttaaaaggttttatttaaattgyggggtagggggaaagggtttgtatygttggaaaaygttttttttygttgttttyggtaaagaggayggaaaaattagtagtaggagaggaagtgtygaaaaagtataattagyggtaattggggtatatttaggtgagaaaaaagttatttygaagaaygttttaagtttaggaaagttaggggaatttgatyggtttttttttttttygtttagtttttttttttaagtgtttgtagagtagttggtgtygygttgttagtttttttgggygtttygtgtttttygggttagttagttttagttttygggygaaggggygtatayggagggttttatgggtagaggtgggtygtggyggttggygaggagygtaggggtygatttyggygtttttgtaatttgatatattttttgyggyggtayggatyggatgagtaattygtgttattttttaaattaatttttttttttttttttttttttttttttttttttygttattttttttttatttttygyggggtygayggtttggatttgtttatttatgtaaattygtttagggtggggggygtggtgagtaggttyggyggttttagttygtyggttygggagtttttttgtygygtttttygttttttttgaagtgatatttggggttatttataggtaggaagggggtgtggagtggagttggygttgtattttttttttttttttyggatttatatygagggttygtttggttttttayggaggyggtgaggygggtattattttttatggaygygt

SEQ ID NO: 6972 - DNA, 2401 bp, synthetic construct; identical to SEQ ID NO: 6748
  misc_feature 1..2401: note = Description of Artificial Sequence: Synthetic polynucleotide
  source 1..2401: mol_type = other DNA

SEQ ID NO: 6973 - DNA, 1579 bp, synthetic construct
  misc_feature 1..1579: note = Description of Artificial Sequence: Synthetic polynucleotide
  source 1..1579: mol_type = other DNA
yggttyggtgtaygtyggtgttattttygyggttaagtttggggttgatattatgtagtatayggygttatttataatgtatyggtttttttttgttatatataggtaygtatatttattttygygttyggagggagtttagggttyggttygtgggygtttaggygtygattttttygatttygtatttatttagaagttgtatyggtygygatttygttttggygttttygggggtttggggttyggtyggyggyggtygyggygagygatttygggtaggatttagttagygtygaataaaggttgygygtaggtagygggygtygtttgtattttygtttygygtttyggyggyggyggyggygygggggttygggygggttyggygttygttygtttygygttgttygtttygagggygtttyggttttygygttttygttygttgttgttygttatygtygtygtygttyggttatygtatygtatatattaattatttatygttygtttttagtttttygggygaagttaattataggyggaggtttygttaatggggtygtygtygtygtygtygaggaggtagttagtygygygttygggygtaagygatagttttttagggayggggatgggtygggggygygyggggggygggggygtayggggygygtyggagaaattttttayggttygygttttgygtygygttygyggattttgygggygtgattatttattttgygtgtgttygygtggggttgggggtttygggggaggttaggttagtygyggtggggggaggggagggaggaggaggaggagygygggaggaagatgaaaggygagtagatttgttttggygtttttagggagtttyggttygygygygtttttttygtttygygagtttygtygttygtatttygttttttagttygtygttygtatttattygygygygtagatygttagtttagttatttygttgygagggagygygagygagtatgaatyggaggtagtttatattttaaatttgtaygtaggggtggtgttggtgtaygtygttgtygagygaaygtaygattygaygagtagtattttagttttygggygggggyggygaygaggtttttttttttttttygtttaggtaattaattggaagtaatatttgtgygagtggggttttyggagygttgtygttygaggaggtygtygggaaggygttggyggtggatgatttygggtgtttttygttttttagygaatttttttaagtgggtatgttaatgagggtttayggyggggagggggtggaggagggagttgaattggagggggtttyggtyggggggaggggaggggaggggaggggagggyggggttaggtatttagattaaatttyggtttaaaggattttyggaaygggttayggggtggagaaggtaggyggttyggtattttatttttttgattttgggtgttttggtattttygggatttttygagygaggggtttaggatagggtgaataygygtaygtaygttttygtttttygatttygg

SEQ ID NO: 6974 - DNA, 919 bp, synthetic construct
  misc_feature 1..919: note = Description of Artificial Sequence: Synthetic polynucleotide
  source 1..919: mol_type = other DNA
yggtttatttatttygygygtttttatataygttttttttygattttttaygagtataygttygtttygygtgttygtttttttttgtttttygtttygattttaygtttttttttttttttggatttygttttttggagygygttygtttttttttgttaygtttttttttttttatttttttttttttttgttygttgttttttygtgygygtttttttttttgtatatygttttatttttgtygtaggttygatttttgaaygtttttttttttttggtttttttttttggygygygttttttttygtaygattttttttttttgtygggygtttygygtttgtaygtttttttttttttgtygygttttttttattttgyggygggtttttatttttgtaygttttttttattttgtygygttttttttattttgtygygttttttttattttgtygtttgtttttatttttgtaygtttttttttttttgttgygygtttttttttygttgtttatygygtgttttttgtttatttattygygygtttttttygttttgyggygtttatattggtttttgaggygygagttttygttgtttggtaaygggaygtygtttttgggtggygagtaggygygtgtgtaggggtgagygtatyggaaaggttygaattgtttttgggatttgtttttttagtttygttgggttyggygggtagaggyggttttgatygttgggttttgggygtygagtaggatttatttgaggyggagagaggtygtttygygtttggggttttygaaagyggttagttgtttttttgttttttttgagyggggagygttgygttttttgygggttgygggagatttttttagattttygggtgggaaaattatattgagygtttygg

SEQ ID NO: 6975 - DNA, 944 bp, synthetic construct
  misc_feature 1..944: note = Description of Artificial Sequence: Synthetic polynucleotide
  source 1..944: mol_type = other DNA
ygttgggygaggttagggttgyggtaggggagtygagtygggagaggggygtaagatttggygttgggygggaygttygggtagggtgygggaggggttgagggtygtttttattgttttttygttttggagttggggttaggyggtyggagattggttggggygtayggygaggttygggttggagtttygaggtgggaggygttaggattagtyggggygttygtagygtaggttgttatttatttgggygatttttgyggyggyggyggyggyggttgggtagagttagggtygggggygtaygtyggaatatttgggtygtygggtatygagygtyggggggttgygyggygygtatttggagagggygtagttatgygggyggyggyggygggggggggygtgyggayggtygygttggygttgttgttgggggygttgtattgggygtyggygygttgygaggagtaygattattatggttggtaggtygagtygttgtayggtygtttttattttaagtygtygtagtgttttgatatttttgtygatttgtygttttgttatayggtgggttataagygtatgyggttgtttaatttgttggagtaygagagtttggtygaagtgaagtagtaggygagtagttggttgtygttgttggttaagygttgttattyggataygtaggtttttttgtgttygttttttgygttygtttgtttygatyggtttatttattygtgtygttygttgtgygaggtygtgygygtyggttgygygtygtttatggaggtttayggttttttttggtttgagatgttgtattgttataagttttttttggataaygatttttgtatygtygtgtagttygggtatttgttygttatygygtttttaggtagygtygtygtygtygttttygygygtttygaygg

SEQ ID NO: 6976 - DNA, 1096 bp, synthetic construct
  misc_feature 1..1096: note = Description of Artificial Sequence: Synthetic polynucleotide
  source 1..1096: mol_type = other DNA
ygagtattaggaaagygaagttatataaygyggttttttttagtttyggygyggtagtttggaggggatgttttttttgtaaagygagttttttaattttttygggttttggyggagtttygggatygygtaggggtaagtggagtgtyggggaaggggygttggggttggggtgtyggggtaggggtgttttgttygtaygtatttaygatagtgagtagtatgttgtttagtagtagygttaggaataygatgaataggatgagttttygygagyggyggtttttttgtagttagyggattagygttagttygtttagggttatggtttyggggtttygttgygggygyggtgygyggtgaggatttaaggyggtygtggattttttattttttygttttttaggtygyggaagggygggttagggagtygygygtatyggtattyggggatattttygggygttttagtttyggtttatttgtttygagygygtttttaygagagttygygttttttggaaagagygttygygagygtygtyggggatttaatttggagatttaatttagaatttttaggaygttgttttgattttygtygtttttaattgtgttattttttaaattgtaygttyggtttygtgtattttgygttttgygttttgygtttyggttgtttyggggttttygtagtttygttygygtagttttgggggtttttttgtttttttgtttttttygggttygttttttttyggtatygygttttgygagtagggaatyggggtygtgttatttyggggtygtttgygatgtttgttygggtttttygtgttygygttaaygttygtatygtagtgggtttygttagttygggyggtttygggtygtagttttygttttagygtttygtygtygtygtttagtttatttygttyggttttgaygttayggtyggagggagygggggyggggggttggggygtttyggttttygttygttygygtygtygttgygtaggaggggttgtygtttttttgttttygtttyggtygyggtygygtttttttttyggatttagygygtggtyga

SEQ ID NO: 6977 - DNA, 4048 bp, synthetic construct
  misc_feature 1..4048: note = Description of Artificial Sequence: Synthetic polynucleotide
  source 1..4048: mol_type = other DNA
ygtaygtttagatgggtttttygygttygggtygtagttatttgagttttygtgaggttgaggttgtgtgttagttgttttttttyggygtttattaygtagtgattttttttaaaggygtgttttagttttagaagttgggayggggagaaggyggttyggattygtttgggttttygggttagygygttgtgtaaaaggaaattttyggggttagtgtygttttttgyggggagtatagtagaaattttattagggggggttgttttgatyggagtygygtatttttttygagtygggttggttyggtatygtgtttagggttttygtatagtygygtygttygatttgygggggtyggtggtttttttaagggtttaygaagggaaygtttgtttagttgttyggttyggaaygtygggtttttatyggtgyggtatttaattagtygttgtygtagaggagttagtttttaggtttttgatttyggtyggtttygtagtygttttggygtygygggtttygttattttttygtygggygttggaggtaggggagggagtygtagagtttggttaggggattggygtttataattygaagaaattatttttttttttttttaatttttyggggaattttgatttayggtggaaaggyggygggttgttttttagagtttttatggagatttatttttaaattatttgttttattgttttttyggaaaagtatagaggyggggygagtygttgaagttygatygggatagaaatttggtyggygggtgtgtttggttatagtygttgttgtttttygygaattgggtttyggggttttyggttttygagaattagaagagaaaygygagygaagggatygaaattyggggggttatygatttgtagatatygttaggatagtttgtaaygtaggaagattttagyggtttygggtttggtgaggggattataagtatgattgatagygaatgaggaagggtagttttaaattttttaagtaaagttttagagttttgggtttatttattagtataggaaatygatttatygaaaatttaaataaagaaaaataagtygatagtttaggtaggatgtaggtaaatttagttygggattaagggtaaaaggttttttgggtttttttttttttggtttgattttttaaaatatggggaggggggtgatatttattygattttaggtttyggtaggaaygtaatgggttaatgaatggataagtygyggagtattgatyggttgtygtyggaggtaggttttttattgattttaattygtaaattaattatttttttttttgaagttttaatttttttttttttatttygtatttagagaaaaataaataaataaaaaatatygtaagaaatgaaaatataygaatagatatttttttttaagatagttttttgattaggttttttttttttttttttaaagaaagaaagaaaaataaaaattagatygaatttgttttttygttgtggttgttyggygttttaattaagtaggtygyggygagagygttaagttttggagtttttttttygtaygggttttygtttttttttaggttttygaaaagtaggaaagaaaaaataaattttatatttttttttyggggygygaggattttttygtttttagaagagggtggaagattaagaagtygygggtttggattgaaggggygtaaagtgggtggtgaatagggtygaaygtagtygaaagtaagtttggyggtygagttttgttygygtttttyggagttaggayggttgggggtattgtygagggtattaggagtttggggatttygygggttttgggtttygyggygtygggtaygtatagtttagtttgttttgattygagygtattgggggataattttttygttygtatttttttttaaagggttaagyggttygtaggttattattttaaattagtygtagtttyggagattggggatygatattaygttyggtttygygtygtttagttttttaatagggygygttggttygygagtyggaggaattttygtttaggttttgttaagygtttattyggagtaggtygggggtagtgaaggatgyggygggagyggygygttgtagtttygygaygtggtaygtattttggaagygatgatttagatatyggtagyggtggatgagttaggggtagaaggtggayggatttygttgttgygaggygaatagggggtgtggygagtgygaggagggtagggggtgggyggttagggygtgyggyggyggtatygggtgtattggtayggyggggttgggygggtgygagatygtttyggygaatattaagttygggttggagtagaygtttttatyggyggyggyggyggyggtygagtggaagtygttgaggaayggatttatggggttggagttagygtagttgagtgtygygggayggatggggttttyggagygygaggygggtaggggattgtttttggttattagygattygatggtgaagtagygtttgggygtyggttggaatatgttgygtygaggagygggygttttgggtttttagtttttggygatygtygtaygttgttttygtygttygttgttygyggygaggayggaygagaattggggattygtttgtttggggtgggggtgggggtggggggaaggaaaggaagaaagaaaggaaaggaaaggaaaaaggaaaggaggggggagggagagggagaggtaaagtygaggatttygagaattttgtattaaaygygtttaatttgaagagaggggggaaaatttttttagaagaatttgtaggygtggattggggtaatttttttttttttttttttttttttttttttttttttttttttttttttttttggygagatggygtggggggatyggagttagaggtagggaggagaaggggggaaagttttygggggaggtaaaaaaaaaaaaaagtttttttttttttgtaaaaggygggtagggygttttaagtttaaggataatttatggaagtgttygtttttttataagttgtgtaaaygatttgttagtttatgagtttaattagtgyggggattatataaatagtttttttygaagtttggtaaatggtttgatgattggtygttattattygttttgaggtggaaggggggagattttttaaagtgygttagagggaggtgagygtttgggaattyggaggtttggattygggtygagagtggaayggagtyggygtygtygtttyggttgagttttttgtygtttatygggyggtygggttttttygygttttygtttttygtttttagtttattygtttttgyggygttygttgyggtttttttttttttttygtttttttttttttttttagttttttttttttttttttttttttttttttttttttttttttttttttttttttttttttttttatttatttttttttagttatygtttttttttttattagtattatttttttyggggtatttyggtttttgtagagtttttggtyggygtygttttygttgyggttttttgaatttygagtttgtttygtttaagttggtaggatagaaggatagatagatttttttagtttagygtttygtygttgttgttttaygyggtttygygtygggagaattgggatygttttaagagtatygygagggtaagygggtaggggttggttttygggttaaaggygtygttyggttatattaatttttatatttagtaaaatttttagyggttttttaggttaggagggattttggagtgaggggtayggggtttttttattttattaattaygtttagtttygaggttttagggtyggtgygttygygatttttgattyggttygttygtttgygagttgagatygggagttgtygatttygtyggagtagtgggtttttaattttttttttttttygttttayggtttttagygt

SEQ ID NO: 6978 - DNA, 3292 bp, synthetic construct
  misc_feature 1..3292: note = Description of Artificial Sequence: Synthetic polynucleotide
  source 1..3292: mol_type = other DNA
ygygtttaagttttagtttttgaaggtygttggatttttyggygttttyggttyggtttagtttttttyggggttyggataaggaggtygggygtttttttttttatttttttggggttttagatyggtygtagtagyggtayggaagagattatygggtgygagtagtagayggggtgygggaaggtgagtagyggttggttgattggtatyggggttttygyggttgtagtygtygygttttyggtygtygagttttygtggtagaggatgggtattygtaygatgygttgygtygyggtatggtttaggttggtygtttttagtttygtygttagttgtygtttttatttgttgyggyggttttggaattagattttgatttgygtttyggtgaggtgtagggaygyggttaggtyggttygtttygagttgtttagatagygttttatgtygaaggtggattygagttggaagatttggttgygygagaagattgtgygygttttttttttgyggtaygtyggttttttttttggatttttagygttttttttttagttttttgygttyggagtggtygtygtygtttttaygttygtttyggtygygtttggygtygtttygtttttttttttgtttttttyggagtygtttttttttagaatgatttygttygggtttttggagtttagttttttgtgatyggggtyggttttgagtagtggtttyggagagtygyggtttgtgtyggaggygggggaggagttttttagtaaggtttttttygaggttggggagatagatagayggaygtatatatatgtatatygatatagttttgagygaggttyggygtttggggayggtaggtttaattygygtyggtttttaggttttaggttatgaggttttattattttygygggttgtttttttttyggttgggttagagaagggaygtygagttttgggattttttttttttygaggataggtaagtagatggtggtagygyggttatttttttttatttttttagttttttygttaggggtyggtagaayggttttttttyggtttaggygtattggaattattttttttttttaggtygtgttttaagtttyggtygttygaagtttttttatttaygttygaggttatttttttygggaagtatygtgttyggggttttaattttatttttttttttattaagtgggattggattaaygggtagygtaatttagygygagggtaggttaggggtygaaaaaaattgatygagtagagggtttgygggtgttggggttttagaattgyggagggaagtagygyggggyggggayggggygggygygtagggggataaygaaagtttaaagagaggtyggtatttttaggtygygggaggtggtygtyggygggggttagggtgtaggggtattattaggttggggagygttttaggtagtgygygggtagggtaaatttttgygtygggattttaaagygagggaaagttaggtygtttatttgygagagygygaagttygyggygttttttagggtttttttggtygttgyggtagyggtagyggyggyggyggyggtagtygaggttggygygaagagygttygtgggggyggttgaggtttagggggyggtyggtggtggttttygttgagtaggtttttgatggagaayggggattttttgggagygggtggggggggyggyggyggttggggttgtgygttggyggtgtyggtagygttyggttygggtttyggtatggttttttttttttygggttttygggagggagggagygggataggygggyggyggggygagtaggygagaggtyggaaattagattataaayggaatttaattayggggygtaaagtygggggtygtttygggygtaaatttaayggygggagggyggagtgaggatttagaygggygggttygtatgagggaggggtgyggaggggyggggagyggttttgtygyggtatygagggatygaggyggttyggttgyggttgyggttttygyggaggaggtagtaagagtagttttyggttygaggttgygttaattyggygtyggatgttaatgatgaaattaaaatgttatttaagttaaatgyggggagtatayggygattgggygygtataatggtaaatgggattaggtaggygaaggtttagtygagtttyggtttygtagtygttttygttatygtttttttttygttttttttyggattttggygttttggtttygggttataagagttygttygttattggttttatatagtttaattaggtagtaaatgaggataagtttattagtataaaaggatattggttttygttaaagaggtattyggagygtttttgygagygtaggaggygagygagggaygyggagtaggyggygtttttggtygaagygtattaayggtygygagttyggagatygygtttgttttttttttttgyggygtagggattygtttttygtygttaggtttgygggaggggggaggggyggattaggttttttygggttatttyggggttatttgygttygtagttgtygttttttygttttttggggttggataggggttygtygtttttaygtagttggagagttaygtagygtyggtttaagaggtaggaygtgatttyggttttyggagaatttattatttttttattttttggggttyggygatttyggtattttttttaaagtttgttaggaagggygaggttaagaagagagggatttgggttttttatttattatttagtygatagtaagggaatttaggtgtaagttttygtattgygttttyggatttagaaattygygtggttttggtttttagttttggaaaatygaagagtgagttttttttygggattaggagtgggtgtgtttgtgtgygtatgygygttgattyggttaaaattygygygttattyggtggggttgttggggtaatagtttttyggtatygayggttgttttyggaagggtatttttttgttttggtygtyggtgtttaaggttygyggattaatttygagtttgtgatttygaygatagtatttttttttaggaagttttttyggttagttggygtttggagttgtttaattaaygttttaatgggggtaaggtgaatygaaggygtagyggygtagtttttttygtygyggtaagtagyggtattygttgygygtttygayggtagyga

SEQ ID NO: 6979 - DNA, 3753 bp, synthetic construct
  misc_feature 1..3753: note = Description of Artificial Sequence: Synthetic polynucleotide
  source 1..3753: mol_type = other DNA
ygyggttattttttyggtgtagygtttttttagtttttgygyggtygtaggtgttagggygaggaagttygtgggygttttygtygygygttaaggttttatttagagtaagyggtygygtgttagtyggtgatttagttataygttgaattaatgtaaattattaataataaaagagtgtagggaagygtttttgttttttttattttttttgtttggtttygggtttyggattttttttgagtygtagaattgttttatygygtttagtttttttttygygygagatatataattttgttatyggtygggtagttgggygtagygataagttggtygygttaagttygyggygagtaaagtggaggttttattaggtataagtagygttatygtttgttttatatttttggagaggaagtgygyggtatagggtatgttatagygggagttgttgtggttaagtttaaggygagtttagtgtygggaatatgtygttgggtatttagttygtttgtttttagaaggtaatygtttaaatggygaggtttgttttttagtttttgttttttttygygyggatttttgagttggattttagtyggggtgygttttagttygygygaygattttgggygttaggagggagagtgggygggtagttttagttaygtgtagtttgggyggygttaaggtttygatttttaatttttgatttyggttttattttttaygtggagygagttaaatttttatagatagaygtatgtaagtttttttatygaaaaatttgaaaatttttygtgygttattatgtygggtaattaagtttattaaagttagtaaagatgtttaaaatgttttatttttttttttttttaaaaatatttatagatttgaattttttttttttygtttttattattttygggatgagggaaaygaaaagaagtaatttagtaattgtttaaagtttttgagggtttggtttggtygagygtgtatgtatgtatatatatataggtgtatatatgggggaggagtgtatttggttttgtaggtgtttttttgatttttttttttattaattatagtttgtttggttaaaatttttttttttattattattygagaatattttatttygaatggtttttaaagygtattggttyggtttaggtaggaagtaggttttttgatttagggaatgttaataaatattygaaataattaaaataaaaagtagggtagagattataaataagagttaatgaatatatatggtgtatttttttatatttttggaaataygtygttttgtttyggagttttgtttatagtatagtaygygttyggttttgygggtagttgggggyggygyggggyggygggtyggttagtagtygagtttgttgtataggttgtagagaggtaaggtygagaggttgtttttygggtagtagagyggygygggaaaggygagygagygyggtatyggtaygygtagtagygaattgtttyggaatattagyggtatgtttattagagtttgygtygaygygtgygttatgttggtygtttttagtttagtygagagttgtygtttttatttgttgyggyggttttggaattaagtttttatttgggttttygtgagttgtaggttggaggygaggtaggygygtttygagttgtttaggtagygttttatgtygaaggtggattygagttggtatatttggttgygygaaaagayggtgygygttttttttttggtygygtyggtttgtygtttagygtygtygtttygyggtygttyggatttyggygagggygagttygygggtaggagttttttttttttttttttaaagttygagtgygaaggagagaggaaaggygtgygttttaagtygttygggttygagttttygttgtttttgggggtatttgaggagygagaatagatagaaaggttatggagttggttggggagtttyggagatygttagttttttttgggattaagyggttggtaagygtttgtagttttggttttattttattaattttttttttttattttttttattggttttttaaatttagtatttygttttttaaaagygataagagagggatttagttatttggagtatggggtttttgtgtttttatttttatgaatgggttaggggtaatagggagaggaggtttggagggggaaatattagtatggttttaaaaggygaatttgtttggtggtaattgagttggaagagtttttygagttttatagggtggtattattttataggtygtttgtttggaaattaygttaaggattaaygtaggattttttttygttaaatgttgtaaagaggaatygtttttgaaatgtattattgttaattattttggagtgttaattattttaaggaggagagagagagaaaggtagagatayggagygagtgaggaagaagatttagaaagagattayggtggagatagattgtttagattygatttgtagatttttatttygtgttyggaaagaaagtattagatgtgtagtgattgaggatagtygggtgtaaggtyggtygygtgtttttttygttgtggtttatttttttaataatttaattttttttaggaagtttaagtyggtaygggtttgtgttygtttgtttttaggggtttatygggyggaggaggtattatagtgygygttttttttttygyggtttygaattttyggttgtygtagttttggttagagggggttyggygygggagttttggyggggygtttagttttttttttttygygttygttygttgttatattggygaygtgygatttttatttaggtaaggaaaagggatggggggatggtgtttggggttttgttttttagggtygtgttggtttgggtagaagtaggygggygttttttagtygtygttyggttttttttttttygaggatayggataggttgygttttttggttggttagtygaygggttttygyggtgttttygaggggttttygtttaggatggattggatggtgaagttggagaygttatyggtygtyggatattttttgttygtattttttttgttgtttattttgggtttataagaaatygaaggaaattaagaattttttttagagaygatttgggtgatttgggtggaaggtggtgtagtaggtaggtagtggggaggggyggggaggaaatttagggggagggggygtygaggttggtgaggygtttttttygygttagggatatgtaggtatyggatggttgygtaggggtttttgttygtttggttttgggtgygttygtttagtttyggtgtaaatgtttttttttygttygttaattygtygggttttyggyggygyggaggyggygyggttttatttgtatagaggttattygaaygyggttaatygtagygtygtygagyggtttyggaaaattttaaaaygtttyggttaggtatatagtatyggtgygtttttagagygygtygagggtttggygggtattagyggygtttaattaggggtagttagggttgaaagtagttgtagattttagttygggtttttggyggttgyggtaatttygattttttggattttttggatttttttttttagaggtaggggyggtgygggattyggagttggagtggttygaygttttygtaggygaygggttttygygt

SEQ ID NO: 6980 - DNA, 829 bp, synthetic construct; identical to SEQ ID NO: 6969
  misc_feature 1..829: note = Description of Artificial Sequence: Synthetic polynucleotide
  source 1..829: mol_type = other DNA

SEQ ID NO: 6981 - DNA, 1328 bp, synthetic construct
  misc_feature 1..1328: note = Description of Artificial Sequence: Synthetic polynucleotide
  source 1..1328: mol_type = other DNA
ygggygagagatgtttttttgggygtttagggtygggyggggtygygygtygggttgtgggtygyggtggagatttgattygtatttygagggtttttagagagtyggggagygagtagtagagttatygtttttagttttagtttgaaaagttggatygtgtygtygtatgtgygtttggtagtygggygtttygggttttgyggttatattattttggggyggggaygtgtgygtttygggygttyggaygttattgagttaygtttgagtygtttattttygggggtgagygagtygyggttyggggygggattttggyggggggattygagyggtttttaggattygygggaygtygttaattggygggggtgygggggagataataatttgtttygyggtaataagaayggtgattgttggtygtggatttattttataggtttgtttttttttattaaygttttttttagttttygggttaattyggatagtttgtttatttattgtaayggttaaggttggtttgtgttagaayggygygygygygygtaygtaygtatatatayggggggaaatttttttaaaaatgaaaggttagaagagtttagyggyggygygggygttgygygagggtttyggagttgattygtygaggtaggaaattttttyggtygygaygttyggtttyggttyggygttygygtgggatggtgtagygttygtygtygggttygagagttgttgtattgaaggtyggygaygatggtagygygttygttgttygtgtttttygttygygtttttttgttygttttggtyggtgttttgttygygttttgygaggttygaggtaagtygtygaattagggyggttygttgttygtttygtygagggtatygtaygttgygtttgggygygtygaggtttagggttgtttygaggggygaygygtttyggygtattttyggagtttyggggtttgygtttttagygyggygagatygattttttttttttaggtgttaattttttggggaagggygatatttggttygtagttttataggagttagtatttgtttyggagggtatagtttygggatygttttttygtttttatttttttgggtgatatttgtagatgtttttgtattttgatatttataygtgttattygggaygatgygtgtygggtttttttgttggttttatttygtagtgaatatttttattttaggtttygggttagttttttattaggttttttttttagtttygtttttttygttaatatatttaggggggygygtagyggtttygt

SEQ ID NO: 6982 - DNA, 2957 bp, synthetic construct
  misc_feature 1..2957: note = Description of Artificial Sequence: Synthetic polynucleotide
  source 1..2957: mol_type = other DNA
ygagtygttttyggttttgygtttttttttagggtattaaggtttttaaygttaataygtggggttgttattaggggaaatyggaggtttgagtttagtatttttggattygtattyggttagtttttagtttttttttaaatttyggttttttttyggttgtagaggaggtgattgaggyggaagtyggyggtygyggtttggtggttaggggygaagttaggggaggggttaagggtttggggagygtgggtggygattgtyggtggtygtttttygaaagaaaagtygttygttaggttttyggggaaggtgttaaggtygttagttagagygtttatagtagaagygaaatyggagaagtaggtggyggtttygggtgyggatggagagggygaggtttgtaggtttaggtaagtygygttygggggttttagygttggygtttyggttttttttaygtttttggttttygagygtayggtygygttggttttagttttttttttttttttttttyggaagttttygttgttaaatattttttygtagttggggtttagggtttagtaattgtttttatttgtagaagaagaaatagtttagtttagaaggttygagttttgaygggtygtggtgtgagttagygaggaggttagttttagaaagattttttgttggtttttatagagggtttgagttttygtttttattttatttttgaygggtattttgtattygatgggtttttatagtaggattgggaagaaagtgataatttagaaaggaggaggaagggagttttgggaaaggtygagtttygttaaggtgaaggaaggtttgygagatgttaatggtgggatttygttagtygttttgttaaggatagygtagattaygttaggtttttaggtaggttttagagttttttaaaygggtattttatttgttttgtttatttttggggtaggygttgttttttttattttattaggtagggtattgaggtttagggaagttgagttatttttaaggttatttagtttgttggttttttygttttttttttygaaggagygtatagagattgagagtttygggatygtygtattgtaaaygygggtttgtggtgggtttagtygttgtttgagaatttgtttatgtttaagtattttttttttttttttttttttttygggtatttttaatygygtagggagaaattaggttgtttaaggtgtttttattttyggagtgttygyggttyggygggaagatggggagttttggayggagygagtyggygygtygttgttatttgggtygttttygtygyggggtatttttttgaagtagtygttgagygataggttgtggyggatggagttttgttagttygttttgttgygtttgtagaaagggaagttattagttaygtattggtagatttggttgagygttagttttygtagyggygygttttggatggttatggygatgagygtygagtaggagtagggyggtygtattagttttagtagtttttgttggtyggagaggtttagttaggygaggtyggygttygttaggtygttyggggygtygaggagygggtygggagtttygtagttyggggtygygtagggyggygtaggttygggattygaagygtaggatttggggttgagygttggygygtttatttataggagggggttttygtttatygygtttagattttttggtttatagttyggggggtgygyggtggtttgggtttggtygggyggggtygaggaggggtttaggtygtygtagtaggtggttatgtttagtygygttygggtttgggttagyggtgtygtatygaaatttattggygatttatttagtttggtygttagtagygttygggtgygattagttyggtttagtttttygttttttaaatatygtyggggttagagtttatggagagtgayggtggygagttttttttttggtagttttggaggagygaaatttttgttttygttttggtgttagtttttygtttygtttaggtttgataygttttggatyggaygtttttttgatttttttttttttttttgtgygattygtttygagtttatagtygttygyggttttggttgtagggattttaagttygtagtttygtttggttttaygggtttygtagtttygattgttttggatygtattaygattttttaaggtttttagggttgtggtttgggagtttygtttaatgygyggtttttttgttyggttygggatatttygttttaaagaaattygtttygtyggggtttttgggttattygggattyggggttagggatagagggygattatattgygtaagagatygtaatgaagttygtagatttttaggttggagtygtagagygaggtggygaggtggagaaygyggggttgggtttggatagyggttttggggtygtttggagttttygtttttttaattyggaaggtagyggattgatatttgygtygaagtygygygtattttayggagggtygggattttggaaatttygaaygttttagtagtttagggtagttatygttttttttaagtyggggagttyggggtttygttaggttttttygygttgtgatttygggygygtagagyggagagygttaagttttttgttgggtgtyggaggaygygtygaaaatagggaygtttttgtagtgygttygatattagttttttagttttgttgtygttyggggttgttgtagttygggttatttyggttttttaagttgttyggttttyggttttttttgtttttygygttgtggggtggyggaggatggatttaggttgaygttgggttgggtatttggaaagagggttygtttttyggatttygagtygggtatttgtgygaaagaggyga

SEQ ID NO: 6983 - DNA, 1860 bp, synthetic construct; identical to SEQ ID NO: 6755
  misc_feature 1..1860: note = Description of Artificial Sequence: Synthetic polynucleotide
  source 1..1860: mol_type = other DNA

SEQ ID NO: 6984 - DNA, 1422 bp, synthetic construct
  misc_feature 1..1422: note = Description of Artificial Sequence: Synthetic polynucleotide
  source 1..1422: mol_type = other DNA
ygyggggagtagaggtgtttagataygyggtttgttttyggtttttattttatagagttttttatttyggtattgagttyggaagttyggttattagttygttattttataatttttttagtttgggagtttttataygggtggtygttttttygtagyggtttagtttttagttgtaggattttygggattttygtatttattatgagygttgtaaagttgyggaagygtgagygtygttggaggaggygtttagggggaggygattaggtggygttttgtttttygttagtttttatggtttttggaaggttaaagttttagayggyggttaggaggtygygttttygggtttttggttttagggtgatygyggyggggygggygtagttygggagttgtttttatttgtgaagatagyggyggttagyggggygggyggagggttttygyggagggtagttygtagtttygatttygttagggagtagtygyggtttttgtygttttttttttttygygggyggtttgggggttgygtttggggttggyggaggyggtgtyggtggggatyggtggggggttyggatygaaygygttagyggtagatgygtttttttttttatatttaaaaattaatttgygttttattttyggtttyggagttaaatttaattatttygggttgtataaagttagaggygygtyggggggtttgtatygggaatyggtatygagtgattygttygttttagttyggtygyggygtttgttttgtttggatgtggttygagtttygggtygggygygyggggygggggttttggattattygtggygtttttygttttagyggagtygaaagttattyggagttgtttttttygyggttagtgttatttyggggygygagtttttttgtygagtygyggtttygygygtttttttygtygtttagattygygygttttttttatttgttgtggtygaagyggttgtyggggyggtygggtygygttttyggagatagaygygttgygtttttttygtyggggattygttttttattygygagggtagyggtygagttgggatygagttattaatagattgyggggttgyggygtyggtyggtgagttatagtttygygtaygagyggtttagttyggttagtagygtygtygtttttgygygtatttttygyggygatagyggggattyggggtyggaggtaggygygtaattatggggatyggggygggygatggyggygggygggtttttgtygtagggtggggatggtttttttagtygggyggtygtygttatattgtagagygtatttaaagagatatttygtttygygttygttttttagtattagattttygttygaaaaygtygtygggyggattgtayga

SEQ ID NO: 6985 - DNA, 1479 bp, synthetic construct
  misc_feature 1..1479: note = Description of Artificial Sequence: Synthetic polynucleotide
  source 1..1479: mol_type = other DNA
ygaygagtttaygaattttatygtggtyggyggtagtygttggtygagtttagygtttaggtttaggttatttttatgtygtgygattygtygggaaygggtttaggttygtttgtttaaggttagaagtattttgttttyggtttaaygtyggatygygtttygttttttttattttatattaaggaaaggaattagaygtttgggagaaaggatgagtagtattyggtgggattyggttttaattyggggtygtttttaatttttaattttttagagtttttttyggtttygtttttttttttayggtttygaggtygtygyggttttttttygttttgagtgtagatagttygggaagtggagagygtagttyggagttagggagtygtttttaggagttttggygatgggagygtaggtggygggygtggtttttttaattttgttttagtygattyggagtyggttttygtgtagtagttatygttygggttttygtttggttatagtattaggttatagtgygttggtttttgattatttttttggttyggtggtygtttttygtttttttttagttygygtygttgttttgttttaggtttyggtgyggttttaagttttagtttagggtttttaggtttttttaggyggyggtggyggtatttatttgggtygyggagtyggggtttggtayggtttygtaggtggtaaatgaaattttggtagttgtygtgttttagggttttaygggtatagagttyggttagtagttgtagygtttggtgatagagygygtttttggtttygggtatygttttttygtattttyggatygygtygggtaggygggygtaggagatagtttttygtttgttagtttagagtygtygttttygggtygttygygtttatygttagggatttgtygagaaayggtgygagtttgagttygagttttagatttagtyggttyggttttttatyggttgtatgtagtttttygttagtyggtyggttaggttttttttttttttygttyggttttttygtttttttttagatatygaggagaggyggtgtygtatagtttagagygtttttttgtttgygtttygttygttattygyggtygtyggggggyggggttaggttaggagtgygygtygtagggtaggatagyggyggttttagatyggggatttggggtatttttyggtttttggtygagygygagatttggtttgggatttygygtttagagyggtygygttttggtttggggagtgtgagtgagtgygygtttygggygttttygttattttattttttatttttgatgtaaattaagtattygtttttatygtygagtgtgtttaaagtaygtttttggatgtttagtgygaaggttataatttgggtatattygttagatgygtagaatygagtttttgtttygaatttggaaagagtygt

SEQ ID NO: 6986 - DNA, 446 bp, synthetic construct
  misc_feature 1..446: note = Description of Artificial Sequence: Synthetic polynucleotide
  source 1..446: mol_type = other DNA
ygtgygtttygygtattttgtttttygygygaygtygttygygtygttygyggttyggtygggagyggtagttygtgtttyggtttyggtttyggtttyggttggygtttgtatttgygattatygtgagtagttatggygtattttatagtgtagagagtygttttggtttttgggtttgttttggttttgtygttgttgttgtttaaggtttttttgtttygygggaagyggtaggagtygtygtygatatttgaaggtaagagtaggttagttttttttgagtttttyggygtygaagagtayggagaaygttgtttgagggaggggtgattttgagagtttgtagtttttatygaaatatttattaaattgattggagagggygggygagayggygttgaagggttaatgtttayggtttygttgttattagygggtggygg

SEQ ID NO: 6987 - DNA, 2991 bp, synthetic construct
  misc_feature 1..2991: note = Description of Artificial Sequence: Synthetic polynucleotide
  source 1..2991: mol_type = other DNA
ygtttgtygtttataggygtygttgagggatagttggtttagtttgyggattttttttyggattttatatttatgtttagggaaagtyggagttayggyggtataaattagygtttttattttgattatttgagygagygttygyggttygttygtttgyggtataaaygtataaattttttgtagtattatatattatgttttagagataaatatagttttaggggtttttgttttggtaaagtaatttttatttataggaatagattataaaagtattataaaaagtggttttgaatygggaaaygggttgggggtgggttayggttatatttgttatatttgggatyggagtgtattgggttttaygtttttttaaataatyggtgtatttyggggtagggtttaggtttgygagggttttatttttatgggggagggygygagaaagttgaatttagttttttaaggtttagttttggtttatygaggaatayggagyggttatygtaatgggttttygagaagggtgttgygtggaaaaaatygygttgtgtttttgttttgtggggygggggyggaaattttagttttttygttttttttattttaagagaggtygtttttaaagygttgttgggaggggggtatttaagtttaattttttgggygygagggattttaggggtattatttttygggygggtgggyggttattatttttttagagtatttggtatatygggttggggttygtattygtagggtattgyggggyggygttyggtgattgggtggggtygtygttgttttttttttygttgggggyggtagttttttgtttgygyggaggygatttagaaggtaygttygttagtaggagggygggygtygtagggttttyggtggagatgygttttaygatgttggataggtagtttaggttygatatygtygtatttttttygggtttgggttttgygyggggagggttyggttagtaagtaggggtggggtygygataagttttttattttygggtttagtattttgagatagattggaaattgaggattttagttagagttygggataatttaaaagatagggagttatttgtttagtattttattttttgtattattttttaggatataggygtgtgtgagtgggggtgggagygttttagatagaggttaggatagttttatgaaggaggaggagygagtagggagaggttyggaatatttatygttgggygtttygttgtagtaggygttttygtagtagtttygtygtygggygtygttyggggggtygttgtagtttatttgtaaatagtaagggygattgagttaggttygygggayggttygaggttygaatattaatttttgtagtygttttttttttaattttagtttaaggttttagtttygggtttagatttgttttggttgggggggtaattaygggtgggtaggagatgaggtttgtaatatgtagggttaaattaagggyggatagttattaaggggygtaaatttatattttggaagtagggataagtagagaaaaagatttttaygttygygttgtagtgttttaatagygtttttaatggggtagttygaaygtttgttygtatatttttaaaataggttattttagtgatagttgtttaggataagggggttttttttttygggaaggattttggtttaaatttttygtaaggttagtttttygttttyggaaaygygtttttgatatttygagygtygttttaatttttttattttttggggtttyggttttattatgtygtyggagtagttggagygygggttggaygygtyggagtygtygttgtagtgttygtygtygyggttygggggtagygggttyggygtatagaaggyggttgyggygttagggggygyggygttttggtygygtagtagagtttgtaggttttygatatagyggatggygttgygtaggatttttattttgggtaatygttggtttggattgttygaygtgtagygtttgagtgttttaaaggttttatttattttgtttaggyggygtygttygygtatggtggyggttttgyggyggtyggygttggtggttttgygtttgtaygttttgtaggtttatagtaggtagyggttygtttggtggtgttygttgggygygygtatatgttygtttttaygtgygttyggggtygggtgtatygtygyggggaagtgygagtgtttttygggttttaggagygygtttaygtgtattaggygygggtttaggttttygaagaagygtaggttyggggagtygaaataygggtygttatagaagtygttygttgtggtaaaggagtagagagagtygtygggggtygttaggtttaygtygyggagyggtggygatagtagttttatattttggyggtggygyggtayggttttggtttygtttaatttaagyggtagagagtggtyggaattttttgtygttygggagtttyggttgtagatagtaaagtgttggtagtttgaatgtttatttattgttttttattttttttttttttgttyggtttgatttgtggttaaggaaagyggyggtagygttttagggtttttttatttttagtttttygttaggygttttgggttatttattygtagtagtttaaaygtttyggagtttaggygggtagttgggggagggggagttygaggttaataggaatattgyggggyggggtttgggggggttttyggggtggtygtaggggttygtagattggttagttagttygtttttttatattggygtgygygttaggttttttatygggtagggagggagggagygatyggtagttttaggyggttgtatttggtttttyggtaygttttttttaaatttttttaatattygattgttgtattygygggaaaygttggttgygygygt

SEQ ID NO: 6988 - DNA, 928 bp, synthetic construct
  misc_feature 1..928: note = Description of Artificial Sequence: Synthetic polynucleotide
  source 1..928: mol_type = other DNA
ygagtttygtagtttttttttttygtttygttygttagttttttgttttttttttttatattttttattttaaagttaggygtygggygtttttttttgtygtygttyggtattyggttaatttttttaaaatgygtttttattttgttggttgtttyggtagggagtatggaggattgggggttygaagtttgtaaagggtgattttagygttgtagttttttygaaayggagatttgttatttttttagagggyggggaagtttatattattttttgttttatagtgttygtttygtttygtttgttggtttttygtttattygagatattttaggtayggttygtattggagagggtygygttgttgttgygatygtayggygttyggggtaggaatatgttygtttttttttgygyggggggaaygaaatttttagagtgygtttygataygttttttttattatttaaggtaggtttyggtagttttggttatttaggttyggggagttttagtyggatttgttgyggtttttttygtagygtaggtaaggattttaaattttaaattagggatttygattttttttttttttttttygttttttttttttttgaaagagaaatagatagaaagtttagttttgagataaagaaygygagtgattttttygaaataaatttgaagataaygatataatagtgaatggtaggaygtataaaattttatgggtttaggttaaatggtattagttataggttttagtygtagtygtygygtygygtagttttttgggttatygyggagtttgaaaagaygygtttaaggagattatttaaagtaagattttttygttygattttttgtttttttaggatttatttttttttttaygggyggttagttttygttttttygttttygt

SEQ ID NO: 6989 - DNA, 1267 bp, synthetic construct
  misc_feature 1..1267: note = Description of Artificial Sequence: Synthetic polynucleotide
  source 1..1267: mol_type = other DNA
ygygggattttagggttttttygtagttttttgttttygtygtatygygttttttygggtttyggtygygttygttagtyggaagygttttttttgygggtgygattttygtagttatttttttttagtttggygggggtyggygagagtggtttttatagtattttataagttygggaattyggggtaygygggttygttttgttgygggtttygattttttgggayggaaagtyggttattagtagtaagagggtgygtttattyggtygygttttttatttttgygtttttgaggtygggttttttgagaaggggtatttaayggggatatttttaagttygtgagtttttatttttattttgttatttygagtagggtaaagagattttaggaatyggtttaygttatygtygttttttagattagygtaaagttyggttttaggtttttttaygtygtygtggtttgtgggtatttttatttttyggatttttttaatygttatagttatgtttatttgttttggtagtgtatatatagaattatataattaaaattaaatttatyggtatygttttygagggttttygtttagtagggggtatygaagttaggtggaagtaaatgagtttggattttgaggygygtttggtttggagtygttaaatttgttagygggyggygggggaggtggttyggtagygtygggtgttgygttygtatatgygttygggaaggtagtttyggtygtttygtttttagttygttttttatygttggygyggyggyggyggygtggggttyggggttyggtttttygttgyggttgygttygtttgggagttygggtaggagygyggggtttggttattgtggtttgttgygttttttattgggggtygatttygttygtttttttygttygtagaattgygaggatttggattgtaggygtygtagtygttattattyggagtatygaagtyggagttttaggatttgyggtygaaaygagagagygggaggygtayggygtttttayggttttaygygttttagttttttygagtygtagtygttaatgttgttttttttattttygtatygyggtgggggttgtygaagttgttatagtttattttygtygagtygaaaagtygtygagttttygygggtgggtattttttttygggggaatttagatygaggyggygttatygagygygtayggattttttyggaaaataattattygggattygt

SEQ ID NO: 6990 - DNA, 1225 bp, synthetic construct
  misc_feature 1..1225: note = Description of Artificial Sequence: Synthetic polynucleotide
  source 1..1225: mol_type = other DNA
ygtyggtygttttttggtgttttyggggttggtaagygygtagttgaggaaagggtataaaggtggygagttttgygggagtagttgtgtagaatttgtyggattttagggtttggtyggtaggttygttttyggyggttgggttttttttttggagtttagattttttagtygtaggttgtttttygggygggttttagttagggygygtagttttgagygtttgtygttgyggttyggttggtaggtttygaggggygyggggtygygggtyggtyggtagggttttgtgtygttygttttygggtgtgygygaggygyggagtatttaaattgatattatatgtttttttattagttgtttygyggtygagttttaggygtataattatygttagtgggygagagygttagtagtttttagggaagggatataatgattgaggtttaatttttgaaggggaatttggagttgygttttttttttgttatttygatgttgggagtggygttttggttttggygttttttgggtaagtattagtyggyggtatttgyggaggtggttggtaygttgttattttttgaaatgagtgaggagggaggtttagatttaggyggttttaygygttygttttggtattagtagattgggaattgtygtggttatgttygaagtttggaaagtttttttyggtttttttttgggatagttttttttttttygggaagttttttgtgtttagaggtggggttttgtagttggaggggtagatggaatttgygaagtaaaggaaggtaataaaaggaagttaggagaaatyggaaaygtgggttaggttttgttttgttggagaagyggtgttttygtaaagtttttgtttgygttggtttyggtyggagtttagattttttaaaygtttgttattttttatygagttgaggtttyggtttttattygygttttggtgagggtttttttttagttttaagttttyggttattttgaaaaygyggtttttttygaaggggaaataagtgtagtttaatttygtttgagtgatttataaataaggayggaaagggtygttttattayggtttygtttgtygtgaygatgtaatttttyggagyggagtattgttataaagtgataaggttgttataagygtttygattgatttttttaattagttttttatgtatgattyggagygattttygt

SEQ ID NO: 6991 - DNA, 1627 bp, synthetic construct
  misc_feature 1..1627: note = Description of Artificial Sequence: Synthetic polynucleotide
  source 1..1627: mol_type = other DNA
yggttgtyggygygagyggyggttttttttyggttgtagaaygtttttygttgtyggagaaggggtttagtaaaattgatttttttttatttgtttttatttataattgatggggagatgagaaygtaatatattttagtatygagtttttgtygtttggyggagattttgtttaagaygttttygtaaagtatttttagtyggggaataaagtayggaaagttgttgggtagagyggtygggaggagatatygggagtygggtgggyggtggggtggtyggtgggttgtttygggttygggagttygttygtagygygttttgttagtaaggggagagggayggtgggaagyggtygtttttygggtttgggtyggggatggggatggttaagttattygagttttygtttttygtyggtaggtattattygggggtygtgtaattygggygtttattgataggtattttaygttygygaggggttgtttyggttttaattgyggygttgygttttttttttaggaygtaggttaatgttygttygttygtttttagtygggygtagagttgttagatttygggygttttagygttygttttggggttaaygggygggagggggyggttaagttygtaggyggttttttyggttttggtttagtttttttyggttggtttttggagaygttgtgttyggtagagaagtaatttttgttaattttagttatgtgygggggaygtygagttggttttgtttggtaagaaatttttatttgatgtttttttygttttttttttaagggggtgtatagtggaggagggtttttaagtttatttgtttttttttttaagtygttagttttgttagttttgaygygttygttaaatttttttagttttttgygygttttttgtayggtaggtagagagagtagtttggaaaataaattaattgtttagtggtaatatatatatatatatatatatatatatatatatatatatatatatagygattygggattttaggtttygatttttatygygygtatatatatatatatatatatatatatagygattygggattttaggtttygatttttatygggygttataagagtattagtaaattgttgaaaayggttttattttattggggggaggttggtaagaaaaaagaaaaagaaaaaaaaaagtttgttaygygtaaggaagaaagaaaataaagaaaaatattgtaaaaatagatatttttttgtttttttaggttttggtttttttgatagaattttgaaattygttattattttttgtagtagtagtagtagtagtgggatagagtaggagtaaaataaatygatgtayggtaaatggtgtaattygatttatttttaagttaatttattaggygagtyggagtttggttttttttaygtattyggtagttttyggygygggttttattttygggtayggayggtaggaggygyggtyggtygggygygttygttttygygggtgaatygtggttagygtygtttggaggtttttattttggygtygyggttttgttgatttttyggtggttttygygtttttttttttyggygttttgttgygt

SEQ ID NO: 6992 - DNA, 1857 bp, synthetic construct
  misc_feature 1..1857: note = Description of Artificial Sequence: Synthetic polynucleotide
  source 1..1857: mol_type = other DNA
yggyggtygtatttggttttatagtgtaaaatgtgtttggygaggaagtygaggyggygttgtagtagttgagygtgggggtttgtaagggyggttagttyggggaagygaggttygtggygtyggtagaggygtagtagtygggtygyggygttttgttygyggtgtagttttaggaygygtygygyggttygttygyggaataygtatattgattgtaatagyggttygttatatttgttttatatgtttgttattyggtagtygtgtattaagttygttttattgtttagaaagattagygtttygttyggatygyggtgtaggttgttggtggtaygttgtatgaygygygggttttattgtaggttgaagaggttgtttaygagtyggtygaagttggtygttaggtagtygaaaaggattaagtyggtttattgtattaggtttattagtttygtttggttgaggttggttagtttattttyggtatttyggagggggygtagayggtygtttttygagygttagggygygggtattattaygttygtgaggttgggtagttagygtgttaggtttattaygttgttttyggtttagtgygtagygygtagttttttttgtatttgygtttattgygygtttygagtttttattygagttagtgttagyggyggtaygtggygttggaggtttagtaggygygttagatagtaagatagggtttygttttgaatttgtttygggttgatgtygtagygtaygtaggygygggtgtygtyggtaaaaygggttagtyggttggagttgygttygtaattttygygttttagggttattattygggygtygygagtygtttttagttaygtygtygtttgggttttygaaaagttygggggtatttgtttttttaggtygyggttttagaagaygttttygtgtatygyggygttttttttyggtyggggttgtttggttgataygtgttatttgggttygtttygggattgtyggggygggtygttygygtyggtygttagggtgagtagygttyggaaagtttttagggagtygtygygggygttttaygttaggggygggggtagagggaagygaggygygggygyggggtygtygtttygggtygggygtygtgggagtyggttttygggyggtygggaggygggtagttyggttygyggyggtaggagttttttttatagygttagtagygagtttagygttagtagttagagtttygyggtggyggyggygtttygtatttttttgtttatgttttygyggttgtgtyggtgygtygtygtygttttaagtygagtttaggtattygggtttyggyggygaggygggttyggtagtttgtgggtttyggggtttygggygtttyggttttatygyggtygyggggygttgyggggttttgttyggygtttygttyggygttgggaattygagttttygtygttttttagttgtttttgtatttygttgtgagatttttyggtgggygygatttataggygttyggattaygtgggagttagggggatttttttttttttttttygttttygtttttygtttttygttttttygttttttttttttttttttttatttaaagyggygatggtttttttygagagggagaggyggttttatattyggttygggatttgggggtttggaggaagtyggattggttgygttygygtyggggygtaggagggggtggygtagagtyggagtttggggtttggygggagggaygygttttgggttttygygggggtgttttggtygtygggtttttttgtttaggtagygygg

SEQ ID NO: 6993 - DNA, 2423 bp, synthetic construct
  misc_feature 1..2423: note = Description of Artificial Sequence: Synthetic polynucleotide
  source 1..2423: mol_type = other DNA
yggagygtagagaayggttggagatatagyggtygyggtttttttygtagygtaggagygttaggtattgygttgggttaattgyggttagggagttatttgttygygatagygagygygtatttatattttygattaatttaggttggtttttagtttattttygggttttaaygtttaaatatttygtattgttggtttygatatttttttattygtygttaggaattagygtagagggagatgygttttttgtggygggtgyggggygaggattttgattttagttttgggaagtgaattgtayggaggagagagttttttatygttagttttgttttygttttttttgyggttttattttagttyggatgtyggygatggggaatagattagggaygtaggagtatattggatygggggtggatttatttggggaggtaggtaatygattygygtatyggtggygtaatttygtttyggtgatygaagtttgtggaggtagttttattttyggttttttggttygatatttttttgttatttttttttttattttttygagttttgggagtttggatttygaaggtgtaaaaagttaagagtttggaaaattgtattgtgtaaatatattgattttatttgtttttttttaggagttttatagatatatttaggtaaaaagatygttaaataaatgtttttagttatygtaatgtaaaaataaatattaattttttagaygtagtagtagtygygttgygtttaaagttttaayggttaygtttaataattataaaagtgtttagygagagtgttggygtgagtgtgaatgggtgtgygttggggggtayggtggagyggtgtgtaaaatyggagttgtaaattatyggataagggtatggagtggttattygtygtygatttagygygggygygttttttygtatatatttatagtagagttygtattgggaagagttaaaaaataaatatttataaggaygaggaaagyggtttygttttyggygttttygggttagggygagygyggygaggggygtatygatyggttygtagyggggygggagttygagygygygaggagyggyggtttygggtttttgygggtttttygggagtagggygygggtattttyggggtttataygtyggttttygygyggatygyggaygygygygtttttttygygggyggygttttttatagggtygagtyggagtygttggagtttaggttgttttttagtttgtagttgttgagttgttttygttgtagygataggttttgygtgttgyggygtaggtattttaggttttgtaggaaygattttttggttttttttttttttatgggggatattttttttttttttattttttggatttygtygaaggttatyggttgygttttgaagygagattggygyggtygtygtagtyggtttyggtttttgggtagtttggygggtygtaygggttgygggaattygtyggttaggtataygaagtgyggtattatygtttggtaattggagtagatgtttattagttygtygggtttggyggttatggygttttyggygtttgyggggtygggyggyggggygtyggggtttttygagggyggtygttgygtyggggtttttygggaggtagtagtygggggttygtygggygggggatttaaatttgttgyggggtggyggyggttttygygggttygggtyggygtttttygggagggygggygggygggyggattygtyggggggtayggggttyggggggygttgtttygtygygtttygaggygttygtygtygttgttgtygtygtttgtttygyggyggttaggttygyggtttatatagttygyggttgtttatayggttttgagttyggatgatagygaatgttatttaaagygtgygygtttygygttttttygtttgaygtygtttygtygttttgggaaagtaayggtttttttttyggygtygttygtttttygttaatyggtttyggaaggtaggtttygttygygggggtttygggagaagtygyggtttyggagtaygyggttggttygagttgygttyggatagggatttttaatygtygygattgggygggtattgttttttttgggatttttaagtttgtattaatygggttggtygyggggtygtaggtttttttttttygttttttggttttagatgtatatatttgaggygttggttattttatygtyggttttgygyggggygygaggtagtttttagttttttttgtagtttggygagtttgagygttyggttttttagagttgagttyggaagaaggggtgggttttttttttggatttttgttattttttttygtaggygygygygygt

SEQ ID NO: 6994 - DNA, 1146 bp, synthetic construct
  misc_feature 1..1146: note = Description of Artificial Sequence: Synthetic polynucleotide
  source 1..1146: mol_type = other DNA
yggtatttgggtttttgygygtttygtttygyggtygggtttatggtattgtgagtttgtaagggagtttygtttagygyggggagygttyggttttttttygttttatgygttygyggttttgaagtttgagygggggtygggggtygggyggggtyggggtygtygtaggtatggygttygggagtyggtggyggtygatattgtygtygttgttgttgttgttgttgttggygttggyggygygygyggayggtttggagttyggyggyggtttygggtagtgggttygttaygygygttgggygggygyggygagtagyggygagtttagttttagtttgygtattaaygttaygygygygttgttgttttatttggaygayggyggygattgygattttttggagttgttgttggtggayggtygtttgyggttgygttttaygttttygtgygtygagtyggttaygttgtagttggataygtyggtggtygaygatygttggtatatggtgttgttgattygygaygygygtygtayggygttggyggtggayggygaggttygygtygtygaggtgygttttaagyggygygagatgtaggtggttagygatttgttygtgggyggtatttygttygaygtgygtttttyggygtttaygttgagtatygttaagtaygagtygttttttygyggttttttggttaatttgaagttgggygagyggtttttygygttgttgggtagttagggtttgygyggygttatygtygattygttgtgygygttygygygtaatttttgygttaayggyggtttttgtatygtgttggttttyggygaggtgggttgygattgtagttataygggtttyggyggtaagttttgtagygaaggtgagtttyggggagyggtygttyggtgtttgggygygggggtgagggtttggggygtttygtgggggtyggagtgtgtgtgggtttttgaggtaygggggttgggtaygagggtttgtgagtgggtgygagygttttagggttgyggggaygygtgttygggygagggygygtggggttggyggtgggyggggygagtgggyggggtyggtttgggygtggttagygtgagttttgyggyga

SEQ ID NO: 6995 - DNA, 577 bp, synthetic construct
  misc_feature 1..577: note = Description of Artificial Sequence: Synthetic polynucleotide
  source 1..577: mol_type = other DNA
ygttttttttattttgygygttttaygtgttttttgtaaataagagaaygygtaggygtygtaaattagygtttattggtyggygtgtygtygtttygttggagggaggatttaggtttygttggtygygggttyggtattyggtgggtyggtggagygtttgttgggttygggtygtyggtttygttttygttatggygttttggttgtagtttttgtygttgttggggttgttttygggygtagtggtygttttygtttagtttygagtygttagtttttaggtttgggggtygtygttttyggagttgttggygtttattygtttygygttggagatgtttaatygyggtygggttgyggggaygygggtygtgttgggttttgtgygyggtygygttygtygggtgaggaygygtygggggygggggygttaggttygggtttaagggataggagttttgatttaatattgggatggggtttgttygttggaygaatygatttttggtgatggggaatgggtagygtygtaygggyggggttttgggygtygttaagggtygattgtgttygt

SEQ ID NO: 6996 - DNA, 1721 bp, synthetic construct
  misc_feature 1..1721: note = Description of Artificial Sequence: Synthetic polynucleotide
  source 1..1721: mol_type = other DNA
ygtgagttttygaaaggygaagggtaggtagtagtygttggtttttgygtttattaggagtttyggatgttygagttagggttgygttaaggyggtyggagtagagagggagayggggayggggataggtagggataaagtgtaagaggtaaaattggttgaaaagtagaagtgtaggagtygttaaggggygggaygaataggttygtgggtygggyggagttaagggtgggggtyggggtttttttaggtggtattygyggygttagtttttagtttttttttttttttyggttttgattggtaggyggtttgygattagtygygaaygttatagygtttygggygtttaggagaaygygaayggtttttygygggagygggygagtaggagggggygtygggttatatatatagyggttyggtttygggygggtttggygtttagggaggygygtattgttttttagagttttagttttagtygygygtttttygttyggttygtygttttatgtagtyggggtagagttyggygttygggggtttygtygtttgtttttygtattttttyggttgygtatttttgttygaggtyggtygtgygttttygygggaygttataggygtagttttgttttttagtttttygggygtattgatygtttgatygaygtayggttttygggtygggatgtyggggttygggayggtygyggtagygttgttttyggyggttttgttggttttgttggygttttgggygggtygagggggygtygtygtatttattgtatttaayggtaygttggaggtygagttggagygtygttgggagagtttggtggygttttygttggygygtttgtyggtggtagygtagtttaaggaggyggtygtttagagyggygtyggygattatttgttgggtattaagyggttgyggyggttttattgtaaygtgggtatyggtttttatttttaggygtttttygayggtygtatyggyggygygtaygyggatattygygatagtgagtggygyggttaggygygaaggggygggggyggggggtaayggtygtygggttaattygtttagttatattttgagattttyggygggtatttgttygggggtttygggaatyggggyggattygggtttyggttttttttgaygyggggttggggaygtagatatttttggtttyggtagtttagygtaatttttgaggtygggygtygtttttygtttttagaaattygggtttygagygtygaattttagygttttygttygtgggtatagggygygyggtgtagttatagggggttygagataygygtttyggtttggtttaggttggggaatygttggggtygggttygygtttgaaggttygggattgggtgyggtygtygggggttttttatataggtaagttaatttgagttagygtaggtttgggtttyggaggttttagagggtagtttgggttttggaggtttttgggggyggttgygtygggaattttggttttttatttttaattttattttagaaatagggttttyggaggygaataagtygaggggyggagtgggttagggattatttgtttygtaatgatttgygtttygtttttaggtttgttggagttttygttygtggagyggggygtggtgagtattttyggygtggttagtyggtttttygt

SEQ ID NO: 6997 - DNA, 1721 bp, synthetic construct; identical to SEQ ID NO: 6996
  misc_feature 1..1721: note = Description of Artificial Sequence: Synthetic polynucleotide
  source 1..1721: mol_type = other DNA

SEQ ID NO: 6998 - DNA, 615 bp, synthetic construct
  misc_feature 1..615: note = Description of Artificial Sequence: Synthetic polynucleotide
  source 1..615: mol_type = other DNA
yggagtttygggtaygtatygtygagygttttattttgagttttttyggtattygtagtttygatagtttagttttttttatttgaaagttttatttgaggttttttttaattttgtttttttgtatttttggygtygyggggagttaggggttaaatttygtggttygygtggtttttttttttttygtagttttttygtttttattyggygtygygtttggagygttygtttyggagattygtataagagaggaggggaaaaagtgggtttgtttttygggtggttaatttatygagttygyggtgttttagaggaggygttagygttaggttagygttaggtygggttgtttgtttttygyggtaaagtataaatgygttygagygyggygtttgaagtttttggygagtatagtyggttygygtttagttttttttygyggtygtygygtygtygtygttgttgggatygtygtttygtygggttttaggttttygyggttygatttygagtttatygagtagggggygtyggtygtttttagttygygygttygtaatattygttggtttygygygtttygttyggygttgygygttyggtagaygtygg

SEQ ID NO: 6999 - DNA, 1542 bp, synthetic construct
  misc_feature 1..1542: note = Description of Artificial Sequence: Synthetic polynucleotide
  source 1..1542: mol_type = other DNA
ygggayggtygtygygygtttttttttttygttttttgtttataagatttaatgagttttttygggaggtagygtagygagttaggttyggaattagtaggttgygtygygygygtygygtyggggygggagttgggtttgggyggygggtaggagttggygggggygtaygggtagygttgyggatagttygggagtygyggygatggyggtgtaggyggygttttttagtaygtattttttygtgtttttyggtttygggggtttttyggaygggttagggggygttttyggagttttggataagggttgttgtttygaggaygatgagatyggggtttyggygggtgygttgttgtygggagtygaaggaggggaygtgygygaggttattygygatttatttagttttattgattyggygtttagtaatattaagttggygttggataagtygggtaagtygaagyggaaggtgaattatygtaagtatttgtagaagtagattaagygttgtagyggttttatgggygtygygtttttyggttygtttttttygagygtygtygataygttagttaaayggtygttggtygtttttagygtttygatagtygyggtttyggtttayggtaaggttgtttttyggygggaggygtygtaggtygtygyggtygttagtttgtaaagtygaagtttggtygygtttttygattygttgygttaygttttygggggtgtygagtyggyggggggtgaggtggttgygtyggyggtygggttaggaggtgygggtattgggggygygggaggggaygtggtaggtttygygggggttayggygattttaggggttaggaaggtttygttgygggtaygtaatttgttttygtttttttttayggagtygtttygggtaggyggyggygggtgtggttygtyggggtyggaygtgagtttgggygatttggagaagggygyggaggtygtggagttttttgagttgttggggttygattayggygtyggtayggaggyggtagttttgtttgtygtygagtttttygaygtgtttttygtyggagttttygtattgyggggattttyggagttggagttyggtttttttgagtygtygtyggtagtggtgggaaatttattgtatttygagttttggagygtttygggttgtttttygattaaaaagagttttttgattgtttttygyggyggtttgattttgaaygagtttttgagttttttgtatttygtygttgyggattttttyggyggggaggaygggyggggttatttggtttttttygtttttttttttttagattgygttttgttttygtygtygtygttttattaggtgttttaygattatagygygggttatagtygtatygtttattttagtttttggagattygayggggtttgggaaggggygtygggggaggagggggygtatygggattgatttygaggtaygtttttttttattagagayggttgtggagagygtygygttttygt

SEQ ID NO: 7000 - DNA, 1542 bp, synthetic construct; identical to SEQ ID NO: 6999
  misc_feature 1..1542: note = Description of Artificial Sequence: Synthetic polynucleotide
  source 1..1542: mol_type = other DNA

SEQ ID NO: 7001 - DNA, 1768 bp, synthetic construct
  misc_feature 1..1768: note = Description of Artificial Sequence: Synthetic polynucleotide
  source 1..1768: mol_type = other DNA
ygygtttggagtgggttttygatatttagggtaagtgggggyggtagagtttttttttyggtyggtatagtagtttttgtygyggtttyggtttgygaygygtttagttttagtttttyggttttyggygtttgttgagtgttyggygggagaggygtagggagygygttatygggaggygygggtagyggggattggttttttttygggttagggttttyggggtaatygtttttagygygtatttttggtgtaggtggaatagttttttgtttyggtagggttttatttatygygggagaggttaatttyggatttaaatttygtagtygtagagygggttaaaatygttattttatttttttttattttttttttttttattttaagataaaaagttttaggtygggtaggatttgattatttttgtttttttttattgygttaattttgygagygagaggtttygtatygaggyggaggttggtaaaggggagtggaaagggaggatggatggggtyggggggtggggtggtgatgagggygaygaaggagggggtgttattttttttttttttttttttttaaaaaaagtatttttttygygagaaatygttgygyggaygatatttgaagaggtggggaaaggagggggttgygggagtygyggtagagattgtgggtgttataagyggataggagttatagttgggatagttgygagyggagtygagtagtggttgtagyggttaygattgggagtagtygtygtygttttttygggagtyggagtygtygtttttttagtgggtgtagtyggggtttygaygggggtygggyggttatyggggttggagttgyggttayggaggtttttgygtttgygtygygtygagggtagggatagggattggggtgaggggttgtttyggaaygtttatagttggygttggtttttttttgtttgatagttttttggttyggggtttttggtgtygggtttygygttagatgttyggggggyggtggtatygttyggagtyggyggggayggygyggttggtttttagtttggyggagagggtaggttgaggagtggggygtttagagygygtatygygygtaattygtgtygttaaaaaaaataaatttagagagttygttyggggtttaggatygttggggatatgggtattttgygtygygtttttttggyggggttygggaggtygagggatyggtyggggttgttgtygtygggggtttgggttttttagttagttgtggattaaayggtttttttttatttaaattaattgygttaygygtaggyggygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyggtggaggataygaygygt

SEQ ID NO: 7002 - DNA, 2656 bp, synthetic construct
  misc_feature 1..2656: note = Description of Artificial Sequence: Synthetic polynucleotide
  source 1..2656: mol_type = other DNA
ygtataggaattttagtygtttaagtttygggtgggygygtygtatttttttaggtattgtttagatagttygttttttttttttgggygttttttttagtttggttggggtyggggygggttgggggaggttttygygggtttgtttgatatttgtaaatggaagtgggatttaatttggaaaataaaygygttagagtttgggggyggagaggagygggaggaggggagaggggggaaaaagattttaattattatygyggttttagygtttttttttttygtygyggttgttgtaggttygtttaaattygaagttgagttttattgggygygyggyggyggygggatggagttggagttttyggtygaggygttaggagtttattagatttygygtgttagagttatyggtygtttaygtttygggtygtaggygttattttttttygggagttttttttagttttttayggagatttygtagggttttygtagttttttygttttygaygtttatttyggggatttttttttatygtttggtttgagtttattattttagygagttgtagttttaggatgttatygttagtatatttatatttygggagtatttttgttttttttatttygagtaatttaagyggtttttttagttygtagttaaatttyggttatttttgtatttttgttttaagtaygttttygttatttttygtttataagaggagaayggtggaaagtgaataaaagttgtttttygtaaagtttaattatgtttaatgttaaattatttyggaaagtatatgtgataaaagttaaygagagaggagaggagggaatttagattatagtatagttaaaaatattygggttygttattatgtaagtyggggggttagatgtattttagtttagygatttttattggyggaattttygygtttatygygygtygygttaagatggtttaggttatttttattgttttttygttagygttttttagttttttatatttgttttgtatatatattggtttgtagaggggattygtttygaatygttygggagtggggtttgagttyggagttggtgtttttggygttttygtttttaattyggagatagttttttygtatttttggggatggttagattygygttgttttttttttaaagataagtagtttttttataygttygttaaaaattatgtattttygtaaagtatttyggttttttttttttgttaagatagtagggatagtttttgtttttaattatttygtaaaggatgtygtttttagtygaagagtygtygtygtygtttattatattttattttgattataagtttygtaagttygagttaggygtggggaayggattygtagattggtaatttttttttttttttagygaaagtggaggttgggttttttttttgygtygygtttygtttagygatgatttaatttgtatttyggggttttttaagtgtattatttatyggtatttgaatattttttattgygttygagaggtatyggttgttaagtaggttygttatttgaatttttttatttatttgtaggggyggttgggagtyggggatgggtgtattgattygtaatttttttygtaatttttttttagatttttagttttaaatttggttaatttttygtgtaaatttttyggttttygtygyggggttaagttattttttttttttgtttgtagyggtagtaayggyggttyggggttgygyggaggttggaattttataaggtgaaaagttttttttaygygtttygtyggttttygtttttttagtttatttygtagtttatttgtatttagtagttgaggttgtgtttyggtaggygygttttagtyggtgtattaggtagttaaattattaygttataaatttttaygtatttttgttttygttggygatttayggttttaygaggygtttttttygtggttttttttattyggtgttyggygtttttgtttygggygagtyggtttttyggttgttgtygtygtagygtttatygygygttagtygggattgaggtygygagtagaagygttttgygttygggaygtygtygtygtygtygtygggggttygtaagyggaggaggggagtygagatgaagagaatagtagygggaggagagggaygggaggygygagattttaattygtaggttagtttatagygtagtttgyggggaggagygtyggtttttttgtttgtttygagttgtagtygtygtygttattgttygtygtttggttgtttygggttttttattatagtygaygtygaygtayggttaagtttttttttagtttttttttygygtttgtttttygtagttttttttttttaaatygygagygaaaagggygagggggagaggagtttyggyggyggggatgattagygatttaggagygtggygtaggggagagggggygygygggagggggyggyggaggaggygyggygaattggagggtattttyggygtygggtttggaagyggttaattttagagttygagtttttttttagttttttggggttttaggatgatattaaygtatttttttgtygyggggagagygt

SEQ ID NO: 7003 - DNA, 623 bp, synthetic construct
  misc_feature 1..623: note = Description of Artificial Sequence: Synthetic polynucleotide
  source 1..623: mol_type = other DNA
ygatattaygygagtgtgtaygygttggggattgagttttygaagygaagttttgtyggaggagttttaggygggagtgggaayggttgggygtggggttagtaayggygttattyggtagggtggggggagttaggtttgttagagttagagygygttatygtygtygygagagaygtygygttgtttaataggtagaggygttttttagtagtttggtgggagtagagatataaaagtgttttaataaattyggagttggygtgtygatygygggttggtggygggyggygyggtgtttygygygttygggttttttggtttttygggayggttttgtatgttgtgygtttygtatttyggttgygygtttygattttagygggaggggaygttyggttygtaggtttttaggggaggggtggtttttgtaaaatggttttttattttttgttgttttgttttttttttttggtgygagttatygagttttaygagggtygggtygaygagtagagygyggaggyggttttggtygtgtttaatgtttygtatttttttttttggaataattatatttttttygattggtagaattttgtgggtaggaggygttayggygt

SEQ ID NO: 7004 - DNA, 1967 bp, synthetic construct
  misc_feature 1..1967: note = Description of Artificial Sequence: Synthetic polynucleotide
  source 1..1967: mol_type = other DNA
ygatgatggaaaggatygttaggygattttttaaaaggtttattaaatattygggttttattgttaygtttttattygggggygaggatgttttaaaaatattttttttttttygttttatgtggataggtygygtygyggtatttaygggtatygyggaaaggggtataatyggggtggttttygtttaggtggtagyggagatttagggttaggyggattaggtttggtttttatttttttttttygggttttgttayggtttygtttygtygttagtagagttttyggttygyggtyggtyggttagygtaygygygtaggtgtgtttgttaggatgtttttttyggygaygygtttaggttyggatttygyggygygagagtgagygttggygggggyggtgggatgttttaagtyggygtgaaagaggygagagtgggygagtaygggyggtyggattaggagtattttyggtgattatttagtttttattttattttttyggaaattgtygggtaggygggggatyggtygtagggyggggttttttttggyggtgagtgagygagatygttaggttgaagtatygggagattgttttggtagtttttggtygttattygygtygtaataaaagtttttygyggtttttygtttagttagtttygtattgattggtygtygtgggagggattygagttggttggaggyggyggtygagygttgtttttgtgtygttygyggagggggygtattgggtgttttttggttygtttygtgygttttttaatygggggtyggtygtttagggtaggtataayggtatttggagttgygatygygatatatagttttttygttyggtttttttygatygttttttagtataygtttttygtttagaatgttygtttaatttatttagttttttgyggtttttgttttttttttttttttttygtttattagagttaaagygtaaatttttgggtggaggtggggggatgatagttggaggggagggtgggtaygtatagaagaattttttagggaggtygggatggaaatagttaaaatgaaatgtatttttttgtatattgtygaggttttttgggyggyggygtaattttygttattygyggtagtattattattgttttttttttagttttttattgtttatattttgttaggatygggaatttygtttaaagaaaggagatagggygaggtgtttygggyggttatttgttatttttttttygtttygtgtaatattgggtaygyggygygtgtaaagatataygygygtataygygygygtatatattaggtagttttaattaygtttttttygtttttygttttttygtatttttttttgttaaaaygyggygttygatttttttattttttagtgttygyggtygagggtaggttttgtaattaattagtaatttggtaaatgaaaaattaaygttatgtygattggggtgtaataayggttatattaataataayggtygtgygattttgtttattttgttttattttgtaaatygttatttttttggggygggggaagtaaagtagygattttgattttattagatttaggaatataaygatttggggyggttgttttagttttattgtttatttttttyggagtyggggttgataagttatttttttttyggaattygagttygtgyggyggtattattygagtygygatttttttygtttygtygttygtttttggggaaggagygttgtttattattagygyggtygttgagtttttaggagtyggtyggttttgtttttatygtygygggygtataaagtgggaagggyggaygygtyggaggggygtygggygttggyggttyggggaggtagtttygtgtagygtagttttggagggagyggggttyggttgggtagtaagggygaygygt

SEQ ID NO: 7005 - DNA, 2558 bp, synthetic construct
  misc_feature 1..2558: note = Description of Artificial Sequence: Synthetic polynucleotide
  source 1..2558: mol_type = other DNA
ygtttyggggtggggayggaggtygttaaggttgggatgagtatttagtygagtygagttatygygtgttttttygtagatatyggggtttttgagaattaggagggaatagttaaaagaatggaagtttggygttttgaaataagttttttgggttttgagggaaatttgggygtttaygggtagtygttttttttattygtygttyggygttygygattyggttggygttggttgtagygtttagttaggyggygyggggaagagtyggygataattygttygagtttyggggatygatygygtttttatatttttttagtttttagygatttttatygagatttggagaygattttagtaaatttggggaagtaatttttttygaggagttagatttttgaaagaaggagagttgagttagggaygagggaaagygaaagagayggggaggaayggygatagttygggygggttggatttygyggygagagyggtaggggaggyggattygtttygyggygaaggggaagtataaaagtttygtagygagttgtgggaggaaaggygagaaggggtttgttygtttttttttttygatttagggtygtgattttttgggagygatyggttgggttttaggtttttggttagyggygttagyggttagygygttyggtttaagtayggtgygagygtttyggggaggyggygagygagtyggtgyggagygtttygtgygttygggtggtttygygggtyggygggatygtgygtattttaagygygtgygggagtgtgygaggygttgtgygagttagyggygggygygttagggtgggaaaggtatttygaaygtattaggtgtagagatyggtatttatygagagyggtygggagygtayggygagtttyggtgttatygtyggtttygtygagagtygaggagggttygtagygttgtagattttttggagttttttttttttttttgtaaaaggggggtggggattaagtttaattaagaaaaagtttattaygtttttttaaagagaaataaaaygtaagtagttttagttttgttttttttygtttttagatttattygttagttttttygattttagttttttagtyggtyggygaataaatatataaataaataaattataattttattttgygttygygtatyggttygtatatataagagtatttaygggttttgttgtttygttagtttttggyggtataaagttttyggattttygatttttttgtttaygtttttagttttygtatatygttaygttttttattttttatttygatygtgttttgaagaggaagggttggggaggtagttgygtttaggttgatagtyggggtttttttttttagtygatttttaatyggtggyggygayggttgtagyggtaggaagggaataygttaaataaaaaaggtataagtttagyggtygagtggtygaagygagygygygttttttagatttttttagtttygggaagtttyggygygyggygttygttgggyggtgygttttttttyggttttttatttatygtagtygagtygggtattgtggggtgggtgtgygtgtttgtyggggggtgtgtgtttgtgtyggggaggggtgttgttggggaattgttgtttttygtattayggyggtagygatagtatygttyggtagttygtagtattygtttttatygtttttaatttttttttgttgygaggttagtaaattattatyggttgttgygttttygtygygttttaygttaaygtygagtttttttttttgtaaggtttyggygtttttttatttttagtgttggyggtygagttyggttttttgtttatagttgtttttttttttttttttttttygygtygttttygggtttagttygtttattatttygtattggtygagttygygygygtttttygttttatttttttttttttttttttttttttttttttttttttttgygtttygygtttygggtttygtttgatatttagttgttgttggggygtyggyggtygttttttatyggtygagyggagaggaaggaaggagttagaggataggagtgtatggggatttagaatttttaataggggaattgagggtgaagggygygtagtagtttttatttatttttaagattttaatttgtattggataygggttttgttttttttttttygtatttyggtgtttaagtaygtagttttgtttttttttttaatgtttgttttaatttagtgygtgttatttygtttttaattttttttttatggttyggggttgtagtttttttgatatttgttttaaaaggtygtttttttagtttaaattyggtttttttatttttttggttattgygygtttttyggtttgagtattyggattttaataagtttttygaggtagagttygygggygttagtgaattaggtgttagaaggttygyggggatttattgtygaagygagatattygtttttagttgtygyga

SEQ ID NO: 7006 - DNA, 2558 bp, synthetic construct; identical to SEQ ID NO: 7005
  misc_feature 1..2558: note = Description of Artificial Sequence: Synthetic polynucleotide
  source 1..2558: mol_type = other DNA

SEQ ID NO: 7007 - DNA, 1508 bp, synthetic construct
  misc_feature 1..1508: note = Description of Artificial Sequence: Synthetic polynucleotide
  source 1..1508: mol_type = other DNA
ygttttttagatagyggagtygggtyggggyggtttggttygggtygtygtttttgtttttgggtttgtggggttggggttygtttgggtttygggttygygyggygtttattattyggggtgtygygggggggyggggagagyggtygtttagtttagtttygyggatgataggagtyggggagtygaggagggaggagtygtygtygtagtygagygttgggttgaggagtagagagagyggggygtygagtgygggyggttgggagygygttgagygggggagaggygttgtygtayggtyggttataggattattttttyggagaatagggtttttttatggtatgtggttggtaattttttttttgtttttggattttttatataaaggtgagatttgygygggyggttgggyggyggaggyggyggggttagggtggygyggttggyggygaggyggggtgttyggygggttttaggtgygtgggggaatygatyggggtgtaaggtttygggtggggygtagyggggaggggtaggtattttgataggggtygagtgagagttagttttygatygtttygttagttattygygtttgtygttttggggygygttygtaggggtggtggtaaaggagttttttatttttttgttttttgtayggyggtagttttgttttggattttttttttagttttttgttttttttttgyggtttggtggtattgggatttyggagtgtttttygagtygaggggtttttaggtygtgatttttgatttaggagtttttgtttatttaggtttyggattyggyggttgattttttygttatgttygtgygtttttttttygtygyggattttagttttggygygaatgttggygtatygtatggygtttattygygtattggttggaggtagggtggggatagtgagagtttygagagttggaggtttttyggatagtaagtttgttttttaaatttagaggttattttttttyggttttattttatttttttgtttyggttttagtttyggtttggtgygttatygtggttatttygggtagygygttttaagatgygagatttttygttttygygtttggttagttggatttggggataagtttttaggttggggggygtgttttttttttyggagagagggggttgttaggggtgggtttaggtgttyggtatgtttagatttgyggttggggygttgygtatttgattygygaggtagtygggatygggaggttggaagagggtagatattttygattgaagttatttgggtattgagtygggattaggtaggygtaggtagtttgggttttaggttatygtagaggaygtgttttygggygygtagatggygggagatgaggyggtygaatttygygtttttgygtggtggagtatataygttttaataagtttagygttatttgtttagttttttaatttttttttttttygtttyggggygg

SEQ ID NO: 7008 - DNA, 1119 bp, synthetic construct
  misc_feature 1..1119: note = Description of Artificial Sequence: Synthetic polynucleotide
  source 1..1119: mol_type = other DNA
yggtggygatatggtaggtagtttygygtggyggyggtygggatagttgggygygttggtaggagagtaggtatagygttttttataggtaggatgaygygggtttygtagttygtttttttaygttgtttygtattattgtttyggttttgaygtgygtgygatagatttatygtaaatagtttttagygggagtaygaggtygggataggaggtgggyggttatataggatattttattttttttattttttygtagtyggyggagtygatygtyggaaaagggaggyggtgggygaaaggaaagyggggagttgggagaggagttgtaaataaagagttgtttttgtgygaagttttgagtygggtttagttagttygttttttgtggtttaygtattgttygtyggtttaygygggagtttygaggggygaggyggaggttgggygtagtttttgtagttagtagttattttygygygtttygtygyggtttagttaattatttgttgyggyggyggtygtgttttttagggtgtattagtattttygtygygggygttgttttygyggygtyggtatygatgttyggttatttttaggttygaaygattgyggttgygggaaggygggtygaggggggttayggtattttagggagaggtygggagtygttyggatttyggaggggatggggttttttttgggaggtattygttttttttttgggttttaagattttttttagttttgygtttygattttatttttttygaaaygtyggggaatygggaaaggagggttaygggtaaagygggggygggygttttttgattagtatgyggygtyggttgttygggttyggattttygagtttttttttygygagygtatattaataagtttataaatggaattyggtggygtygtttgtaataaaaggtagaagttgygtttyggygttttaatgagagtattttttttygtaataaggggttggatttagttgtttggtgtygtttgagyggggygagttgttagagtaattaaggtttagygygtaygtggggagagggagttggttggggttttagygttagtygtygtttgygygttygg

SEQ ID NO: 7009 - DNA, 1119 bp, synthetic construct; identical to SEQ ID NO: 7008
  misc_feature 1..1119: note = Description of Artificial Sequence: Synthetic polynucleotide
  source 1..1119: mol_type = other DNA

SEQ ID NO: 7010 - DNA, 653 bp, synthetic construct
  misc_feature 1..653: note = Description of Artificial Sequence: Synthetic polynucleotide
  source 1..653: mol_type = other DNA
yggaagtaaggygggttagttatygtttygagttaaagtttttgtagttttggtaatttttygygygtttttgtttaggagttttatattttagagaaatttttyggygtttttagtttygttgttttttttaggttttgggatatagttttaagggattgagyggttyggaygggatttgaaatttttggaggattagttaygttygtatagttygtttatgygygttggtattaggattygtaggttgttagyggygagttttygtygyggttttttagggtattttyggagaagggggyggttttgaggaattttttgtatttyggatgttttatttttttygtttttagygttttagggttttgttygggttttggtygygygtggtgttttttttagtygyggagttttgttttttagtgtygttgaaaggaaagagaaagaaaaygttttyggttttggaggttttgtttttttttgaagygatgttattttttttttttatttttttttttttagattttttttggggtttyggtagaggyggggyggttgygtttygagttttttttyggyggtagygygggagyggggttggaaaagagggygtygggagtygtttygttttttatygtttttggttttttygt

SEQ ID NO: 7011 - DNA, 1768 bp, synthetic construct; identical to SEQ ID NO: 7001
  misc_feature 1..1768: note = Description of Artificial Sequence: Synthetic polynucleotide
  source 1..1768: mol_type = other DNA

SEQ ID NO: 7012 - DNA, 1101 bp, synthetic construct
  misc_feature 1..1101: note = Description of Artificial Sequence: Synthetic polynucleotide
  source 1..1101: mol_type = other DNA
ygttgygaggattaagggagatggaatgtagygtaaagttttaygtaaaygtgtygtgtaatatgaagttttttattttgagttggggagygggtggtaygygtggaagttgaatgttattatttttgggattaggygtagygttttttagaagygtttttggtgaygggtttttgtttttttttaggaygttttttttagaatgtttyggggttttggayggttttggagaggaygggagggaagggaaggagaygggyggaayggggaygtatttgtttttattgtatttttttygtttttttatttttagttatttgyggaggaggaagygttttyggygyggggaygygttgggtgtggagtagttggattayggggtgttttygtygttggagggygtgatttygatggayggtagttgtaggaattttttgtygggggttaagayggygggtaggtttygggttagttyggtttttaggttttgtttttgtaygttttttatgyggygtattttgaagygtyggyggygaagygtgggggtygaygaattggattagatygggttgttttygggygtattttgyggttygggtatttgtagggygggtagyggtyggttttttattatgttggtygtyggtatgggggtygtygtttttgygttttttttgagtttttygttagyggtttggttygygtttttttttggttgttttttattttyggtttygyggtatattttttaattttggggtygaaggaataagtttttttttyggagygtagygaggaagggaygygaggggaygyggygtagygygtygtygttyggagtttaatttttyggagygygygtttttygggtygttagtygtyggygaggttattygggaggggygggagtygtttgttagttattyggtagtttttttggggtttttttygygygttygtttgtttttttttygttgygttttttygtttgttggygtttttgttttagygggattyggtagttaggggttttagggggyggtgtagtaaatttttagyggtttgygtttagtagattaggttggggagtyggtttggygt

SEQ ID NO: 7013 - DNA, 1101 bp, synthetic construct; identical to SEQ ID NO: 7012
  misc_feature 1..1101: note = Description of Artificial Sequence: Synthetic polynucleotide
  source 1..1101: mol_type = other DNA

SEQ ID NO: 7014 - DNA, 2341 bp, synthetic construct
  misc_feature 1..2341: note = Description of Artificial Sequence: Synthetic polynucleotide
  source 1..2341: mol_type = other DNA
yggtttttgtaayggaggyggtttygaaggaygtaggattttttyggaggygatagttttaggagttttggttttggagtyggygtaygtttaggygygaagggygggggttyggggygttagggatttgtgyggaygggggttggggaaggtttttygtyggagaggyggygaggtyggtttaggagtttygyggagtyggyggttttttagygtttagagtygggygattgagtgtygagaggaagggaaagygttgatatgtaaataggggtttttatttggaggagttygtttagatagatttttygatatatttatttgtatttttattttygtgtaaygaggttatttatttattttagggtttattaggtagggattygagttygggygattgtagttttygttttygtygtgtttygtttttgyggagaggaagtttagtgtttagygttggggttaygggagtttygggtgtyggtgggagtggtggatttygaggtttttygtttttgatttygtttygtattttggggtttttyggtttttygtygtttttttttgtagtttyggygggtagygaggtgggaggggggtyggggttttattttgggggttgggatttygggggagggtygtttttaatgygggygtttggtyggttggttygygagtaggattygttattygagygtyggaggagtyggygygaagtyggggygyggagggaagggagagaggttaygtttttygggaygygggtttygtatttattygttygtygtttygttttttyggtyggttttygtygttygygttygttgtttygtygtttattttaatagtttygtttatttggttaagtttgtagtygagttttttaatattttatatattgattyggttatagtttgatttygtagttttttyggattagttyggygyggtttttttggygttttgggttttttttgygtgttttttgygagygttttgtttttatttttttgtgtaygtttgttgttgtagyggagygaaagagatagttaatyggatgaaattttttttttagttaattttgggaagtgattttattttgygaatyggggaggaagttttatttttttttttttttttttttttttttttttttttttttttttttttttttygtttygagtttttttttttttttttttttttttgtttttttttgttttttttttttttttatatttttttttttttttttgttggttttgtttttygtattatatattatataaatataygyggagatgtttagatatatttatgygttgygtatataggatatttgtttttgggagataagagttagtygggaataatgayggggtttaygtttagygttygygttttgattttygaagtttgaatttttttttattatttttttttaaaatttaaagttaaagatttttggtttttttgttttttttgaggyggttggtygaaggtggtttttttgatttatttatttttygtttttttttatagataygtttattaatgttttttttagtyggagataaattttttgggggtggggtagggggggtatggagggagagttggttagggttgygggtaatttagygtttattgtyggggaagattyggaygaaaatygaggtaaattaattattaaaaagtgtatttaataagaatttttttatttaggtttttygttgtygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggaygttttttttaggatagttagtaggttttaggagygtagtaygtaatagygtagagtagatttagatttttttyggggtgagattyggaggttygygttttggatygttttttttatttagtttggaggtyggygtttttyggtttaattyggagattttttygttttttttttgggtygtygygygttttagttggagtagtttygaggggttgggttttttyggtyggatttttttttttyggatatttaaaataggttattttgtttaygtttttyggattaygt

SEQ ID NO: 7015 - DNA, 3857 bp, synthetic construct
  misc_feature 1..3857: note = Description of Artificial Sequence: Synthetic polynucleotide
  source 1..3857: mol_type = other DNA
ygagtagaaattatygtgtttttgggggtttttygggygtygtggggygaygyggtgtagygtttagggtygtygtaggtygggggtagggtttttagyggttttttygyggttagyggttaygtaggaaaaattygttttttygtttttgtatttgttgataagtygttygaggtgtttgygttgagygtggttatatygatgtagttttttaggaaatggttygggagggggagggggygagtgagggattaggttyggttttttttygttttttttgygtaaatattattattttttttttttttyggaggtatgaggtttttaygttyggtttttygttygtattttygtygattttttyggtttygygttttattygttaggttttttttttgggagtygattgyggtgaagtygtygttagtayggtyggttttgataygtgttttaaygtatgtttgagttaaggttgtttttataggagataygatttggtggygtttttttattttttttttttygttattttttatttttatygygttttttggtgtattttattttaggaggaaggggagagattagygttttgatgtgttggttaagttggtaygtgtagygggtatggygtggttygagttttttgggtatatygaggtygattgagtgttttttttatygagagagggggttygggtaggggygyggagagttagtaaggyggggtggggygygggttgggtgagtygtatattaggttttttgtaaggyggaggaggggagygaataaattagaggtgtaagygattaatttaggtttyggagttagtttttttaaaygagggtggggyggaaggggtggtgggggggaaaggaggggatatygttttaaaagggtgaggaagagtttggggygtygttttttttttttttatttgtatagttaatagttttggggtttttgttattgygygttgattgttatygggtagattattttttttttttttttttttttttttttttagtaggaygygttttttattatattaaaaggaagttaagggagggyggagggagagygggygttggggygggygaaagttggggagaggttyggtygttttygattttattaatagtagygggaatgagtattttattttttatatgtaaagaaaggggagggaaggggygggygaggaaaatgtttaattgttgtggaagttattagtttttaggaagaaaaaaagttygttgaaaaatttaagttgtaaatttaaaatgaaatagtttagygtygyggatgatattygggtygaatatygtgtatattygtatatagtyggtttygaataattatttattggttttagttaygttgggtttttygatttaagtttttgagttatttyggataaggatatttatttatattttaagatttttataagggaattattttaattttatttaagttatttttgagyggattaaagaaagttgtagyggggagaggygagagaaggagggagggygggaggtatttttaaagtataaatttaattygataggtaagggatagaggtygtyggggtttttagtttttggatattatttgatatagttttgygagtaaggttttttttatttygatttygtatattttttttttttyggggaaaggtatttagagttttgggtttttygaagtgggggtagygggggygaggaagaagygggtggtygtttyggggtttagtttatttygaggagaatgtttgggtggygagtttttaygtttygggagtgagtygagggttttttygttttttttttttttttttttttttatttygttttgttttatagagaaattttagyggggaggggggtagygaatgggaggggtagagagggtygyggtyggatgtttttttttttyggygttttttgtatttatggagattygtaagttygggygtttttygygtggtaggttygttttttgaagtttttttgtttattttttttttygattattgattgttttygagygtgaagttygttatygaatttaattttyggtggttttgtagatttttataygtggggtggggygtgagagggtgyggaggttggtaggaatgtttttaggaggtttggattggaaattgagtttttttttttggtygttattttagttatgtgttaaaattttaatgttttgttaaaatgtattttatttagtaygygggaaaaygtatgttgttttttaggtaaaagtgtatatttttttttagtgtagatttyggttttaagaaaaagygtaagagtttgtgttttggttttgaagtttaaattgattatygtggygygggggtggggggyggygggagggggtagattgttggtttttttttattttttttttattttttayggaaaaaaaaatatatatatatatattttatgtaggattggtgataaattttagygaaygttagttttattggatttttatttttttttyggtyggttttttattttttaygttagygttttggagtttyggttggaaagtgtataaagtttggaggtggagggtgtagtagggtgttgggtgtttataggtatttttttgtaggagtttgtagtattaagtatatatatttttaagtttatttggaggatgttttttagttaggtgatttygyggtyggtttaaggttygggagtagygygagttygagtttygtttttttygygtaggggygtttaggttaggtggggagygggtagtgattgagtttaggtttagaaatgggagttattgtttttttttyggtttttttaaagagtggagttgtgtttgtgttttttygtggagggatggayggttaattaaaatygaaaattygattggtaaaatgygaggggatatataaattygaggggatatataggaggtatattaagaggaaggagggagtgtaggtaaagtagaaaaatgyggataaggagaagaggaaaaygtygggaagyggagagtaygggggagtagggtgggtggggaygggtagtgygattgtaggtgtttattygttttygggattttttggtygtagtygygttygtyggggygttgggtygttgygttttggaggggggtagagttygttaggtttgtgtattygtatttttttyggygaatttyggtttggayggggttggattattgaggyggtagatgygataggygtgagttaagaaggygagygtttgtygtttgttatttatttagtattttattttttttttttyggaaaaaaaaaaaattaaaagattygaatttttttttttttttgtttgatttagtttaggataygttttaygyggtygaaaatagttttggaaatatatttgttttataaaagtgaattttttaataagttttggggyggggggygttyggyggtyggygtyggggggttttgtttttygggaggagaaggaatyggtygttttygtttttttttttttttaggygttttygggagggggtygttgggyggyggaatygygttttygttyggggagttattaygyggttttttygyggaattttgaygttatttataygtgggggaaggggttgggagagtaagaggaagyggygggggagggggtygyggttgggagagygyggyggyggygyggygggtttggtattttygyggtgggygtagygtygggtagggttygggttttgggtagygyggtagaggaggtygtgtygyggatttyggagttagygtygygattygttttttttttygtttttygtttttygt

SEQ ID NO: 7016 - DNA, 1439 bp, synthetic construct
  misc_feature 1..1439: note = Description of Artificial Sequence: Synthetic polynucleotide
  source 1..1439: mol_type = other DNA
ygygggttttttygttaagygggaygtygygtygggygggtgagagaaagttygggtaggagagtatagagtyggygattggaygygagygyggggygggtggagagygttttttygggygtygttgttgttgtttygggtgttgaaaagtygggaatttttygggaagtagyggtatttttttttttggaaggtgggtgtgggggttttagattgygtatttgttaaatttttttgggtttttygggaggggttygttagatgtgtttttttttagttttattygggggagaaggatgggggygggggygtgggggtgagtatagtyggatatygtaagtgggaatttggggtgttttttttygtagttttygggtagtygygygtygygaatttyggtttatttgtaagtaaggygggtygggggtagagggygtygggttgtgygggggaatyggttygygtttygggattggggggyggtggaagagagagygagygggtatgygtagtggggyggaggaggtggygatggtygggggaggyggggggattgttgtttatttgtagttgggttaatttygyggygtaggyggyggyggagygyggggagttygyggygggtttagttgtygtagtattatgttygagttttttttygggtagaygtygygygtygtyggggtttyggtaggggaggatgttagaygttygggagaggttagggtagtagyggyggyggyggygygatggtggtgattatttttgttygaggyggyggyggggatygtatattttttyggyggyggggttgygggttagygtyggtyggggtygyggygttgttggtyggggtaagttgtttgtgttayggtygttttttgtagggygagttygtgtaygaygaygtgtgggygatygtgaataatttygaygtgyggttyggygtttygtttygttggggtatttttattaaygatttttggggtaagggtatggtygagaatattagttataagttttatyggtygttttgygtttttatttttaagtgagttttttatttygygttagtygtygttgttttttttatttttygttygtttttyggatygggagaagttgygggattgatttgggggtattttatttttgtygttttttttttttaygttttttttttttttaggatgtgtatggtattttgtttygggatttattgttyggttaatttgggttttyggggyggttygggaggygtyggttggggagttgggatygagttttttaattgtttgtttttttagygggtttttttttygaggtagggttgggagygggttggtgaaatygttttygtattttttygtttgtyggatygtgattaagtgggattagygyggatttagagggtttyggaggggtggyggtggtggyga

SEQ ID NO: 7017 - DNA, 1288 bp, synthetic construct
  misc_feature 1..1288: note = Description of Artificial Sequence: Synthetic polynucleotide
  source 1..1288: mol_type = other DNA
yggagagggtttttygggttaattttgggtaaygatgagtattttyggtttyggtaggggygtygggtygttygtttttttttttttttttttttgygagttttttttttagaggaygyggggagtygggtttgygygtttygtygtttgttatttagygttygygtygggttgygattggaygygtygtygttaggtattygttagaaatattagtgygttggggagaggaggggggygtgtttgygagtygagggtttgttttggtttttttayggtttttttttttttttagtattttatgtygggtttttagttttagygygtttyggttygttygygyggygggagagttggygtaaatttygyggtagtygtagttttttygygygttttttttttttttaygtttttygttttygttatggggttaaygtggggtttttaagagttgtyggtttttagyggygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatygagttgtgtttygtyggttaggtggagtgggagaagtgttygggtattttttttygggataggggtagttagggyggaagtagtataggtaatygggagggtttygttygygttttygygtttygttgggatttygygygttaggttgtaagtttyggggttttgygtttttygygtygttttygyggtatatttggggygttaygtttttttatttygttttttttttygtttagtttttgaygatttygagggtggggygtttgggttttgtttttttttgtttatttgtygggttttttttattttttggttygtttttygtttttyggygtygtttttygtttttagtttygtygygttttttygygtttttttaygttttttatttttttttyggagtggagaagtgagtgygggyggtgayggygtygggayggttygyggtttggttgtttgtgggggyggtttatttgtgggattagggttgttttygttygttttatyggtygttggtttyggttttgttgatgggggttaggygggayggataagttatgtttggaygtagaatttttttgtagaggtggttgttttggttttygaggtaattygyggttgtaatttgtygg

SEQ ID NO: 7018 - DNA, 1006 bp, synthetic construct
  misc_feature 1..1006: note = Description of Artificial Sequence: Synthetic polynucleotide
  source 1..1006: mol_type = other DNA
ygagttygggtttttaygttttatttggtagggggygygygggtttyggagttgtttagtattttttggttaagttttttgygtttttygygttygggaagtttttygygtyggggaagttttttagygtttygttttyggtagggaatttttttattaggatattyggggttttttaggttygttattygtttttattagtttttatttattttgtttagttttatttyggtagtgtagygtgttttggtggttttttttygtaygttttggagggggagtgttttgtatttyggggttgtttyggagtttagtgtaygagtgtatatgggttttttttttttgtttaaagggtaggygagygttattygttttagttttgttttttgtagttgggtggtttttttttttttttgttttttaagataygygttygaaatygaggggtgagagtaaagatygtttattaatttagtattttggatttagagtttttaatttygaaaggaggttggtattgttygggttatygagagagggagggagaagagttgaggttgtaayggtttttgggttttttagatygggtttggtatttaggagatygtgygggagatygaygttgagygtyggtttygttttyggyggttttttttttttttttatttygtttttttyggttygtttttttttttttggaggagtagttttttygygygtttttyggagttttttttattgtttttgtttttataataggttygggyggyggggaagaygggggggtgyggggtygttttagttygggtttttttggggtygttttttttttatygggtgtgygagtttttggttgtttttattyggttygggagttaatttttygayggagtygygtyggggygagttygattttttttttygggtttttttygggtygygttgtygtttyggttttgygtgtgggaatgatgtgygtattggagggtttaagttttttaygygt

SEQ ID NO: 7019 - DNA, 1185 bp, synthetic construct
  misc_feature 1..1185: note = Description of Artificial Sequence: Synthetic polynucleotide
  source 1..1185: mol_type = other DNA
yggagagttagggttygtttaataggagtaygyggagatattttagaygatagygygttttttttatttttatttygtttttygggygttttaggttagygtttattagattttaygtttgggggattgtttgggttttagygagagtgttayggttttgtayggtagyggggaggtggygagygygttygatttaygtygtttttaygtttatttttttttattaygagttttttttttttgttatagtattatttttattgttggtygygtttgttattttgtggggttggtgatatgaatggatgggttggatatatttttygttygtttagaaaaaaataaaaaataaaaaaaaaattygtttagatttgtatagagagggggaaagatttttttttgygtttttagagtttaygttgtyggttagagaaatttatagttttttttttttatatttattttttttattttttaaaaaaaygtttaaygtaaataaataatatygttttaagttygtygtygtttygggtggttttttttttttgtttggtttygygygttttagttttgygggaggyggyggygagaagttgyggttttgggtgyggtgyggggygttygggygataggygggygtaaggygggygygtagtagatyggttggygtygtattatgttttttagygyggtygtagtttaygtyggtgygtattgggaygttgtggtttttttygygttttttaattttttygttgygttyggttttggtaatttgggtaagagttttttgatygagaatttgttgygggtygggggygttttaaygtttaggttgtagtygttygygttttaygattyggygatygttttggttatygygggygygtagtttyggtttttgtttgttagtttagtttttttaaagttgtgtttygtagtygaataagttagtttygtyggggygttttayggaaygyggtgggttttttaagtgtttagtttttttgyggatagtgygaggttgtygggtygggtttygggggatygagattgtattttttagtttttagygttaggtgagttagtttttttttttttttttagtygygttygygtttttaggtygggtggtttagggatttgggagygtyggyggtgygtattgygtttagggagagtygg

SEQ ID NO: 7020 - DNA, 409 bp, synthetic construct
  misc_feature 1..409: note = Description of Artificial Sequence: Synthetic polynucleotide
  source 1..409: mol_type = other DNA
yggttttggttttaygygggtagygttagttggtyggtgttayggagttttygygtttttygttygtttagttttygyggatttatttattggggttgtttygtagygygatttttttttatttygggggagggttaagggyggyggtggggggyggggtgggggggaagyggygggagggggyggtgygtygtygttttatttygggttygygaattygtagygtttttygtagtatttttttaggttyggttttttttttttttygygtygatggtaygygtyggttygtttggttyggttgtagtggatgttgttagaatttaygyggaggaaggaagagaygtaggtaggttgyggttatttaagyggttattygggttttagggatttttttttygagagaygg

SEQ ID NO: 7021 - DNA, 1813 bp, synthetic construct
  misc_feature 1..1813: note = Description of Artificial Sequence: Synthetic polynucleotide
  source 1..1813: mol_type = other DNA
yggggtygttgygtttttttgattattgayggttaggayggttttagtttygttttatttgtaagttttattttaggttygagttttygagggtagggatagtttttygggtttygaggtttgattagagtttgaaagtttttgtygggggttgtttygatttagygaggygttaggttgttyggygyggttgggggygtttagygtygggattttagttttgtttyggtygttygttggtttagtgygtaygtttyggtagtttagtttttttttttayggyggtaggagagttttyggtatttgtttggggygggggygggggyggggyggggygggygtygygtttttttgtttgattggtaggaagatagattaatyggaggggtttttyggggggaggggyggtgtygtgtttgagtygggygygggygatygagggagttgtagttattygygtgyggtaygygtyggtygtttgttyggatygyggttattagtgtygyggtttttygattttygtttygtygagtygygygygygattgttattttttttaattgttttttaygattttttttgtgtatgtatttattttttgtttygttttgttttttttaaggyggtggyggyggygatagyggygtaagttygtagyggggagggggyggtyggaggatgyggygyggggttgygttygttaygttygttgttgttgttyggttygggtttgagygtygagtaggtgggtataggtgygtyggggggygggaggygagygttggttagagggaattygtggattyggygatygaggggyggatttggyggtaagggaygyggygatyggtgtygtttygttttatygtttatttttttttttttyggttatygygttttttttgggttttttttttattttygtattttattttagtggttttttatttttttatatttattttttatttttttttagatttttttgtaaaattttttagtygttgygtygttttttttaatattttttttyggtttygtttttagtttttagtttttttttaygttatttttatttttattttttttyggatttygtttttaagttaaggagygggagggggatttattyggtgtttgtyggagtggygyggggggtgtggtyggttygtttttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttgtygggtyggygygttttgggygtattggttttyggagatggygygtaaggattgattttygtggtgttagatattttgtygggygttttgygtyggggttagyggtttygttggtttgygttagtgygttgyggtttygttttttagtttttyggtttttygttttattttttttgttgtgggtttttgagtattyggtttgggtagtttagatagaggtygtttaygaggttggygttttttttygttttagaagtatttygtttttatatattttagttygtyggttttttgaaggttgggttagtttyggtttttygttagtttttgttyggttttttgagttttagygatattgtatttaatygttagttttttttygtygttygt

SEQ ID NO: 7022 - DNA, 1294 bp, synthetic construct
  misc_feature 1..1294: note = Description of Artificial Sequence: Synthetic polynucleotide
  source 1..1294: mol_type = other DNA
yggttggagaagttttygttagygttgtttgtggttagattygttttttgttttttttygggygtatatataygtttatttagatatttygygygttttttygygtttttgtttgttygttygtygtygtttgtttttttttttttgttttygtyggtygttttttttttttttttttttttttttttttttttttttttttttttttttttttggtattatagagttgttttgaaaatagaagatagagggagtttyggagttygttatttttagygatttttatattgggaaaaaatatggagttagtttyggtagttttygatttygtygttagygagttaggtagtagyggygyggaygyggtygtyggttttagggagatttygttgaattaggaattygttygtaagagygagtygtttgtttyggtgygtagatagagttattttagtattagtagaggtaggaggttggagaggggttggggagggggyggygggagttygggygyggagyggggggyggtygggagygggygttyggggygyggggttyggyggtygygygygagtttgyggyggygtttygagttyggaggattttttttttttttttttttygttttttagaaatgttgtaaatttttgtagttygttttyggtttgygggagtagagtggggygggggaggyggygggaaggttgatagtyggygggtttatttttttggttttgatttttttgtaaatattggaggaaagttgygttgttttaattaaataygtttttttaaaatayggagatgyggggagtgggggttygggaaagaaatttttaaagyggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggygagttgttygttaagttgtttggygggygyggygaggggagatgygtaagtttgtagatygggggttyggagttyggygtttaggttggyggggggygtgtgygygttaaygygtagagggyggyggttttgtggggygttttaygygtattyggagggagygt

SEQ ID NO: 7023 - DNA, 939 bp, synthetic construct
  misc_feature 1..939: note = Description of Artificial Sequence: Synthetic polynucleotide
  source 1..939: mol_type = other DNA
ygtygtaaggttatgggtygaagtggtgtaggggyggygttyggggaagygattggtagagttgtgygtattgggggtgttgtaggygttggggagagtgtggagaggttgygtggagttgygygttyggggtgggggttgtatttttaatgaagygygtgaagggtaagyggtgatgggttttgygttagtggggttgggagttygttyggggttgtatatggggttgygygtaaggtgaggattgygtatgtgggtttggggtttgygygtatyggaggttgtaggygttggggagggtgtggggggttgtgygtggggttgtttttatyggaagttgtaygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttygttgaggttgttaggygagttaggtttttttggatttygtttgattyggttgggttgtgtttgaaattgatttagttttattatattttttgattatgagaaaataaggagtaagtttaaagyggttgtaatttttyggtygtagttagtttaaggggyggygyggggtttttttygttygggagtyggaggtagaggaggagatggaaaagtyggttttaggyggygggaaattgttaaggggtttttggaggtttttttyggggaggatttaaagtttgaaagagygaaaaggtttggagttagaggtggtggttaagattttttttttyggttttttttagttygttygtaattttttggygtagtttygggaaaaggtgtaggaattgtaggygyggyggttttttagtagaattattttyggtatygg

SEQ ID NO: 7024 - DNA, 939 bp, synthetic construct; identical to SEQ ID NO: 7023
  misc_feature 1..939: note = Description of Artificial Sequence: Synthetic polynucleotide
  source 1..939: mol_type = other DNA

SEQ ID NO: 7025 - DNA, 899 bp, synthetic construct
  misc_feature 1..899: note = Description of Artificial Sequence: Synthetic polynucleotide
  source 1..899: mol_type = other DNA
yggtttttgagggttygggtagttattygtattttttygttaygyggagaaagtygagtatataggtygtagggtgggggttygyggggagagggtggaagtagygggtttttygygtttggggtggtygttgttttatttaggttttygtttgttttttatttttttagattaatygttttttgtaggtgttaaygyggtgtttygtattaggtggtaygyggattttttttagagtttttyggtttagayggagttaggttaaggtagaagygygggtagtttyggygttattttatagygttttatttgtagttttggggtttttattyggttttagggtgtatagtagtyggggygyggttygggaaatgtagttgygttttttgagtatattgtttaggatggtgtttaygtygtygttttgtygttttaggtattttttttygygttttagagattyggttagtttgttttgtygtattygagagygtttygggttttggtayggttatygttygtttyggttttygttattttattygttgagyggttgagttygyggagttgggtgagtgtttgyggttgatyggttygtgggagtagggagygtatagtyggttggtgttggagggttayggggatttayggggtatygygggagtygtygagygtagggaagttagtaggtatttgtagtgyggagtttgtaaggttgaggtaggagatygttygaggyggggagggygggagygagygagygagygagygygtgggagayggaggyggygtgttygtttttaatttyggtatygtygtgygtaggyggggtygttttagttttttygtgtttagaagygttagagatagggagttagtgggygygtaattgygttygg

SEQ ID NO: 7026 - DNA, 899 bp, synthetic construct; identical to SEQ ID NO: 7025
  misc_feature 1..899: note = Description of Artificial Sequence: Synthetic polynucleotide
  source 1..899: mol_type = other DNA

SEQ ID NO: 7027 - DNA, 547 bp, synthetic construct
  misc_feature 1..547: note = Description of Artificial Sequence: Synthetic polynucleotide
  source 1..547: mol_type = other DNA
yggygttttggygaattyggttattttagttttttaygtggtgagtatttagggtagygggtygatttttygaggttttatatttgggtttgaggggygyggttygtagyggygggtgtaggggygattgttagtttttatttygtttyggggtgygttyggaggtygatatttggaggaygtttttagttttygygggaygttaygtttgygygttagggattygggataagaagtgygygtygggtttyggttgygygtygyggggttattagtttgygygtagggtttaggygatygtgyggttatggataygttayggggtatyggtattttygtggtgtgggattaygtggtgttygygggtatgttggttatttyggtygttatyggtatttattaygttttygttgggggyggttagtagatttttaaggattttttgatgggyggtygtagaatgatygtagtgttygtggygttgttttttatygttagttttatgttagtygttattgttttgggtatttttttygaggtttatygt

SEQ ID NO: 7028 - DNA, 2505 bp, synthetic construct
  misc_feature 1..2505: note = Description of Artificial Sequence: Synthetic polynucleotide
  source 1..2505: mol_type = other DNA
ygtttygtttygtatygggggyggaatttygygttttyggatttgggatagtattagtagygtgaaataygygtattygagtgtaggagtaaataggtaattttttgttttggttatttttagttyggtygtttttttagyggtttgggatagtagygygtggttgggaagaygygggagggggaygygaggtaaatttgygttaagagttggttaggttaggtgagagggagtggtattygygtagatatttatygttggygtttttttygtagattaggtgttggtagggttgtaggagattttagattttygagtygttgttgatygtgtgttttagggtttttayggtgaatttgggygtttygtggagygtatggtggtggtgatggtggtggttggyggyggttgtyggygggattgyggyggtygyggyggtyggyggggygtaatagttgttgttttygttggygttgttggttgygttgtaggygtygtygttygtygtttttttttygggygtttttygttttttattygtygygggggtygtattagggttygagttygggtttgggtyggagttygagtttgatttagggttattgtagtttyggggtatttyggaggttaygattygygagtagatgtttyggaagaggttttttatgtaggttgttaggtagatggyggygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtygtygtatagtgygyggttaggttttaggatagtaygatttttatggygttttggatttygtatttggtgtatttggygaagygtaggtttaggygttgygtttttttggttatgygtattagygttyggtttattagygtygatagtttggttagygygtttttgggtaggtygtyggggatygtygggtttgttyggggatttygygaaygtagtagtagygtttttagtttttggagagtttaggggatttygtttaggttyggtagtagtygygagtagtgttggtyggygtagtttagtttttyggagttttttattagggtagtgttgatagtgttaaagttgttgtgtyggttgtgtatggagttagttagaggyggttagtagttttygttatayggggaygtygggtgygagtyggaatagtataaagataagttggaggagygtatygagttygtygygttattataattygagtttagygttagattttttagygtttttattaygggttttttattttttttggttatygttgygttattttatgttgtagtygtttgggagttaaagggaaggagyggygaggagtagygagtgtygyggggygyggggagagtygagttygygtygttttggtttatttttttattagtygttgttattaattgttagtattttyggttgtttttyggaattgtygtygttggaatatatagagtagattttggagttattttttagagttygggtyggagttgggygtaatggggagygagttaggtygggaaggaagttttygtyggggtttgttttttttttttaaaataaaaagtgtttagatygtttttttttgagtttygttgggygtagtagttatygggygtyggttayggtgttygtgggattgagattattttagatgtygtygtygtygtagtttygygggtagttggttttyggttttyggtttttagttttyggttttggttygttyggygttagtttgttttgtatyggagygtagtagyggtygtggyggttgtaaattttgtygaattttagtaaatttygggtagttagtgggaygggygtatgtaaagtaggggyggyggagagttagtggaatyggagaatgttaattatttygttttttttttttttttttaaattttttttttttatgyggtttygttttttatataygttttyggyggatatygaggttgtaggaagtggggagtagtggttagggatttggggaatttttgtaagygtagagaygtggatgttgttttttgttgttgtttttgttygtattttttyggagggtggtgggttgggtyggtgatttttttatttaggtgtgttttttatygyggtttataaggtgtttgtttgayggtygtttttttttttgyggttygtattttattttttttttttygtaatatttgaaatatggtttttttttttttttatttttatttygggtaygtaaattaattagtgyggtttttttttagtyggggtttgttttagtatggagggaaataagtttgtygagyggaggttygtggyggtggatattattgggaggtyggattttyggttattygttatttgttattagggygygttaattyga

SEQ ID NO: 7029 - DNA, 1587 bp, synthetic construct
  misc_feature 1..1587: note = Description of Artificial Sequence: Synthetic polynucleotide
  source 1..1587: mol_type = other DNA
ygaggagtggggygttyggaaggayggggattgggaagyggttaggayggggagaaggygygggtgttggaattatttattagaagaaatttaaygagatttgtyggyggattaaaaaaaaaaaaaaaagtgggtttttttttatttttagattgatgatttygygtttttygygaatgttayggttaaggtaggatgttttaatygttttgttattygtattattttttygtttttgattttygtygtattygtygagattttgygagattttaaggttggggggttttgttaggygygttyggggtatttygggaaagaatagaggtyggagtygygtttttayggtgygttttttgagattttattttttagtttyggtttttayggggttygtagagaatatttttaaatttaggggaggtatatagatttttataaagggaggatggggagaaagtgatggggtttygaagagtygttttagggaaggagagagaaagagtagggaagagaggaaagaaatagaagaaaagtagagaygggagagaggagaygaggggagtagyggggagaaaygtaggaggtagaataagtaaggaaattttttatttaaaagtttttttgggttygagggttgggagttatttgttttgygtygttttyggttttttatygttttggaggtaggagygtaaatttgygagygttygggtttatttttatygttygtttgtatttagatttgggaaggggatggaaggggygggggggtaaaggtaagaagtaagaygaattttaagatttyggttygaggagaagaggtttgtyggygtttgyggttagttyggyggyggyggttttggyggyggyggyggyggttttygggtggyggygygttygggttgygtagttaggygggyggygaaggttgaggtgtyggygagyggyggggygyggagtygttttttygttaatttyggtttttttttttttttttttttttttttttttttttttttttttttttttgttygttagttttttttttttttygtyggagttttagtygggtgyggattggtaagyggygygtttygyggttttttygggygtygygaagttgggaggygygtaaagtgyggtttaggggggatygtygggggttttygttagtagttttttgttygaggtygtagtttttgtttttttygtttttygttyggtygtttggtygttyggtygtttygtygatygagggtttattagygtttttttatggtygyggtagttaatygatgattgaatygaataaagagtagyggygagattaatttttaatatttatygatgggtagygggyggtygagtttyggygagtttyggtagtygtygttygtygttttagggygttygtttgttygttyggggatttttttaatgygtttagggygygttygggggttttttayggtygygyggtyggygttgttygtattaatttggagtygtygtagattaaatygtttttaatattgaaatatygattttatattggyggttattttgggggttatygagaygygt

SEQ ID NO: 7030 - DNA, 5693 bp, synthetic construct
  misc_feature 1..5693: note = Description of Artificial Sequence: Synthetic polynucleotide
  source 1..5693: mol_type = other DNA
ygygyggagagggtttaagagygtttttttaaaggtttagtttygtttggagagagtgggygggtatygggtttttgggggaggggttgtygtaggtttgggagggaatttagyggggttggtygtagtttgggtaggtygtagtttgggtyggygggaattygttattggattgaagaggygtttggtygtygttgaygtygttgtttttttttygattygttygttygtagtgttattttgtayggatygtagtttgttttyggatttttaggaygtattgtaggaygattttaaagagayggataattygatttygtyggataaggagayggttaataaygagaaygaggagtagaattygggtattaagyggygyggttttygtattattattaaggttaagtagttggagaygtttaaggttgttttygtygttaygtttaagtttaygygttatattygygagtagttggygtaggagatyggttttaatatgygygttatttaggtgyggttyggggygggtatagttttttagtttygttggtttgggagtygggagtttyggaggagtttttygttaagtttttttggttaygagygygtttggttttggtttgggagtagatygtgygttygagtggggtatttgttygaggtyggggattgtgaatygaaagattttatttagttttgttgtttttttggtattgygatttgggggygggttattttatttttttgaatttygtttttygttttgtttatggaaggttgtaagtttttttggggttygggatttttttttatttttatttttygagtagagaaataggygatgttttttttttttttgygtygaagygygggtagataaayggttagaggttggtttyggagtygaggggtygaggygagagtygtgtygggagggaggtttttatagagtygttaggtygygggygagtyggggattaggaagtttaagtttttatgagtygttttaygggttygygaaattttttatttttggttggttygtygaagtttttttttatttttttyggtttaattyggttyggtttygtttygggggagttttggtgyggaagaggygtaaggatttagtaggggtagtttagttagggaagggagaagagggggggagaggatatttttgattttgggtttatagtttttttttttgttttaggtgtggttttagaatygayggtttaaagaaygtyggatgaaatagttgagygttttaggygttyggaggtaygttttttttyggagttygyggygtatgygttygttgggyggtygtttggaygagtttgagatgttggggtttatttygtatatttattayggaggtaaggggygtttygggattygttgtttygtatttgttttatttygggagttgagggygaagggtttyggttagtaygtttttygtygttttagaatatygtttattygttggatataygattatagatatatgtatatttatttatatgttttggatataaaattagatatatggttttatttatatagtgatgtatatagaagtatataygagatatagtgatatatttatttaygtagggtataaggtgtatttatatttgygtttagagattttagggatataygtttagataygatygtaygattaygtataggtaaattttatttttttatatataggtatatttayggagatataattttatagaygygtatatttttattagttatattgaggttagtattggtaaatttatatgtatgyggtttttayggatagaygtatagtttttttgtygttttgtgtttggtgtatttggtatgaggtggatttygagygttggagggtagtgtgaggggaggggatgggggtttggatttattttaagtygtttgtttattagtatygaaggtagtaatttttgttttatgtggyggggtgtgtgygtatagtatttggtagtgttagtttaaatgtyggtagttgttttgggtaggattgtagtttattttttagtttygagatttttggggtttttatagattgggggtataagtgttgggttaattttagatttttatygtttttggggttgtagagagygaggagttttagtttataaagggttttagatggtggtattaggtttgggtttggggtgagttgtttttttgttattttagttttttttttttttattttttttatattggattggtgagttattttaattttttttattygatttttttagttttttattttgagtygtattgtttgagtttattaagtttattgttttgttttttttagggttgagggtttaagaaagtatttttttttttttattttgaagtttttgaatttggagagattttaggattgtttatgtttgagaggtatttgtatttttgagttgtaaygtaggttaggaagaggtaattttttttagaaagtgggtttagtggtagtgttagtaaggtaggagttaggtatttaggtagaygtagaagggaagggaagataattttattattaattttagtatattyggaagtttgaggggggattagattttgagatyggatyggggtttttagaaattgtgggtaaaatgttaggttgtgttttttagggtagagattttaggtagtggtagggtttaggttggagygttttagtygtttaattttggatagttttttaattttggatagatttttaatttyggatagatttttaattttggagagttyggatggtgggygtgtttttyggagtttttatttatygattttttttatttaaatttgtttttttttttataaaatttgggttyggagtagygaggtagtgggggyggtatyggttyggaattttttttygtttggataattaattaaggttttttygaggattatttygttttygtttygatttattttatygttttttttttttgygygttggatgaggtggggagttggatattgggggtttttygtttttygtaatggtggggaagattttttagtttttagygaggtagtttygtttaattygygttgggagatttyggyggtggygatyggtagygggygagaaaggggtygggyggyggggtyggyggtttttygtgggagygyggataaagttttagttgyggtttttgtgttttttttagayggygtttgttttaattattttyggttyggtygttatatgggyggaggyggygygtayggygygggggtagyggttttygttggtttttyggttygtygygggtygyggtygttttttatttttgtttttttggggttttaaatttgtygttttttatttttttttttattttyggggagaattaaattaatggttttaaaaagtaattggtaatygttttagttgttgtttaaattgtttttaagttaygtttttagatattttttatttggatagattttagggtttggagagggaagagggtggtagggggtattaggaattygttttttgattgagattttaggatttagtagggggagtggatttgtagaagagatttaggtttttggattygttggttttttygtygtataaagygggtgtttggtataaggtggttttttygtgaygttttttaygttagttttttagggttttatttggtgggggaaggtaggatatttygaaggttttggaaaaggggttatgtggggyggttagagagttgatatagatttgttgaggtagaatgggtttgtaattyggagtttttatattttttgaatttatgggtaaaatttttatttttgtattttttttgagagagagtttatagttattattagttttttaaaagattttaatgtttttagatgttttagaatttgggggtgttggtaaaattaattyggggtaaggttggaggatygagtttttattttaaggagttygyggagttttggttatgatttagagaattttygtgttttttttttttttttttaagtygttggagtttagtttttttttttttaggttaggttaggtyggtataaatggttttatygggatygaygyggyggtygtatttggygaggygaaggatttggattgggttggtagggygtagggatygagtttagggygttaaggtygtttygttyggtttaatttattagtygtttttgtygyggttyggatttagtttttttyggttaggtygtttttyggttttaattatttygygttttgttttgttygttggtttgtttttgttyggttttttttttygggtttgttagttttygtttttttggaggtttttgggatttatttttgatttatygttttgygttttttgggygtatygatttttttttattttygggtttatttttgattttttygttgtygttttygggggtttttaygygtgtttttaatygyggtygttttttttttttttgygttttttygattttttygygatttttygatgtttygggttttygggttttagtygyggatttygtgtttttgggtttttttttygtttttttttttgtttttttgtygattttttygtttgtttttygttgtttygtatttttgtgttttttatygattttaagatatttaggaattattgtttgtttttgygtttttggtygtttttgtttttttttatttttaggtgttagggaatttgtgattgaagttttygagtttttgtygygtgtgttttttayggtttyggagtttttttygtttttgtgtgtggtttttggtagtttgagttttttgttttttygagattttttattgtttttttttttaatttttttygtgagtttgygaygtttatygttttaaggggygtyggttttygtaggtttttttaattttgggtyggtgtygygygtttttttttttygttygttygggtttttttttygggtttygggtttttygtttatttygtttttttttatygygttttgtttttttttygttttttttttgtagattattaaggygattattaygygtygggaagtaattaygattttttygygtayggttygttttygtaggygtagttttyggtygattttagttttttggyggtttttggtttyggttygaygtygttgggagygttggaatygtygttygtyggttygtaygtygyggataattttaggtttatygatatgatttygtattyggatatatygagtttygagttaggtttgtygggtaygttgtattttatgttyggygaggtatttagyggygggtttagttygttttttttaatgagyggtattagyggttatagyggatttttgtygtattttaatttygagtttaaygaagtygtygtgtggtaaggtygtygggtygtttttygygttyggttttygggggtttygtttygaagtagttttttgaaattaaaaygttygaygtagaygyggtgggagaygtgggtgtttttygggggttttttttygggttygtatttaattggtagttgtttttyggttgggygtygagggggggtygatttttatttttatttygygggttttttaggagttttagtttatygttagtatttttttagtaatygyga

SEQ ID NO: 7031 - DNA, 589 bp, synthetic construct
  misc_feature 1..589: note = Description of Artificial Sequence: Synthetic polynucleotide
  source 1..589: mol_type = other DNA
ygtygyggaggttttagyggtaggtgygttttagtaggtagtagtagtygttattttgggtaagtagtaaatttygtataaatttyggagttattatgtttgttttttygttttatygtyggtttttttgttaggagtagtagaggatgtggtgaatgtatyggttttatygaaygaggtaatygtttyggtagatggttygggaggtttaggagggagttygtyggtygagtyggttggggyggygggaatggyggattttagttyggttttgtattttgtagagtatagtttgtagagattttgygyggttyggagtttttyggtaaatggagtttgggaggtygtygyggttggyggagyggtattgaggtttgtagaagtayggtttggttttgttaaatygtattttgttygttttygttagtttagagtttttygggattttggygagggygyggggtaggatttttttygyggtyggtagtgaatgggagygygtgtaggggygttagttttgtttttttttgttgtgagtaggtagyggggttttagtygtygtttttttgaagtttygagaaygaggyga

SEQ ID NO: 7032 - DNA, 1294 bp, synthetic construct; identical to SEQ ID NO: 7022
  misc_feature 1..1294: note = Description of Artificial Sequence: Synthetic polynucleotide
  source 1..1294: mol_type = other DNA

SEQ ID NO: 7033 - DNA, 1373 bp, synthetic construct
  misc_feature 1..1373: note = Description of Artificial Sequence: Synthetic polynucleotide
  source 1..1373: mol_type = other DNA
ygattttygttgagtttayggtttagtttttatatatttatgtygygtttttagtygttgggtgaggagttatttagygtygyggttttttygaggggyggtygggtagygagtagyggtygagyggayggggtgagttaggggygygygyggggygtttagtattgygtyggggaagttygtagttttygtttygaatttgggttygttgaggttgagggaggggaygtaaggggagggaagaagagaagggaggagtgggggttaggggagagggggtggggagggattttggaggtataaagyggaggggaaggggagggaygygygyggtttttattaggaggygagtgggtgtaatyggygttttttagtygygyggggyggyggattyggaggatttagaattyggagygyggyggtygygggygttygggaggaagaggaggagtaygaggygggygggygggtgygtagygygaagaggtagtttyggygttgttyggttyggygttaggtgagtttttgatttaggygtttygygtttttttttygtttttagggtttttygttttygttygagtttttggtgtgygyggaaggttygggttttgttgygygttttaatttggttygggyggttttattttttttttagygggyggttttaggtygggggtttyggttygggggtttaygygtttaggttttaattttgtaagattttagtygttttttagtygygygtttggtttygagttgtgygttggyggtaatggyggagtttttggtatagttygttattttttygygggtagttygggttgggggatgttagtttttggggatygttgtatttgtttaagtttaattttaygtttttttyggtgttygattttgyggtygaatygtaattgygagtygtaggtaatggyggagtttttggtattgttagttgttygyggttgggggttygaggttgggagggtttygttttyggaatatygtttyggtttggtttttaattttgygaggagtttttttgygtttttttttygyggttatggyggggtygttygtattttttatttttttygtttgggygagattggggtgtaagagygtygtttttaaaatttgggaaagttgtgtttttttygtaaaggaggttttagggaggtygaggggygygtttygttayggttyggggttgggtagtggaaggagygttygatgaggttgtttttaggtggttagggttyggagtagggttttygggggatttaatttttagggttatttaggggttttgygttygaggtttyggaaggggttttttygggattgygttttagaggaygttagaygttygt

SEQ ID NO: 7034 - DNA, 1524 bp, synthetic construct
  misc_feature 1..1524: note = Description of Artificial Sequence: Synthetic polynucleotide
  source 1..1524: mol_type = other DNA
yggggaaaggygtggaggggggttgagygggttyggggttygttyggaatttggggggttgaggggtygggygttgggyggtggagggaggaggtagggggatgyggggagtggtgggggagtttttttaggaagtgagtgtgygygygygtttgtggggagatgaggtagttgttggtgygttttggggttttygattygagttttgtggygggtygtttgttttttttttttttaagtttygatttttttttttttattttttttttttgtattggygggygggyggygggggyggttggggttttagtttttttattttagttttttagttttttyggtagttygggggyggttttagttttagaaatgtygtyggttttyggtttyggtttttyggttttgtygtygyggtygttggggttgttgttatygtygagtygggygtygtagyggttttttttggggtttatatttgtttygttagttygtgttyggagtttttttygygggttatataattaggttttyggtygagtgggygaagtttagtatatttygggggyggggggtaggggagggtttttagatgtttttttagtgttttygaagatatyggaggggagtatttygygtagagygtagttggattttyggggtgygggtttttttttttgttttgttttttagtatttttggtaattgygtaaagttgtttgggttgtaatggtggggtgtagggggygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyggttttagtttggaggagaagtttygtagttagttgtattagggggatttygtgtaygttatggagggtaaaggtgaggygtttttatttygggtygttttttgygttgygggtygagygtaygtggggagggagttgtyggtggttgggttygtatttygygttygygttttttattttaggggattyggtgaygaaaygaggtygagtattgggggggtggggtggggtggtgagggaggagggtaggtagtaaggggggtygggtatgggtttaggttyggttygygtttattattagttttagggtgggtagagttagggggtyggyggatagagggatttggagatggataggyggatygagggagggygggagygtygygtttttttttttttygagtyggtygygttttttgygttgtttgaggtgtygtygtttggttggaattgggtttagggygtttttggggtatyggggtaaggttttttaggttygaagtttttttaatttygttttygtttggggtttgttagtgaggaattggtgatgggggygygtygggtgtttgggaygatgtttttttaggtttggggttygtagagtygt

SEQ ID NO: 7035 - DNA, 1009 bp, synthetic construct
  misc_feature 1..1009: note = Description of Artificial Sequence: Synthetic polynucleotide
  source 1..1009: mol_type = other DNA
ygaagtggygggtygtggttattttttttatttgttgtattttttggagtttyggggygtaaatagtygttgtatttttttttattttygaygggatgatattatagttttttttttagatagygygggtttttgtttygtttttttttagygatygtagygaygattttgttttagggygggggagtagttttttaagtygygggygtttattttttygttyggatttygggyggtgttggtyggggygygyggggaggyggggattagggattttttaggaattagtttgggttgttgtatygttgttagggtygttttgygtttagtygagtttagggygtygtyggttggaygttygttaatttttattgygttyggttttygagygygttyggttggattyggygygttttttygttttaggygtygttaagttttagtattatgygtttttttagatgttygaaagygtttttttagggtagtttatgtttttttgtgtttttttygygaygggtygggtttattattttatatttttygggtttttttatgtttattatygtgtgtttttttagtatttttttttttttttaagttttaatatagtatttttttatatatttttygygtygttttagaggtttttttagttattgtttygtttttttatttttttagtttttttagttttatygaggygygtttttttagtaygtttttatttttttatttttttttygygtttttgtatttttttttygtatttttgtatttttatttygagtttttttgtgattaaatatygygtttttttaagygtttttttttygygtygttttaagatttttttttatattttgtatttttttygtatttatttaygtatttttgygygtttttattyggyggtttttttatttttagattygttttygygatttagygygyggggtattgggtagggatatttttygtttttaygygagtttttygttgtagaygt

SEQ ID NO: 7036 - DNA, 961 bp, synthetic construct
  misc_feature 1..961: note = Description of Artificial Sequence: Synthetic polynucleotide
  source 1..961: mol_type = other DNA
ygtygtygttgtgagygygygaggattyggggttttaagtggtgagaattattygagggatttttyggatgtttttttttttttttgtttttgagttttgtagtatagyggtgtyggtygtyggtagggaaggttgtattttttttgygtygttaaatygtgtttattatygyggtgattgtygtttaggtygtatttttgagtygtattygygygtaggggygtaygggtaygygtatagggaggtygtatatatatatatatatttgtatagggaygagtygggggtttttgaygttygtygtttatttygtttyggtttggagttttttggtttygtaggtgtagygaygtttagttttygtgyggttagygygtygygtyggyggattttgtagtttagagagtttagggagtttagggaggggagyggggygygggyggggtagtgtygtataatygtaggygygtttygygtygttttygtttygggtttattttttttygtygygttttttttagtttatttayggaygagyggattttygattttygyggtagggatattttaagagttttgtttaggtttgygtygtttagtatttygttygtgtygggggttyggyggtttygggygagagayggaggttaygygtagggttgggygtaggggtygtygttygaggattatgggtgggttagygtttygtygggttgttagttggyggggatygtyggygtttgtgtygggtygygttygaggttgygtygttygtgtygtagyggttaatgyggtagtattygygaaygttatygyggygggtttygttggttygggttgyggygtgggggygggggatyggttttgagyggagtttygygggaggaggagyggaygggaggttgggagggattygtaatattaygtaggatyggggtttttaggtgtyggggaaggyga

SEQ ID NO: 7037 - DNA, 961 bp, synthetic construct; identical to SEQ ID NO: 7036
  misc_feature 1..961: note = Description of Artificial Sequence: Synthetic polynucleotide
  source 1..961: mol_type = other DNA

SEQ ID NO: 7038 - DNA, 980 bp, synthetic construct
  misc_feature 1..980: note = Description of Artificial Sequence: Synthetic polynucleotide
  source 1..980: mol_type = other DNA
ygtttttttgtttygttyggtgtaagttyggggtygtyggttggggtggggygygtagygyggtaggtaggtagggttattatgtagtttttagttttttggttttttygtttttygtttygygtttttgggtygttttygtttgttygtattttagagtagttttgattygtgggggygygyggtttygyggggattttgygggygggygggyggtygggygygygyggggygggggyggygygygygyggggagygtgtgggtygggygggygyggyggggaaagttgggygygygagtygaggttgttgtttatttgtagtygygtygtttatttgtygyggagtgygygtttygygttttttyggttygtttyggagttyggtygttttttttttgttatagygggtaattgygtygatatgygataygagtagtttaygygtttyggaagtatyggaggagttttttyggtttgggygagttaaggtgattttttygatgattttttygttttygygggtygtttgttttygtattttgtttgtttttttygygttygattttygttttygtygttagggaatyggtagtagtgtatgggtatttgtttgtttgtttgtttyggtatttttattgtatatatttttttttygtggttttttygattgtttygtgygtayggggggagtttggagtttttttttgtttyggtygggggtgygtttgaggatgtgtaygygygygggggatgygtttggagggtgggagttygatggaaataggygatttaaatattttatygaggatggyggtttttggttygagatttgtygttgtygygtggttttttyggtagtagtttagatgttaaatagttgttygtttttagtatgtaagatgtgattttttaatgtgtatttttagygttgttgtaaatagatygtygygagttygtgtgtgtttgtttygtttaygt

SEQ ID NO: 7039 - DNA, 408 bp, synthetic construct
  misc_feature 1..408: note = Description of Artificial Sequence: Synthetic polynucleotide
  source 1..408: mol_type = other DNA
ygyggygtttttttygaaatatttgagtataagtagtygtaagggygagygtaggaygyggggygtggaygtygggttgggaagagtttygattaaattygygggtggttttgattttttttttygggaggagttttgygtagaggtygtggttygygygggtaagttatttgtggtagtttggtagggtagtttttttyggtaaatagygatatgttttyggtttttgtyggttttggtttggtagagtygtttttygttttttggtttttggtgygttygaggygggagaggagtttyggtygygtggattttagtttgygyggtaattatygygttttgattttaggttyggttgtttagggaaggatagtttagggygygtttagygagttttagggggtaygg

SEQ ID NO: 7040 - DNA, 2190 bp, synthetic construct
  misc_feature 1..2190: note = Description of Artificial Sequence: Synthetic polynucleotide
  source 1..2190: mol_type = other DNA
ygggtgtattaatgyggtygaaaaagatayggataygtttttttgggatttgagttggttygtagtttttttaaaggtgttaagtaagygttagttttttttaggygttttaggtttagtgttttgtgtygagggttttyggtgtttttttagatttttygggatagtttgaaggggttaggagyggygggatagygygggaagagtaggtaaggggagatagtyggattgygttttagtttttygtgttaagaatatygtygyggaggygyggttagttttttttggatyggatttttygtttttagggttaggyggyggagttttagttttgttttttttttagtttygggyggtttttagagttgagtaagtygggtggagggagtttgtaaggattttttgagygygatgggtaggaggaggggtaagggtaagagggygyggagtaaagattttgaatttgtyggggtygygttttygggttygygtygttagtatttttttaygygygttyggtttygggttattygttttygtyggttttygttttttttygtagtygtagggaagygagtttgggaggaagaagagggtaggtggggaggyggatgaggggtgggggattttttgaygttattagaaggaggtgtyggggtaggaagtgggttggggaaaggttataaatygttttygttttyggttgttttttatygaggttygygggaggttyggagygygttaggyggatatttttttyggttttttttyggtagyggyggyggttyggagygggtttyggggttygggtgtagyggttagygggygtttggyggygaggattattyggggaagtggttgttttttggttggagtygygagaygggygtttagggygyggggtyggyggyggygaaygagaggayggattttggyggtygggtygttggtygyggggagygygggtatygggygagtaggtygygtygygtttattatggttagttattgggatatyggggttttgttgtgygygttgtttagttgtttgttttttataggtgaggygyggttgggggtyggggtttgaggygggttgygatggggyggtyggagggtagagttttygaggttagggyggggtgtaygyggggagaygaggttgtagttyggagaagttggttayggygagaatttgggatattagttgtagygggtaygtttggggtygttgygtttttttttygagggagygtttygaggagtggttggtttggattygygagtattagygtttagatygggttygygttggggttgttygtttgygataggatygttgattttttatttagttgtygggttggggttttattgtygaggttttgggtattaggagtagtaygtatygggatttgtttggtatttagagtttatttttagaggatttggggtaggtaygtagggtttttyggagtygggagtagaggtttttgaaagtttgttaggttgttyggggttgggttgaggtygggattttggtgatattgggtattggtygygatttygygttaygagagtgtaggaggggagtygatttggaggggattygtgtttgygggggagtaggaggattttaggagagggttagygtyggtattttatgattygtttgagtttttaagtyggattgtttyggggaaygttyggygagygttygttttttttygtygttttyggatygyggggttttagtgygttgygtttagttattygggtggggtttttgtygggagtaggygtggtgygyggtttagttygtgtygyggatattagtgattttgatttataagggtagtttagggtttaaatatygttaatttattgatttataagtttagtttttaaaattygagygaagagagggygggygattttgattaaaygatgtggtttgaggaatygatgaggttygttygttatttaagttagttttygttgggygtttgggagaygggyggtggaatagttaggggtygggggttttattagtagttagatygtygttattgaggggttaaagtttygaggaatttgagggttyggattygtagtttttgtttagtggggttgagtggyggagatttgtgtttygtttttttgggygtagagagttagatttyggagygt

SEQ ID NO: 7041 - DNA, 2190 bp, synthetic construct; identical to SEQ ID NO: 7040
  misc_feature 1..2190: note = Description of Artificial Sequence: Synthetic polynucleotide
  source 1..2190: mol_type = other DNA

SEQ ID NO: 7042 - DNA, 679 bp, synthetic construct
  misc_feature 1..679: note = Description of Artificial Sequence: Synthetic polynucleotide
  source 1..679: mol_type = other DNA
ygtyggtttaggtttygtgyggtaatttttyggttttgttgtttatttygttttatygttttttattttttagtttttgtttagttyggggaagtygygtygtagygttttagatgttatttatttttttttgygaggggtttgtgatagtttagggtgttgtgtattttgtgygattgtttatygttyggtttatgyggtggtttgagtagtttygygtyggtattttaygtatygaatttygggattaygtgagtyggyggagggyggggaggtggygttygggygtyggygtgaattygygtttttyggagtttagygtygtgtttttaggtttyggttttgattttagggygtttaggtggaatggtttygtagttgygygttgttttygygttttygttttgtttygyggaaatygttttygatagttaattygatygggygygyggygttttyggtyggttttygttygatttygygtagggtatagatyggggygtaygygttattygtattyggttattygygggttaggtyggtygagyggttgggtttagggggtatttttaygtgygtagtygttattyggtttggtygtttagaygttttygggggttygygtyggttagtttagttygagtttggygtygygttgyggtygttgttttttattygg

SEQ ID NO: 7043 - DNA, 2013 bp, synthetic construct
  misc_feature 1..2013: note = Description of Artificial Sequence: Synthetic polynucleotide
  source 1..2013: mol_type = other DNA
ygttaygtagtttagggygtttagtttatatygtygtatatttattgtyggtttagaggtttggtygttgagygttttttggatggygtggtttgatygtttttttttttgatttatttttagtttygagggtygggttttayggyggyggagagggygtygttygtayggtttyggttgtgttatygtttyggattgttttygygtagygaggtttttttttyggggttttygggtggggtyggtygagtygggtgygttatttttttaagttygggygagatgagagttgttagyggtagtygaggttagygygggaygtygttattttagygttaggtyggagttagtagtygyggagtygyggagagyggagggggyggyggggtygggygtggygggttttttygtygtttattgygygttygaattttgggtttygygagyggygggyggtattygttgtaatgyggagaatgtgagaggtagygtagggyggtggggaggaaggggygygggagagggyggyggygagatagayggagagtagyggggagaaygaggatygggttgggtaggtgggataaggtagggaggygtyggagaggtyggattggaagggggggagaagggyggyggygtygyggagggggtyggygtttttygygggagtgygagaagttygagtyggtatttgggtttaggttygggttgggagygyggtygyggttyggttaggtagggtgygggagtygggtygttygyggggtttttayggggagtagyggggtatttaaggtyggygggtttyggaggggtttagggtygygtttygtaggtttyggtygtttyggtagggggtttttgtgagygttttaggagggygagtygggagtgyggagtygggtgtgygygtttgggtgtgygygtgtgtgygygagtgtgggygtygggtagtgggggygygyggtagagattttgtyggtatygtatygtggygagtaggaggtaggagygggaygygtaggggagtygggattttttygygtataygtatatgtataygttgygygtttttaygygtatatataygttttttttgtygygttygtygtygyggttattatygyggagtygagttttgyggagygggaatygaggtyggagyggggatyggaggtagtygagtygggggatgtyggttyggagyggagtygygygyggayggygygttygggayggtgagtgtggtygggtygggaygttgtagyggggttagggtygtaggggygtaggtyggggagtyggtgtgtttgttygtyggyggygyggygygygyggtttttgattgggygggagtttygggggtagyggygggggtggggtgttgggtgygygttygtggggggygtgtaygtttggggttgggagggggygtgttyggtagtttaggtygyggtttygttttatttttatttgtagttgtagtttygaygatttgtagtaagtttgtggagtttttggggygyggygggtygggaggggtggggayggaggygttttgagggtgtaatttyggtttttttttttagagaagagaaygygaggggagtggggygggggygygggtygggtygtttggygggyggaggggtgygtttttagttttttagtygygtagtygttygttttttgggatatttatttaggttygyggygtygygttggagtygtttygggygttagattattatgatttygttagggttaggtaggatygygyggggatagtttttaggtttagggtttgggatgtttttgtaggtaggaggaagatattaaggtttagttgggggagtgyggygaygtgttygggygtgtatgtgtgtgttttygygttttttgttttttaggayggtggttggaagaagggaatttgtygtaaggygygttttattygatttggatttttaggagtttttaagaggtygggggygtttttaggtttgtygg

SEQ ID NO: 7044 - DNA, 1501 bp, synthetic construct
  misc_feature 1..1501: note = Description of Artificial Sequence: Synthetic polynucleotide
  source 1..1501: mol_type = other DNA
ygtggtttttygtttggtttttygtatttattaggaggaggttgtgygttattaggtattygagtygygggttgtttyggatgtygggggttaggygttyggtggygtagtygtgttaggttattaygtaggggttgtygatggtgatttagtatttgatttgatygtygaagtggyggaagtagagtttygygtaatttttgaagtggtyggttagggygyggttggtttagtygtygtaggygttttgtaggygttggggtaggttttagtggtatagggtgattaygggttgtaygtttagttttygtagtygttttagtaggygtyggtagtagygtagtttttygyggttggggaygttygygttgttattggggagtattygygtttaygagatggagaagyggtagtgagtgatttygagttygygtagygttttygtgtygyggaagaygttgttgtagttgtygttggttaygttttyggtggygggttgtagyggygayggggygtttaayggtagattggygtttygggagtttttygggggtgttagggggtggtgggtgaaygtattttagatggaygtatttttgtygtgttgttgttagtygttttyggtttggtaggyggygttgtttayggtttagaggaagtygtyggggaaggtgttttggaagaggttygyggtttygggggtaggaggtygygagaaaygggtttaggtttgygygtygtygttyggtttygtaygtaggyggyggtygtttaggtttagtagtattagtagtagygatagygayggyggyggyggtygygggyggygyggyggggygttggygggtatgttgygygggagttaggtttyggggtttygygtygygtttttttatgttygygtttygtygygttygttygtttatygtyggygygtttattttygtttttyggygggtttygttggtaataattatttgygagtygggattgttttygttttggtattgggggygggggtaggggygtygagggygaggggtgttygggaggggygyggtagygggtaaggtgyggtaggygtygttygyggaygtyggagaaaggtatttgttttttttagttttygggagtygtgtaggaygtttygtggaygtttaggtttattttttttgtttgtygygygttttttgagagtagttttggagyggtttygtyggggagaaaaggygtygattaatttttttygatttgggggygggattttgtygggttttagyggagygygtygttggggaagtatttgtttttattttttttttattyggaggtttaaagaagtttyggttggatattgttggagttaattagggattggtygaaattttagagggattgttaggtgggatagtygagggggaatttygtygtgygttgaaagggatttttttttaggtgagatgttygyggggagaygygtttattygygtttttttttyga

SEQ ID NO: 7045 - DNA, 668 bp, synthetic construct
  misc_feature 1..668: note = Description of Artificial Sequence: Synthetic polynucleotide
  source 1..668: mol_type = other DNA
ygaggttgttgyggtgggaagagggygttgggagggaggaggatttggggygtagtygtggtgggtgygttttgttaagaagggygggggygayggggygygtaygtggaggaggaggaggaggagggagaygggagggygtgtgagygagtgagataagaaaagggagygygttygtygtygtygtygtygtygtttttttttggagagagaggttggagtgaggttgtgygaagygtygtattttaatgaggaygggtygaggtatatttttgtattagtggtygtaatygaggygtygygttttagtagttgttgtygtttagttyggtttygtygtygttttttagttttgtagtttygtagtttyggtygygtttagttyggygaggatagtattaggaggyggtttttagygyggttataaagattttyggyggygttttttygyggatyggtgygtggtttgttttttttggggaygggagttgyggggagggyggtygggggatttygtagagttygtttygttygtagtygyggggygtygagggtagggygggygtttagtttggtttygtygtttygttygtagtttttygaaaggyggtygttttgttttggttagtttggttygattygggggygttgygtgygggyggtttygg

SEQ ID NO: 7046 - DNA, 1006 bp, synthetic construct
  misc_feature 1..1006: note = Description of Artificial Sequence: Synthetic polynucleotide
  source 1..1006: mol_type = other DNA
ygttatagtygtagagtttttatttygagttygygtttttttggtygygtygtgttattttgtttatttattgggygatttgggtaygagtatygygatttttygtttygygtagttttttagtatygtggttttagtatatttgtagagtagttaggygtaggaatygaaattygtygggtggtgggygggaagggaaaggtagatgtttaagtgaaggygtttatttttttttttaygtgaatagaagttgatttttaattttaagtgagaaatgatagggagaaaaagtatgtaattattattagaaaaggtgagaggttagtgttgttttttagygaagggayggggtgagatttaaatttatygttyggttaggggagttygtttttagagtatygagaagttggggtgygtgggyggagagagagtagggtgygttygatagttttgygttaggttgtttttaaatttaatatttttttttttttttttggagttattttttttttyggaatatgtaagttttgggtggtttagttttgtygttagatttagtttttaagtgygggggaaggagatgggygtttttagtygygattttttgggaaggtggttatttatttgygttttgaaatagaagaatagggygaygttgtagataatttggtttagttttagttttaggagggttaygaatatggagygggaggyggtagggggttggtgyggygtaggyggyggyggggygtgtagggggttttygtgyggggtttyggggtygtygtttatttttttygagttaygtaggtatttggtgtagtttttgttggygyggygtatggygttyggttttttygtttyggagtttttttttttttttygtttttttttttttttgtttgyggttaatttyggaggttgyggyggagtttygaygtggggygtygatttggagttyggttttgggttttggggygygygggygagygggtagggygttygg

SEQ ID NO: 7047 - DNA, 867 bp, synthetic construct
  misc_feature 1..867: note = Description of Artificial Sequence: Synthetic polynucleotide
  source 1..867: mol_type = other DNA
yggaagtaaagttygtagtgaggtgggttggaagygggttttgtagtagtygygagttygggtttaggtttttaggygyggttggagtagaagtgtagggatygttaygatttatygtygyggtyggtttygtttygttagaggagatttygtaygygtagtygattggttygggttgatygaggggatttagaygttgttattttttttttttaaggtagttttygtggttttgtatgtaggaagtgtttygattaatttttttttyggttttygtagagattttaaattttgyggtttttatttttygttgtatttttttttygtttttttttttaatgtttttgttagtaaaagtttttatttgtagtatygggtatgttgttygtttaaygygtttyggggatttgttggttygtgtttttaatttaggggtggttataygtttygygtttttgtttttgggtagatttttttatttgtgtattttggtttttttatttagtaaagagatgtgygaagtgtgygtttggagaygagtygtttyggtgatttttattygttygtagyggtggttttggtttttyggattygygttygygttttgygggtttttygygtygtttttgttygtyggattattygggtttagagggtygttygtttttagygtttgygagygtygttttygttygggtttggggagygttagygygttttttttaygtyggattttgtagagtatgtttagtgtattttatggaattyggtttttttggggttaggattagattttygggttttygttgttgtygagggggygyggaggaggggaggttgggagatagttagygttttgtttygygt

SEQ ID NO: 7048 - DNA, 1072 bp, synthetic construct
  misc_feature 1..1072: note = Description of Artificial Sequence: Synthetic polynucleotide
  source 1..1072: mol_type = other DNA
ygyggagaagattgtttggtttygtyggtttygttaaygtgayggttagtttygtygagygttygtattygtttatatttatgattattygtatattygttttaataygtgttaaggygygatygyggggtttttggtagttttygttgtatttttttttttataggggtatttatagttgttatttgtatagggggtaatttttttygatttagttgtggtygtygttttttttagttttttttggtttttygtatttttyggtttgggttygygtyggtyggttttttttttttttttyggttttttttttygtygtttttattatatttttttttggttagtggygtaygtygggggaygagttagagggagygggtygygggggtgtgtatgtatttttygttttttttttgtagygtatattgtatatggtagtgagggggygagtaaaggtggtatyggtttttyggttgttttagygaaggyggyggttgtagtttttgygttgtttttygttttttagygtagyggygattatygygttgggatttygtygaygttgttttygygtygagttygtygtygtygyggtttttaattagtatttgagaggtttttgtatttttttggtagttttatttttayggtgtttgtagggtttttttttgtattttttttttagatgyggygtataatygttattagttggaattttttattatygatattttttggggtttttgggggaaggggggggygggtagtaatygygtygttttatgtttgtggtttgttttggtagttyggtggttttaaaaaaaatttygagaaagttgygtttttttttygggygtygaggaggtggtaaygyggtaagtaatatygggtttttgagatagttgtttyggagygggtgtagggtttagtttagtgtatttgtttattgtygygtttttggtgygagttaagttgtagtagatatgatgggttyggggygaagygggygttyggtggtygatagatggtagtygagggygaaggygtttttgggttagggyggygtaatygg

SEQ ID NO: 7049 - DNA, 1633 bp, synthetic construct
  misc_feature 1..1633: note = Description of Artificial Sequence: Synthetic polynucleotide
  source 1..1633: mol_type = other DNA
ygataygttttatttatagagttttagagaagttyggattyggttggagttaagagtyggaaaataagtatttagattgtygygtaagttgtyggagattaagtgttatatatattggygtygagagaaagggtgggygtttttaagtttttggtggagtaatgttagtggtygggtatgygggggatayggggttttygaattyggattygaatttttagttgagttattygttaaagttggttgttygttggtagaygaggtyggttttagatygggtggtagggtgttttygggttttgagtggttaatagtaattggggaagtattgaggaattttaaygggaaagttygttttatatttgaaataggtagttygtgaagtttttaaattagttttgaaaygtyggygtttagaggttaggttttyggygagggttttttttagttttgttygttttyggttygagygtygggygttttgtygttygaaggayggataggggagagaggggttgggggagtttttygygtttttttatygtttttgtyggygtaagggygggagtggagaaggygttatttagattgtggygttgggtaaattgyggtygtagtttttttaagtttgttygaattagaaygyggagtgagygttyggttyggtttttygtttgygttttgtagtygtttyggagtgattygggttttttggttagtygggtttgagttattaattaaggggtagaagggygygagagtagygggaggygggagttagggtgttttygygtgtgtatataatgaggyggyggagaygtatattttttttygtygaagaagtygtaggagtattygtygtttaatayggagaygyggagttttatagyggtggtagaaagtgagtattaatttagtaatagggggaaggaaggggaygtygggyggttagtgggaygtgyggtagtygagggttgtagtttgtttttgtagygygttygygtttatttgygattttttggtaggggatgttygttaggttgaattttttggtatygtaygtttggyggattttttygtagtttygagtttttatattygtttyggyggggagggagagtagtagttttaagaggggaagaattatagtttygatttaagaaggtatggtgtaatatataaatttagttyggtaaattttayggtyggtgygttttttattttgttttttaagtygaaagttygttagaggtagyggygygtttttygtygttgtttagygttatttttttttgttagtygaggggaygagtagygtagttttttggattgygtttagtaaatttttataagttagatggaygatggtaagttaataagggttggttgggaaggttgttgttttgtttttttagtttttagatggaaayggtgtaattaaaaygaggaagagaaggaaaagaagtgtttaaaaaattattatgggggtttagagttgtaattygagtttygagtygtagaattttggagygttgygggttyggttygtyggagtgtgyggtaaaggtgggagygygygtyggttttttygggagggagatggataagygagagygagtgtgtatgygygygt

SEQ ID NO: 7050 - DNA, 1143 bp, synthetic construct
  misc_feature 1..1143: note = Description of Artificial Sequence: Synthetic polynucleotide
  source 1..1143: mol_type = other DNA
yggtatygtgtatagtttgattttaygttygtaygttgggttttyggttttttggtagtgtatttaagtgtatttygygtgtgttyggyggattttygtgtatatygtygtygtgttgttgagtaygaaagattttygagaggagttygtagatgagagtttagttgttgttgtgagattgattgygggtggtagtyggtaagaaggaattgttagtatygattttggygttttttattaattgyggygtagttttttttgyggtgttygtttttyggtattattgtagtttttgtagtaaagttaattttaaaaatttaaataaaataataattttttaaaggttygaaaatttyggtttttattttttttttagtttgttyggyggyggyggygtttagtgagtgatayggygagygtgagtygyggttttagtygggtygagygygttgtttgagttgagtygtygtaggtgaggggttygygttttygttygttttgggygtygygtttggtattgattttgtyggtygtttattgtygtygtygtygtygttygygggtattatgatagttttgagygttggggttataggttggttatygtygtyggtgttygggaggttgyggygyggtyggtttygtgttttgygttygaggttygygatgygygttygttagttttttggtyggttygggttaggayggtttaggggygttggggttgygagaggggttgttagaggggttgygggygggggtttygygygggggaggggtggggaggggygtttttattygagagyggggyggtggggtttttgtyggtttggtyggggygygggagtygygatgygttttttttatttttgygygtgggtgtygggggygtttgtygygggatgtttttgggttggtttgggaagtttagggtyggygatatttygggtttgtttygtttgggtatttagtaggtgttggggggtaggtggttgaggaygaggttattgggtattattatagygttgtatttgttttttyggtattagggtygttgtttgggtaaatttttgggttaaygygygggtggggaggtgggggtgggtagtttggttttagtaggttttygygggggtttygygg

SEQ ID NO: 7051 - DNA, 1143 bp, synthetic construct; identical to SEQ ID NO: 7050
  misc_feature 1..1143: note = Description of Artificial Sequence: Synthetic polynucleotide
  source 1..1143: mol_type = other DNA

SEQ ID NO: 7052 - DNA, 1371 bp, synthetic construct
  misc_feature 1..1371: note = Description of Artificial Sequence: Synthetic polynucleotide
  source 1..1371: mol_type = other DNA
ygttttttttayggygttygtttagttyggtggttttaattttttgygggagttgtataygtttyggaaatttgggatagaaattgagttttttttttttttggtggtggtgatagtatttgtttagatttggtyggaygtygtyggtyggagtatttagttyggyggagaaggagttygttyggygttggggattgggatttggagtttttttttttatygtaygtaygtttygtttygygtaygttygttygttygttygtgtttggygtagttttatttyggatggtttttgttttttygygggttygagggygttggaaatttagyggyggygaagyggagaggagtttygygygttttygttygtayggttttaggtttggggtttgygttggagtygygyggggagaggtygtttttgygatygtygygttygttttygatygttygggttygyggttagttyggttattagttatgggttttggttygttttygttgtttttggtgttgtygtygtygyggttgttgttgttgttgttgttgtttttgttgttaggtaygygtataggygttagggtttyggagggaygggygttygagaaggggygyggggttyggaggggttgtyggygagaatatygygygggygagyggagagggttggygtygtygtyggggattyggaattygygtagattggttttagttyggyggygatttgggtggggtggttttttttttttyggtttattttttatttttagttattattaaatttgggagttattgagygggygttggtaygygtygggtgatggggaggtygagatygggtttttygttttgggygtaggagttggggattygygttttygygttgttygtygttttgtttygygtattggtttttaaattggygygtttaagtttttygttttatygtttgtatttygtttatttttttatttgayggagatggttgaagatttggttaaggttatttygggaagaggggagtygtttygggattggggttggagttggagygttagtttttttttyggttgtagttttttagygtttttggttgygtygttgagggattttttatygggagagygttttttgtttttttttygttttttagaggagtttgttgggggaagtyggttttggttygtygttgggaggtttttgggtgtttgggagggttggtgggtagygagagtyggggatygggtaaggttgtagggaatttttggagggtttaggtyggyggtttgtygtgyggttgtgagtttagagygtttttygttttyggtgtygaggtttgtattatttagaaygttataygtttttaatyga

SEQ ID NO: 7053 - DNA, 1545 bp, synthetic construct
  misc_feature 1..1545: note = Description of Artificial Sequence: Synthetic polynucleotide
  source 1..1545: mol_type = other DNA
ygygttgtgagagttaggttatttaaatgttaygtttttygtatygtyggygaggggataaatgattattttgatggattyggtagtttaaggaaattatygttttyggagggatggyggtagagtaggtygggtatgttgtatttgtttgagttggatygygtgtgagygagtttaygtttttygygggttaggtttagttttygtgttttttgataggtgaagttgagtatttttattaaattttygggaagaataaygattttattttatattaaygtgattggaaattttaatttaagaattggatgtatyggtyggtttatttggggtttgtttagttttttattttatttygygtttttgatgtgttaggttttttgtatagatagtttatatatttaatttttaaaatatygttttttgaagygatgtttaattaggaaaatttgttttaaattgtatgattatttttygtggttttttttttygaatttttgttttgtttattaggtgyggtttygtttygtattygtatatatttttttygtygttgttttgagygtagygataagggtttttatattttygyggttygtaatgtttyggggttaagtygaggtagggaggygttttygtagtttttgattttataattygygygygtgtgtatygagtygygggtatatygygaatatatatatatatatatatattygtgygttttygtttttygttyggttygggtttttygaatttattttygaggygtttygggygtagggttygtttttttttgygggtttttagyggttgttyggtagtggttygtayggttttygatgtygygttttyggtaggttttagagttagttggttattgttattyggtagttyggatttygygtttagggttgtatttygyggatggagygattttygttttygtygttygagtttaggtttgygtttataygygyggygtttataygygyggygtttatttggttgtagtttyggttagggttagygygtygyggttgaagggggygttyggatttttttggggyggygygtagtygggatagtttygtatgaygttygygttttagyggtttygggaygyggttttatttttaatttttggyggttttagtttyggtttttgtgtttyggtyggygtygttaygttatgggtttgtaggttgggagtagygygggtygggaaygyggttggggagagttgggttgggtttttttatygtygttygttyggggygtttaagttggyggggygtaygggtagtaattgagygtattttgggggatygagggggyggtttyggggaggggygyggygtygygttaagggggtgttttgttagaggttgyggyggaggaaagtgggagttagagygtygtyggagtttygggaaggyggtgttygttyggttttaggtygyggttgtagygtygaggggaaagygagyggaagttgygygttggagggagtttattattyggagttattygyggggttygygt

SEQ ID NO: 7054 - DNA, 1545 bp, synthetic construct; identical to SEQ ID NO: 7053
  misc_feature 1..1545: note = Description of Artificial Sequence: Synthetic polynucleotide
  source 1..1545: mol_type = other DNA

SEQ ID NO: 7055 - DNA, 1027 bp, synthetic construct
  misc_feature 1..1027: note = Description of Artificial Sequence: Synthetic polynucleotide
  source 1..1027: mol_type = other DNA
yggtgygtgtataggggygtttygggaggggtggtgatyggtagtyggttttttatttttygygtttattttttygtttttgttttttttttagttggtggygggtagtgtggtgatggtttttgaggaggtttgttyggagygtatygatttgatttataaaaattatyggaaattttgtaatttgttgatygaygtggaggagtggggttaggtggttattattagtatgtttattygttaygttygtaygtagtttttgagttttatttagaaygtaagtgggtttagtttaggtagagygggtygaagtgtgtttyggggaggygtttatagattygtyggttttttygtttaggaatttttattagaggagaaygyggaaaaagttttttayggtttagaggaggaygaggttaagggygyggggtttgaggagayggtygtygyggtygttttttttygaaagttttatgttatggatttygattatyggttgttgttgygtaatattaaatttttgttgtagagtygtagygtygyggtggtgatggyggtggygtagttttatttttatttggygtttaaggyggaagtgggygttatygttaaggygttggtgygtttgttgygtagttataggtgygtttygtttttagtttygttttttttttygttttttgtttygttttaygggttgttyggtttygtttttttaygtttattagtygtttttatttttgtttattygttttatattgatygtagttttgtttttygtattggtttttttttygtaaygatttgttttattttttttttttattygttgatttttgttttaatygaggggttyggggtgttttgattygtttttttygtagtgaggtgtagtaygttgtgttttagaaygtggttattatgtttattaagygtygggtgagtttgygayggygggttgttttygttgttygagggtygtttttgygggtattggaggygttgtyggggttgggatyggggtygg

SEQ ID NO: 7056 - DNA, 693 bp, synthetic construct
  misc_feature 1..693: note = Description of Artificial Sequence: Synthetic polynucleotide
  source 1..693: mol_type = other DNA
yggattygttttatttgaggatttygggtttatataggygatygtttyggttttagattggaagygatattttagggattaaagtttttagttygygttyggttttagtttttgttttygttttagagtygtagygagtagggttttgyggtatygtttagagattggtttaggaggttttagtttttagygttagtatatatttatyggttgtagtagttttattagttttgttttttttttygggtttyggttatattaagagtttyggaaaygtygagaattttgygggtttagaaygttygygyggaygttttttttayggygtyggaagtyggygtygagtttgttatygggtatttttttgttgttttgaygayggygggygttgtaagagtggagaagttgtaggtgttgaggygyggtgaaagaaattttgggagttaagagtaygaggagttggtgtttgtgttatatttgtatttgygggtaagaaatygttggtgtagyggygggttagggtttgggagtygatttagggtttaggtgtayggagygggtttttygggaattttgagagtggtygtttttyggagatgaagggaygagggygtagygattttygtatttatttygttttaygaatattygtttygtattygtyggttattyggggataaaaygtttgttygt

SEQ ID NO: 7057 - DNA, 1496 bp, synthetic construct
  misc_feature 1..1496: note = Description of Artificial Sequence: Synthetic polynucleotide
  source 1..1496: mol_type = other DNA
ygttttygaattyggagaaagtagttygttygtttttttattyggtagttagtttagtttattygagagttgagttygagaagtyggtttttgayggtgttggygtggygtttgttaaaatatgttttttgtattttaatttttttyggttattttttttgtaygtatagttygttyggggttatttyggttttttagygtagttttttygatttttgtttttttttttttygatttatgtttgtttaaggtygaatgtaaaatttatttttaagaaagygtagygggtayggggggtatttagygtgttatgtttygtagtttttttttagttaagattagagttttagattttagattayggaaatgagtgttatttagattaaggattgygygtttgyggtttyggttttyggttttgggtgtttttttggggtgtttgtgygtttyggtatttttygtygtygttygtgagtttgygttttttatttatttaggtttgggagygttttttatttaaggtttgggagtattttttaattattttygttaygtttattttattttttatygyggttyggattgtagtaaaatygggtagygygagggttaaaaagtggaaaggagagygttttttygtgtygtgtagttagttygttaattttttttttttagtttygattttygtaattttaaatgtaatttttttttttyggtttyggtttttttygggttgyggttagygggygtygygttgygaggygtggagygggygggttgtygygaggttgygggtggyggtgtyggttatagtygygagttggygagtgggtgggtgggtgggtggggaggagggagaggataggyggggagagagaygggtgtggggaggggagggagggggagatttygtttttttgtygtttttagttygggyggggggyggggggaggaggtygygatgagggaggggaggagggagggaggaagggagggagggagtygaggaagaygtttygataattygtgygtttygtaaggttyggagtatttgtatatttttgtagtygygyggygagttattygyggyggttgttgtagtttttattgtatttttttttttttttttttttygggtttygggtgtgtgtatgtgtgagagtgagtgtgtgtgttttgtaggtgygtggtgtgttygttttaattttgtttagtaggtgggatttggtgattttagtattattttttttttttttttttttttttttgtttttttatygtttgttgtaattttgtaaagtttyggagtyggagagygygtttygtttttagagttttyggattyggygagttagygatygtygagtyggttattatgttyggtagatygygttattaggygtttttygyggtttttattyggyggyggyggyggyggyggyggygttygygatggttttagaygttgaaggattttgtatttgatygttyggygt

SEQ ID NO: 7058 - DNA, 5820 bp, synthetic construct; identical to SEQ ID NO: 6811
  misc_feature 1..5820: note = Description of Artificial Sequence: Synthetic polynucleotide
  source 1..5820: mol_type = other DNA

SEQ ID NO: 7059 - DNA, 699 bp, synthetic construct
  misc_feature 1..699: note = Description of Artificial Sequence: Synthetic polynucleotide
  source 1..699: mol_type = other DNA
ygtygyggtttttaaaggtygttgttgtgggtgygtatattygggttggagaaatttyggyggttttgtatygygyggtttygtttgggttttggagggygtattygtttygtttgggttgtttygyggtttatggttaagygttttttgtttagttyggaatygggygttygagttagygaataggtyggttygttttagttggtygagttygattygtygygygttygggttaggygagygyggygyggyggattagttttgagttygtagtttygagggygyggggygggygygtttggggtatgagggyggggygggyggyggtygygtttttaatttyggygttgygtgtgggagyggtyggattagggaattagygttgtaatttyggattagtaaygttygttaaatgagtgtttaatttygattttttatgttttttagygtygyggttgagttttaggaggttttttggttaggtttttttygygttttggttttatttttygggaggttyggtygyggtyggtagagaatttttyggtttgtggagattyggttttaggtygygtygtagttttttttyggtagygtattttattggttygggtagaggtttatgtagttttatagygttyggagttgggagttygtggattagagaaaaggaagtttyggatgtttygtttattaygg

SEQ ID NO: 7060 - DNA, 1845 bp, synthetic construct
  misc_feature 1..1845: note = Description of Artificial Sequence: Synthetic polynucleotide
  source 1..1845: mol_type = other DNA
ygtaygyggygygggattygagaagagygtttggtagagtataaattttatagaagaagagattttttgttttttttgagattttattttttttttgtttagggttaggaagtttttttygggtttttttagaatttyggttgtttttttatttgtygtttatygttttttggaggtttyggagaggggttyggttyggygagtygaaggttgyggggyggggygygagttttagtttttgggatatatagtyggtgygtttygygttttaagtgygtattttaggaagttyggagtygggaggattygggttygyggttttattttatttttggygaggtygggagaaaaaaagygttagatygttygtttgagggtttagaagtttatygggyggyggtatagattttttygaaatgttttygttttygygttgygagygtataggaatttagggtygtyggggttgtygtggtttggttgaaygtttaaagttaggygagggyggggggttttagtttagttatgygagtttttttttagtggtgttagtttttaygtygggttttygggtyggygggaggygygtgtgtttgtttgtgtgtgtaggggatatttygttttttagtagtttatgtagaatttygtttttygtttyggttttaggaattttttttttagtttagagatttttgygygttttttgtttattttgttaaggygagaaagyggtygtgttggagataaagaaatttttgtttttttttattttyggttttttygttygttygagatatttttyggygttttttttygatttyggygatattgygtttggataygttaggtaggggggtagggtgggygagttygtttttygaygygggttagttgggggtttttygtgaatttygttyggggatattttatagtagtygygtttttatttttttttttttaaatygtttygggtttttgtygtygttattttttgttaaatygtttttatttttttagyggagttatagyggggygyggygtatataaagggggtyggagggtggagagtatagaaggagggagagatttygttagggttygtggtaygggtttgggagtagttatttattygatttttttttygatttttgagatgtttgygaagatgaggaagattaygagtagygtgagygyggttagtatttagtttyggaattgtagttgtatggtgggttygygttygtygggatttaygygggtyggygygaggagtaggggtyggagggygtagyggyggaygtyggagttttygygygtygygygtagttgggtagatattttgygtttyggaygagttygggtyggyggyggtagyggtagyggtagyggtagygataggtaggggttgtttaggygyggygagttygttygttttttttyggttttygtttgtttttttttttttttttttttttttttygttttgygttyggtttygygygtagtttgatagttttgtttygygtttttgttygtttttttttattaattttagygtttaggygttagtttttgtttttttygtttggttttatttagttttygagggygyggggatgtagtyggaygttatttttggtttagagagattgggttttggttatygygagygatygggtayggagttgagtttagggaagtgygygtatygttyggygtattttttaggttggtaaaygttttttttygttygttttttgtttagttttttygttttttygtaaagttttttygatataaagattaatatttggggatagtttttagygygyggygagaaggygg

SEQ ID NO: 7061 - DNA, 1844 bp, synthetic construct
  misc_feature 1..1844: note = Description of Artificial Sequence: Synthetic polynucleotide
  source 1..1844: mol_type = other DNA
ygattagagattyggygtayggagyggagtttttggtttttatttgtattaatttagttygyggtygtagtttttgttaaagaagtggggtttygtgtttaaggttygtaygttygggtgtattyggataaattttagtayggttygggtgttttttttttttaygtttataatgagggtttggggtaatygtttggtatttagtttgggtgagtyggagtggttggaatyggagaggygaggggygggtayggyggyggygggygygttgggagygttgggttygttgggygtyggttyggagggattataggggygggatttttggagaagtttttggtygttygygttggggtygyggaggtagygaggygygtygaggaggyggtttygatttaggtygtygtagtagtataggaagttgtaatataggtaagtgtaggagagygagagygtgaaggygaagagtagtttgygygtttttygyggttgaggtggtttygygyggtttaggattttataggttatggttttatgggttygygtygggggttatggttttygagggggtatyggyggttgagttgttgtggttttgyggtygtttagagggttygygtggygttgttayggttaygygggtygggygttgggggygtygtttttttygggggttgttgattagggtgygtatagtgttagggggtttygggggtagyggtttttyggggaataggyggttgtatttttagtatttttyggttttaggygatggggtttygggtagtygggyggttygggygtttttaggtttttaygtgygtygggttyggagygygtttagygttygaagttttatttttgattttyggagygtygtttaygaaaygttyggyggyggygyggttgtgygggttggygggtggatyggayggtggygttggygtyggtygygatttggtttttygggaaatgtygagyggagygygttgtyggttttatttaaggagtggtttgaygttagtygygygggtttttygagttygygtygygtttagggatttggttygttttttgygtttttatttttttattttttttagaaatatagtaygygggttttttttatgtaggttattttttayggagttttaggttagttttggggyggtgaaaygaaggtgttaaggtatagtattttttygggaggttggatatttttattaygttggtttttygatatttagggataygaatttaggtygagatygygtygatatgtagattagatagatttagaygtagaygtaggtattttgttttgatgygyggttttattattttgattygtataygtaygtataggtatagaagtataygygttttagttyggatatatttttatatttaygygggggtggggaggagaagttttttaatttgggtttagatatatygataaggatatttttttygttttygatatttygttaaatggatatatatagttyggaatyggatatygagygtaygtaygttttggattgggataygygttgtagaygggatgggtggaggagtygagygtgagtgagatttygtgattatttatttagttttttagtttttagygygttgatttatatttyggyggttygttttgtttygtatttatgaggtaygygygtattttaatttattgttattttattttttttygggtttgtyggagagygagtttyggagyggtagatttygygttaggagggttttttttttagtagtygtygtttagyggtagattgtttttyggggagttgtttagggtattagagggtygtyga

SEQ ID NO: 7062 - DNA, 1480 bp, synthetic construct
  misc_feature 1..1480: note = Description of Artificial Sequence: Synthetic polynucleotide
  source 1..1480: mol_type = other DNA
ygttttyggygggttttgttgttttaygttygtygtggggatttttttttaggagygttttgtttgggattttttttgygttttagatttttattttggttyggatttttttygggggygtttttttatttttaggttttygttygygttyggygtggyggtttttttttttygtgygggygggtttyggaatagtgtygtyggtygtttgtaggtgtttttttayggaggggygygygtttttgygtygtggtygttgttaggygttagyggtttttagtygaggtgtattygygtttygggtttygggygygtygtagtygtttttttatygtygttygtttygttagttygtttygtaygtttttygygtygygtttttatttyggggttggggggggtatgggttygygtygygttygtygtygtygattttaggtattygagtttyggggygyggygggtagyggtygttgaygyggggygttagttgttaatttygygygyggagtttttyggyggtgtagtttygtttyggyggygygggyggtatgaagattagtygtygyggtygagygtttttggtygtggttttgaatttgttggygttgttgttygttattatygttttttttattaygtattggtgttagggtaygtagygggtttttaagtygggttgyggttagggygggygygttaattgttttaattygggygttaaygttayggttaayggtatygtygttttygtygtygtygtygtygtygttatygtttyggggaayggtttttttggyggygygttttatagttgggagatyggygaygatygttttttttttaggaatttttatatyggtatttggtattygtgygaggaggagtttagygggtttggtgagtgygygygggyggyggttagttyggtttyggttttttyggggyggygyggttatygaggttygagtttyggattygttygtttttttttygtygtttgggtttagtttttagygtttygtttggttaggggygaygtttyggggtagggggygygygtygtttyggggtyggggattagtatggggggaygtgygggaygtttygtygtggagaggtgtaaggtagagtttttattygttgyggaygtttygyggttttggggaygttttygygtttygggaaggygtttattttygttgtyggtyggaggggygygygttgtttttygtttttgaatttatttttaygttygttttttttttttttttttttygyggggtattagatgtttttatttatttyggaaygtttttgggggtgggggtgatgtagggatttttgttattagtygttttttttgtygtagatttatagattygggagttttttatttttatygttaatttaygtygaattttttagaygggagtggggagtgggggagtttygygggttttyggaaagtygtattygt

SEQ ID NO: 7063 - DNA, 5065 bp, synthetic construct
  misc_feature 1..5065: note = Description of Artificial Sequence: Synthetic polynucleotide
  source 1..5065: mol_type = other DNA
ygttaagygtttttttygggtgyggttttttttygttagtgaggtygygatttyggygtagttgtygttttatttygggttatttttattygttattgyggattagtttttaagtattaggttttttggyggaatttgtaagtttaaatttygttattyggattttttagtagttttttttttattttatttttatttagagttaggagggtgttatygtaygtagagygygtaggtttttggggtgagtagggygygtggagggattttaggagtggtattttattttygttygtygtttattttygattygtataaaaataaagaataatttttattttgtttttgtttttattgatgtatttttttgtatygyggtaygyggagtttygttagygttttgatattgtagygttygtattagygaattayggaatttgggatygagataatggttygtaattgatgtattgttattaataataaagattaattttttttttttygttatttygattatttttttttttttattttttttttttttattttttattttttttttyggggttatygagggaaagaaaataaataagaaattagygggggaygttaagygtagatygaaaygttygtttttaygtygtygaggaygtaaaaaaaygaaaaaagttattaaagtttggattttttaatttattygtttttgttygtttatttttaattaagtatygygtagttgtttttygtatgtttatttygtttggttgtttgttgtggtgtttttttggggggggggaattttttttttttttatatttaattttaaattataygtagattaagtaataaataygtgtgaagttattttygggagttttttgttgygtaygyggygygtattaggagaaaagttttgygggatygttagtttygttaggtttttggttgtatgyggtgttygggaggttyggatttttaagaagttaagattgttagagaaggatgygggyggttttaaataygggtatatttygggaaaggagtgtgtaagtgtatataaaygygttygtgtatttgggatagtgtggattggtgggtgtgygaggatttttgtttgtgagatggaggygggtgygggatttataygtgttttygtataygtttttyggggtttgggagatgygagtygtttatattttaggagtgygtagatttatttttgtygagggatttttttaaatatttagtgagaaataatggtatttgaagtattatttatggaaatattattatttttattttttaatattagttttattgatagtttygtttgtttttttattaaaatttattgtatttattaggatttggygagaaygggagagygaggyggagagggtgtgaatgtgtgtgttagggagtgagygagggtagaagataagtaagagaaaaggtggaaaayggaygagtagggagagagaagggagaagttatattaataaaaaaaaataaagttagtagatgaaaaatagaaatatttatyggtatatatatatatttatattttaaaagaaaagatttaagaagttaagagaaagggaagggttttttatyggagygtagtataggttyggagtataygaagtyggttygggagatyggtgtttatttygygygaatygatygtggtatyggttagatttaagggygttygygaattggggygtttttatgagttttttttttttttgatygtgagatagggtagggattgtgtatttgtatttttttttttttttattatttagtygaagtttagtttagtttagtttttygggygtaagatttygagaattttggagygaggagatttygaggygygaggggaaagagttaggttgagtygygtatygagttttaggttygygggygtttgagttyggtagagggatygggtttttggttttgggttttggggygagggtagggaggttgtattttagtttgagggagatggtgatagagygaaaagttygggygtygygttyggtaagtgtttaaaaagtggaggygagtttyggygtygttaggtagtttyggatagaatatttttttatygttttttttttatttygtttttyggttttgygtygttatttygtttyggaaggttggggygyggttttttttttagggyggggtgtttaggggttttagggattggtttagtttagtgtygggttygttygggttgtgtttttttaggtyggtgttygttgttgygtttagtgtgagtygtagtttttttttttttttyggtyggagttgaattyggagtttaggtyggttttygtttttygttygttyggggttttgyggygttatygttgtygtygttttttygyggagtgaygygttttgtagttaatyggggtagtygggggggaggttygggaggggttttgggyggagtygggtygtttttttattttaygggttyggggttgtttttttygaaaattttagttttaattgttttgggaatgttygaggtagagaaagggagygagggagtaagtaagaagttggaggattagtgtttttggyggggaggggatggggtggygggagaattgtttttttttttagttataaatttattaggtttttaaattttttttggattttttttttygygttttygygagttygggatttaggggatggagaattyggggyggaggagygtygagttaggygggagggaggtygagtygtgggygggaggyggatyggygtggggttggtttttttttattygtttatttttttttttaatgggggtgggggtgggttgttttttggtagtttttaaagaaaygaagaaatatttaygaaaygggaygtttttttttttgatttygtygygggatttttttttttygygggtyggygygtttygttttygagttgggaagttygtagygygtyggtagttygggtttttagttttygtygttyggttttattttttattyggggyggtttaatttyggggagggtatgttaatttgggtyggtttagttygggattgtgggggggggygaaggagggagggaagagggaggggagagggagagagyggggggygtttgtyggggygtygggttygtagtggagaggaggtyggttttyggyggtygggtygyggagtttygggyggtygtaaagagggttaatttagtgtygggyggygyggygygtagagttagtttygyggtyggtttattgggttagygygyggagagataggggtttgtagtaaattaygaattaattgattaaggygagygggtttgaatagygttggttyggtgttaatygttttttaaagagtttttttatgattaatygtaatgtattattgataattataattatagtaggatatatgygygttgygttyggggtyggggagtyggggagggggygggygggtyggygggyggggggagtygtygtygtygtygtygttygattttygtaattttgagaagatttttttttagtaattttttattttgttttagttgatgtttgagttagtatgtygyggaggaagtaagygaagttttaatatttttaattygatttygaagtggtttygttttttyggygagatggtgagtgtttyggttygygtygtggatatatatataygtatttatatttaygtatattyggatttatttataygyggttggttttygygttttttattttatygtygtygyggtttygattgttttttttattyggygtaattttttttttttttttaatttttaatgtgtttttgttgggttttttttygttgtttyggggaaagygagtatatttttyggtaggattttttyggagttgttgggttttttygggggaaggagggygggtatgtyggtttggttttttygtttttgttttttyggggattttagtygyggttaagattygggagttttatgaggygtgggtgygggtggaggtygtttyggtttgatygtayggggtttttagygttttyggygtyggttttagggtattyggttyggttttygtygttyggttttgttgttagyggtaaggaagtttatttygggygttgggttgaatttygagygtgggggagttygttgygtttttttgtttttaygtatattttttttyggtttgygaggtagaatygggtgtttttggaggtttagagttgtaagaagatggggattggtgtyggggygttagygtttgattygttggggttgyggtyggggtggagagtgttgttggtygttagttgtttyggagayggtgtaaayggayggggaaagtgtyggggtttggttygtaaaatttattttygtatttttttttataatatttgtattttttgttttttaaaatttttttggtyggtatgygttttttgyggatygtggtgttttttatttttaggggggttagggaagaagttatagaatagttttttaggtttgygggtggttagttagagtggaattttttttgaaataggggtatttgtttttttygatggaggygataattgtgggtttygaaggggttgaataagtttagaataaagtttgtgtgtgggggttatggtagagagtggaagagattygggtagggagttggggtataaagggaggatatttggaatttttttttgtttttaaaggtgttttayggtatyggttttaaagtttttaggtttagygttygaggyggtgtagyggygttyggattygggttttygggtygtttyggtaygatgttggtttttyggttgtgggaggaygtataaggagtaatttyggyggggttttagyggtttyggatgttattygggatgtttaygttttaggyggtattttggggtgtgaaggagggagttgggtttygatagagtttygaagygtgattttgatyggtattttagtttattaagttgyggtygttygggtttttaggttttyggttygt

SEQ ID NO: 7064 - DNA, 2372 bp, synthetic construct
  misc_feature 1..2372: note = Description of Artificial Sequence: Synthetic polynucleotide
  source 1..2372: mol_type = other DNA
ygagggaygtaggatgaaagaagttaagagtgtygttagggtttgygttagygtygttagattttygggatgggggagttttagggtayggygttagyggatttayggagaaggagaaaagttttattgtygtgtagaagtttaggttygggtgagaygtttgygaaggttgttagtagyggaagagaaggggygtttttygtgttgygtagtattygttygyggtaggtgggygyggagtttagagttgggagttaaaygtaaaygttggygagaagttttagtttttttyggtagtttattygttgyggggaggggttttttaygtttttagtttttgggagattgtatyggaggtyggaagtaagtygggygaggatgaattatttygtttaatttttttttttyggttttttagttttygtaygtyggttttttttagagattttgtagtygygagygaagattgttttatttttagattttatygaattttttgtggtttgyggagaygaggagayggaygggtttggtggttaatgagagtttygattttttgtttttygtttaatgggtygttgtttatgggtyggggygggattaggagggtaggtaggggyggttygggttggygygyggygyggyggttaygyggttgyggtttatagagttagygtttttttgggtgttygtgttagtgttgygygggaaggtattattattatagtygtygtygttggttagggtgttggataagaygggttygtyggttatttygttagtttaggtattygttgtagtygtygttgtttttttttagatyggtttttatggaggagatggaagaggagttgaaatgtttygtgtgyggttttttttatygggagtttattattttgttttgtttttataatttgtgttaggygtgygttygtaatattttggtgtagattttagagtttgaatttttttagagttatygggtygygggtttyggggttttygattatgattatttggatttggataagatgagtttatatagygaggyggatagyggttatggtttttayggggggttygttagygtttttattatttygtgttagaagttttttaayggygttygygtgtttttttyggttatgtygttatyggttatttatttgttatyggttttggtttyggtgtttygtaatttttgtattatttgtttttagtgttatygtagttttattttggatgatygggggtttygyggtttttttaagaatygygtattggaaggggtaattgatygttattagtagagtaaagtygyggtttttaagtgttagttttgygagaaggygtttaaggaagttatygttatgtgygaatagtgygatgttttttattgygattygtgtygtttgygttgttattygtttygggggtttttagttaagtatygtttggtgttttyggtttagggtygtgtgagtyggaggttgagtttaygtaaggtttttatttgtatagattaygagttggagaattatagtatgtattgygtgtaatgtaagatgttygtgtgttattagtgtttggaggagggtaaatattttagttaygaagttaaggttttgggggttatgtggaaattatataaggtgagttttaagaaaatttatttttaattttttgygttttygattattyggttttgtagtagayggttttygttttttgygtatagygtattttagtgggggygtaatgtaggtgttttygatgtttatttttttggtttggtgtattgtaggaggtatgggggaattttaatyggygtaygggggagttgaatgtttttatagagttgttgyggggatgttttagagygggtttttyggggygygttgtttgygagygggatttagggygtttttttttygyggygggtttgtagttagtggtygyggttagtgtgtgggaaagtattgtatagttgggtagagtygygttagtgtttagggtygttaggtaygttygagggtagggygggttgygaattttyggggagggattgggatgggggyggtggggtygygyggayggygggagtttgtygttgttggataggyggatttggtgaggtayggyggagggtyggggagaygtygtaggyggaatattgatgagttyggttttgggttagatttggttttygagttggagagaaygyggggttttggtgttaygtgtttaaaagatagagyggagagggtagttagyggtygttatggtaaygygaygtgtaggtttgggtttgaattttttyggagttgggatttgagattagagtgttaggatyggagtttgygtagtygygg

SEQ ID NO: 7065 - DNA, 2372 bp, synthetic construct; identical to SEQ ID NO: 7064
  misc_feature 1..2372: note = Description of Artificial Sequence: Synthetic polynucleotide
  source 1..2372: mol_type = other DNA

SEQ ID NO: 7066 - DNA, 2372 bp, synthetic construct; identical to SEQ ID NO: 7064
  misc_feature 1..2372: note = Description of Artificial Sequence: Synthetic polynucleotide
  source 1..2372: mol_type = other DNA

SEQ ID NO: 7067 - DNA, 2142 bp, synthetic construct
  misc_feature 1..2142: note = Description of Artificial Sequence: Synthetic polynucleotide
  source 1..2142: mol_type = other DNA
ygtagttggtttygaggttgtgyggtttttagttttgyggagtagtttaggttatygttttygtggtygygggggagggtattttygayggtygtagtaatgggtaagagattagggtttttttattttygygattygtttttttttgtttggtaattaagygggatgttttattttattttttaaayggagyggattatatatagtagtattttatggttttttttgttgyggttttttygggggaaggtatttttagagggtggttaagttttttttagyggtyggttttygggagggggatagaatttaggagttagttttttgttttygtataaaggttygtttttttttagggygtttttgggtggagygaagyggtygaggggattaygataatgtttttttgtttttyggatygatggttaggtttttagagttaggagygttygggattttagggtagggagtaaagtttatatygtaatttygttattygttygygttttgttagtttgttggggttatagygygtaggttagtagtygtattygtygttgyggggttttttttgygttgagtttattttttgtaaygtygttgttttaaattttgygggttatttggtttygggggtggggttttttgggggtygyggggtagttyggatgagaggatgattygggagttttttgggggyggagtggaaggggtagttttaggtagttttggttaggagtttttatttygttagtttygttgttttagyggtygttgttttagaaaagttaaygagaattagatgtggtggttattgtygaatttttttagagtyggtgattggtttttagtygagggttttagttaattagtttgttgggtgggtttggagtttygtttygtttaggygttygyggagatttaggttygaggttggygyggygyggagagtgggttggaggtyggggygggaygygttgtgtagygggtaagygtayggtygagygagtatggagggggatygggtggtygggyggtyggtgttgtygtygttattagtgttattgttgttgtygttgttaatgttgygggtygyggygttgtatttagaygagttttttttatayggggagtygtggggggattagtttttgtaggaaggygaygaygaaagtttagtygtggtgaagttggygaattttttgtatttttaygaagttygatttagtaatttttaygtaagtttagtttttttttggtatttttttygtagttttttttttggggtyggttttayggaaattttgtttttagaggggaggaaatagattttatttttggagttttttagtatttttgyggtggtattyggttagagagygatgtygttgtttgtttygttgttgtaggggagtaagaatgatttggaggggagagtaagaattgttygtagttaygtaygygttttaggtagaaaaggtggygttgttagggyggttagygggttttgtagttaggatygygagaaggttgtgttygtttgyggagttggggtgttttttttttagatttggaggtttttttttygaggatatggggtttyggggttgtgaggggagtgagaagataggtgaaygagttttagggtttttggatttattgtagygyggagttgggatagtygtaaaagttgygtttgtttttttgaatttagattttttggttagtggggaaggagagagaggttttttgtttaagttagtttttttttttttttgygygaaagggtagygtttttgggtttgagygattgttatttttttgtttttttttttttttaggtgggtattaayggtattatttttatttaggatttttttagggaaaygtagtatgtggattatgatttttttatygatttttyggttatygttttttttttggyggatatygataygagttayggtagaggtygagttttgtatygagaggatatttttttygtagtgttgggtttggtygttygttatgtgygygttggtttttygygttttgygygttttatttttatttaygtttttttggttatttgggagtaggtaggygtttaygaggaggttaagygyggggygttgttttygg

SEQ ID NO: 7068 - DNA, 544 bp, synthetic construct
  misc_feature 1..544: note = Description of Artificial Sequence: Synthetic polynucleotide
  source 1..544: mol_type = other DNA
yggtttttagtyggttttgtgttgttygttgygaatatagttygtgggttatygggtagtygagttatgtaagttattttgatttttaaaaggtagaygtataaattygatttagaattygaggygaattttgaatttatagygttaaaaaygygtagtgttttygtttgttyggttygttgaaggttggttttgggtttgggggtagtgttygygaagggttgygatggtaggtttygttgttatayggtatygagggttttttygtttyggygttaggygtaygtttttttgttatatttttygyggggygygtygttagggttatttgtttttttaagtttygttaggtagttaagggtgaggagyggagagggattyggtygttgttgtygygagttagtataaaggtagygtttgaaatygaattttttattttgggtatygyggtttttttttatttttggttttygyggtyggagygtatttattgttagtygttatggtyggaygagggggttgttygayggtygtttaggttygg

SEQ ID NO: 7069 - DNA, 2002 bp, synthetic construct
  misc_feature 1..2002: note = Description of Artificial Sequence: Synthetic polynucleotide
  source 1..2002: mol_type = other DNA
ygttttygtttygtgttaagygggtttaaggttygaggttttttygtttataatttyggtgttyggaataygttttygaggggtygtgttgtyggggttattattygygattggatttygygtygtgttgtttttttygggtttygagttygtttagyggtttgtayggtttaggtttgagttgygggttttttttgtggggygygttgggagtgagttttatttttaaagtttattttaaygttttaggtatgattaygayggtagaggtyggtygtttattttygttttttttttyggttagagygtttttgtygggagtygaygatygyggtttgatttygggttttatygtttattttyggttttygttttttttttayggttaggggttatatatagyggaygtttygtttttagtygtttttttgatttttgaatttgggagttagygtgttygttggggtatgtattgttaygggtattgggatttttttgttgttgyggggaggagtttygayggtaggtgggaagatttagtttgttygygttttygttttttagtttttgygattygggtygaggtttttagtttttgggttttttygtttygggtttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggggttaggatttyggttggagtttggttttttatggygaggaagtygattgggaagggttttttggygaggtttttttgttgtgttattttttttyggtagygtygggygyggggaaygyggggttgtatyggggygggggagggggttttattyggyggtttygaggattygattttggggtygggttyggygggtaggtttgtttaggagttagttggtaaatgtagyggattgttaygttattttattgttattatttattgtaaattattgttttaagttttygggagaattygtygaatttgagaggggggagggggatgggggtgggygygtaggaagttttataggtattagggattggtgatttaggatattagtttttygagttttttttgggaatttttagtatttagattgtttttgattgtagggattayggtggggygttttttttttaagtttttttygggatatygggygygtttttttygtttttgggttagygtatatttttttaygygatgattagtatagttattgtgaggttyggttttggtygygtttgttttttgygagtgataataataaaaattattggaattgtaaggaagtttttggtttyggttttttagtygttgttgttttgggtgtttyggttgyggaaagatttygtagtygggttygatttaygagtggaatatygggttgyggatttagtygggtttataggattggygyggggtttyggggataggtttygtagggtttttttgygtatygtttgggaygtygattttgttaatttggaggataatttttgtttttattttattagtagatttttaaaaatttagtygtygttgaaaygtgttttttattygttyggtttgtttgtagtttttgaygagtttyggtatagttttygg

SEQ ID NO: 7070 - DNA, 983 bp, synthetic construct
  misc_feature 1..983: note = Description of Artificial Sequence: Synthetic polynucleotide
  source 1..983: mol_type = other DNA
yggtgtygygygttygtttgttgtttggagtttttaattyggyggaatttaggttaggaygygtygtygttttgaygtgttgtyggtygggaggygygggygttaggttttaaygattagggtgggtggtygyggggtaggggttggatttgaattygtttttygggggttttggatgygggatgygggatgygggatgygggttygattttttygttgttggtygaggagygttttgagagtttttttttygygygygaggataaatatgygyggtttgttagttagtgyggygttgttttttagttgatagggtgaygtttygtttggaggtttggagattggttttttgatttggtttttttyggtagtttaatgggtaaagtttttygttygtttagaaattagttttttygygygttttttttgygygyggygaggtygagaygtttttygyggtgatagygtgtaaggyggagattyggygygtttttagtttagggaaagtttaggygaygygatygtaagttygagtttaggtttttyggagtygttagggygygtygggttgtttgtttttttgtttttttttgtaggaatttttygtygttygyggtygggatttygggtttttttygggygtagattttagttatygttttgggtyggggtttttttttttttgaaattygtgyggaaggatttttttyggggtttttygttttggttttagatatttttttttttagatttygygttttagatgygttgtttygtagttttttgatagttgygagtttaygaatttyggygggagggyggyggyggyggattgatatgtttyggaygyggttgyggtyggygggtagttygygggggygatgagtygttgygatyggtgaggygtygggyggygggggtatygygtattttttttattttttttttttgtttatttygttygggaggtygagaggaaaygg

SEQ ID NO: 7071 - DNA, 947 bp, synthetic construct
  misc_feature 1..947: note = Description of Artificial Sequence: Synthetic polynucleotide
  source 1..947: mol_type = other DNA
ygttyggtgtttattttygggattttgaatttygttttttttttattttttgttagattygygagggttaggaagggttttgggaggaagygggagygtagyggyggggtatggaagaagagggttgggggygygygttatttgtaaaggttttygaggtttttttttagttttggtggtaatttygtttagygtygygtttttttttagatttaaatttttgttgggtttttygggtggyggyggyggygayggyggyggttgttggagttaagttttgtygttygtagygtyggggygygggggtgyggaggtyggagttttagagyggygygygttttttygtagygggtyggggtyggggygtttagttygtttygtttgttttygtttaygttttttayggagttgyggtatygttttttttygtttttygttattatygtttttagggttygggtatgttatttttttttggtttyggtygtygygattttygtttttttttttttttygttttttttttttygtttygttaagttaaygaattttaaaagaagtatagygagyggggaaggyggtagaaagttgtttygyggygtyggagtttttyggatttggaggatttygggattyggygggagagttaggygggttttttttygaygygtgtgtgyggatagttyggagtygggygtgyggygttgygygggggygggygtagggttygttttaagtgttgygttygttyggygtgggtttggaggttgtttagattatattattgttttaattygaygyggtygggttaatgtaggygtygyggtttttatttttattttttttgatattttyggatatgtttatagtaatgaattygygggatygttttygtagttttygygtttttttttttttttygtttttygygttttggygygtttygt

SEQ ID NO: 7072 - DNA, 1362 bp, synthetic construct
  misc_feature 1..1362: note = Description of Artificial Sequence: Synthetic polynucleotide
  source 1..1362: mol_type = other DNA
yggttttygggttttgygaagggagttttgttygygaggyggagggtttggtttatygagaagygtattyggaggyggttgaggggygygyggggtaygtagtagagtygtagttyggttyggattyggagygtyggagtygtaggaaggygaggagaaggaaaaaaaggaggttgtygtyggtttttgttttattttttygggtagygttgattygttggtygtygtyggatagggttggtygtygggygygggatttygtgygygttgtttatgttttygtttgtygttggttaggtgtgygygtagtttgttggtttttgggyggtattygggggttttttatgtttygygtyggggttyggygggaggatttyggagaggtagygyggagggaaagagagagagatagtatgagaaygygtagagttgtatttygygggggtygggygttagtagtatygygttgttttatttayggygygtttgtttttygygttgygygtttagyggggygtygagttttagaaattttagtatatggtyggttyggyggttayggtggtygtagttgttttgtttttygagygttttttattgttttttgttttaagttttagagygtagtttattagyggygatygygatygtagyggyggggygtttattyggtygtaagtatagtagtgygtatttgygggaaaggaggaaggggttggyggygtyggggtttttataggggaggggtatttyggyggtagtaatyggygtaggttaaggtattttgggtyggggttgygygygagttaggtggtggtaggtygggattggggagggtttttgygtttttygtttygyggygtygttgttgatgaygygygygggttttttyggtttygygtttgyggagttagtttygttatttagygattygtttyggggagttttygttgaygygygttgygagtygggttgyggtagtygaggggyggggagggaggggagggggagttttagtgyggggagggtyggyggttgygggttaagttttttttttygttttttttttygygttggggagggggttygggaaagaygtggttttygtttggttttggaggatgggaggttttygyggggygggggggayggagggaggtattgagtgtttttgttttygtagtggggatgtagtagtaggtggyggttatgtggtttgtggaggttyggtatttagaggygygyggtgagttygtttyggygggagygtggygaatgtggttttgggygygygggtgtgtgggataygtttttatttaygtggygtatatggggatttggggaygygggtgaaagaggygt

SEQ ID NO: 7073 - DNA, 1092 bp, synthetic construct
  misc_feature 1..1092: note = Description of Artificial Sequence: Synthetic polynucleotide
  source 1..1092: mol_type = other DNA
ygatygyggygygtygaygtttggygggttayggttataaagygggttttagagttttttttaggyggyggtaaagggggygttygaggttatyggtaagagatagattattggygtttygggaaaatagagtggggaagggygagattgtgtgtttatttaygttygygygggtttgagttggttyggttttggagggtttygggattttagaagggggatagtagtgggggatgggtagaagggggygattygggttgtttaggtttttygtagtttttttgttaaygagaggggttygggygggaatagttygagtygygggggtgyggggygygtagttygttttatttygggagagtygygatygtygttttygaygygtgtattaagtgggggtgttyggttygggataaaggatygggaygyggatygygggygggygttattgtttagttttagygtggagggygagatygtggtttygaatttttttaaatttggyggttyggggygygtgggggggaygtttygttatttgygyggttataaaggagagatttatggtgtygttgtagttagygttygagttttygttgttgtygttgtygttgygggttagtygtttgtatagttggyggggatygggttgagtagygagygttyggagatygtayggygtattyggttgtttttgggtttttggttttagatttttattaggyggagggtttygagtgygggggygggyggggyggggtggggyggggttyggyggayggggygtttttttaygtgattatttttygttttattttyggggyggggttygttagaaattttaagygttygtaatygttttttttygtgggygggatggggaaattgaggttygaggtygtttygttggttggtgtaagaattagtttgtaatttaagttttgagttgttggygtttygtttygtgtagttgaatttaatttattyggggttgtgggtagygtttttttggggttgataygttatttygagtttgaggattaagatyggagtgatttggttttttaygttaaygttttttttagagttygg

SEQ ID NO: 7074 - DNA, 1092 bp, synthetic construct; identical to SEQ ID NO: 7073
  misc_feature 1..1092: note = Description of Artificial Sequence: Synthetic polynucleotide
  source 1..1092: mol_type = other DNA

SEQ ID NO: 7075 - DNA, 1092 bp, synthetic construct; identical to SEQ ID NO: 7073
  misc_feature 1..1092: note = Description of Artificial Sequence: Synthetic polynucleotide
  source 1..1092: mol_type = other DNA

SEQ ID NO: 7076 - DNA, 580 bp, synthetic construct
  misc_feature 1..580: note = Description of Artificial Sequence: Synthetic polynucleotide
  source 1..580: mol_type = other DNA
ygtgtttaggggagttygatagagtaygygggaaaagtygggtgtttaygttttygygatttaggttgtagagataagagaaggttaggttttgggaggaygygaggtygtttaggaatggtagggaggttygttggggtttgattttggttttaatggattaaagtttygayggagtaaggtygggtgttygtggtggtattttttattagtggaygttggygaatgattatggaaataatatttaatagtagtgttttttatgttaggtatataatygttttggygtgggttgataattatgtttattttatygygtggtattgagtygatygtatatttagggtttyggtttttagggttygtttattygtttattgygtgaagtatttattttygtaggagtyggagtaggaatagggttgggttttggggygygygtatgygtaggtygtgttttaggaagggyggggtattgagtygagggtyggygyggggyggagggtagggggtggtygtattttttagggtatttgtgyggtgattgagaatygattyggtaattygygggttygggygg

SEQ ID NO: 7077 - DNA, 888 bp, synthetic construct
  misc_feature 1..888: note = Description of Artificial Sequence: Synthetic polynucleotide
  source 1..888: mol_type = other DNA
ygattygttttttggtygtttttttygyggttaggygtattttgtagygtttagatygtygygtttttattygygtttttaatygygagygttygtttgggtygggtygggygttygagattygggagagattaggggttygtaaagtagaagagtagatttagaaagaaaaaaaaaaaagygagaagtgygagaaaaatatattgaatttagttaaatatayggtagatgaaaaaaatattttgtttagaagttaaaaaygagttttygagtygtgagatattgttgygttttygttaggygtgtaggtyggatgttaggggggtaatttygaggttygatggtggtttygattttagggyggatttgygtttatttttagtttttgtaattgygggttaggagaaagggatttgttatggygaagaaaatygaattttttttaattaggtttttttttaaagagagaaaaagtaggtagttgggtaatttaatttaatttgggattygggaygtgtgtttgggygtttttygggtagttggtyggagygtgtgggttyggagtttttagygttggtttygygttgtttttygatgttattagtaaattygtagggygttttggygtaggttygygtttgtagagtyggtttgggaagyggaatttttttyggtttygatgattaggtttttttagggttttggtttaggttgtttttgtgggatagagttttatgaagggatatagaaatagagatagtttttgggyggygttttygggatgtggygtttttgtgtttyggggagggggtattatttttgtttatgyggagygattyggaygttgtaggggtgaygtygggtagygttygttttgattttttaygg

SEQ ID NO: 7078 - DNA, 1483 bp, synthetic construct
  misc_feature 1..1483: note = Description of Artificial Sequence: Synthetic polynucleotide
  source 1..1483: mol_type = other DNA
ygyggttttgggygttggtagggggaggtttyggtaaygtttgggggttttaggttagtttttttygggttggaaggtatygtataggggttttygttaatttyggttttygygyggtygggatayggttatatttgttygygggggtttgttttttaggtygtygtaggtttttyggagtttaagaggattttataagtagttaaagttagygtygtttgttttttgtagaatattgttttttataagttttgtagattttttyggttttttagaygtttttayggttttygygaagttattttygygttttgaatgttttygaatttttgtagagttttygyggttttttggaagttttygygttygtggagtttttttttygttttygggggtatygygggtttttagtttagttttttygaygttggtygttgttattttttaygaggygtyggtttygatttattttattgtygttgtyggggaygggygygtygggttaggggygattyggyggyggyggyggyggyggyggggygygggaygygggygttagygggggagtyggtttygggygyggyggtttygygtttgattgggttgyggggggtagygggggtttatttttttygggtgggygtyggggtygttagttgyggggaagggtygyggyggyggygattgatagttgggtttyggtttttgttattttggygggygygtgttygggtyggygtgtgygygggygygtgtttgggggtygtygtygggggatgggggggyggggggygagtyggttggggttygggyggygggaaygygtgygygttygtttgagattyggggyggyggtttttggygagtgygygggyggtttygagttttygagggagaggygygygggygygygggttagttttagtatagtagttaagagttagggtaygygygttgttgttygttttatygtttttygaggggattgygygygygtgygttttttygttygyggtygttgaggtgaatgagygygygyggyggttaaagttygatataaaaggygyggggttttatygttygygttttygggagygttgagtttgaggttgygaggggyggggyggaygagagtggyggggttgaggggyggggttttgagggaagygygaggggygtggtyggggtgggggyggggygtygggygggtaygtggygyggtgygttttttttyggygyggaygtttttttagttttygtttgattttagagtttatagaggttatygggggagttagggttygtgttygatggttttatgatttttattatttggttttgttgagtattttgttygttyggattyggggtatttttgattygagggtygtygaggttatyggygattgattttttttttttgtatataaggagtygtggyggggtyggagagttgtagttttggggygatattagtattyga

SEQ ID NO: 7079 - DNA, 3714 bp, synthetic construct
  misc_feature 1..3714: note = Description of Artificial Sequence: Synthetic polynucleotide
  source 1..3714: mol_type = other DNA
yggygtggttttgttyggaggggtyggtttaaggaagtgttatttattyggagggtggtttygggttygttgattagtttttaygtttgtygtttgagttttattagtttygtgtggtagtggyggtattagtygttttygtyggtygagtggttttgttttgggtyggtttyggygttttygggagtagggyggttgtygtatgggttttggtygggttyggygggtagtttttttyggggggatatttttagtagyggyggyggttygygggtygggtygttttyggttatttgtagggtgtgggggyggaagyggatagtgagtttgggaygttygtyggatttagatttttgygygttttgttttagygtgaygtttttgttaaagttaggagttttgggtaygattttggygtttatttattttttttattttyggaggtttygtttgygggttygttatttttagtaggaggttyggtttttagggatttagygtatatygygagtattttygtygtttygggttttygtygttygtttttttttttaggtygggtygygygtatygygggttgygtagygtatagagggaygtygyggtygattatggtyggggygygggaagagttyggtaggygttttyggttaygttggtttttygggggygtygyggttaygtgattyggtttygaggygtttttatggttyggtttagtygttyggaagttygtagagtttgygagtgtygygaggagygyggtggtttyggtgggygygttygggaggygagggyggggtyggggaagggyggggttygggttttyggggygggyggygaggggygggagtttagagagtgtttygtttttgtttagtgttgggyggygygtggggggggtagggttttygtttttttaygyggtttygygtattttaaggattttaatttgttaggtgagtttttgtttyggggaggggygttgggggyggyggygaggatttagttgygygygygtatgygtttttygtttttttttygggatattagggttgygygttttttaggaggygtygaygtttttttttttataggygggaaaattgaggttgyggaggggaygtttttgtttaaggtttayggygaggtgggtygaggaaggggygggatttyggtttygagatttttaggygtttttttagtaagtttagygtattttgtgtgtygygggttattttaggtttaattgtygygygtgggttagtgtygtygyggtgtgygtttygagtygggtagygatygygtyggygtatttgtgtttyggygygtttgygaayggtaygtgtttttatagtygygygtgtgttygtaagtgggtgtgygygtygtgtygttygggaagygggaggttttgygggygtgygtyggatttgttgttagtaggtttggtagatgggaatttagtttyggaattaattgtttgtttgttttyggttgggaggtygttttttygtttttttttggygattagttgttttgtgtttagtygggttttaaatgtygtyggtattygyggtygtaggtagtttygggttaggtttygggttagttttaaagttygggttaagttaggygggygyggygggygggtttttygtgaygygagtgttttttgtyggtygttgygtatayggtttygagattggggagatagygtygygygttttaggtttgaggygtattyggaaatttygaaggtygtgattyggyggagattaggataygyggttgtyggtatatayggtgaggttttygtagagatttagtaygttaaagtgatttttttygttttgtttatttttttttatttggataagttttttygtttaygtaygtattttttagaaagtggggtgggtgattttttttyggtttttygggtygttgatgattttaggggttygaaaaygtaagggggtatggaataaagtggtaggggttttttattttttttgagattygtaagtttgtagtygttttttatttagtttggggggtyggaagygttttttttattygttttttygtagtttggagaatgaaaaygggygttagtttatatttggatttgggtattgaggataatatttaaattttatttygtattgtyggtagatagtatygtttttygtygttttattgtttygggatatatattttttatatttygtttttttatttatataygtaatatagaagtaygtagyggtygggagtatyggttttgygtttttggttagttatattygtaattttagygtttttatygtygyggygtttygggaagtataagtttatattttatattygtagaatayggggtgtataaggttggagttatttygggggtttaygattagttaggggtttygattttttatttygtttattttagtaaggygtaaggtgagttygagaatttttgygttgygtttttygttttagttatagttttygggtgggttyggttgggatatagttttgaaggtagagggagatttggataaygttaatgggggaaagtgyggtagygagttttagttygggttgygggaygyggtttyggatttgtygtttttttttyggygtagtattttyggtygygygagtygygyggtaaagtaaygggayggygtttaygtygttygtttttttttygatagtttttattttgtttygtygtygtaggaggtggttggtgaagtttaggatgattttygagtttaggtagagygtttttatttttagtaggttgggagttttgyggggygygtygyggggyggttygggyggttggggtagygttatggaagagggaagygyggggagyggtttttagtgtttttygttatygtygtttygttygygygtttattggtygygygttygtygtygtygygtttygtatygygtagggtygttygttaagttttyggtttttygygtttygygttttygagttttgygttygtttygygtygygygttttygygtttyggtttygtttgtttgygtygatagygtttttttygtttyggyggygagttagatattagttaygyggattggaggtgtggggygayggtttygygygttattgggyggaggttggaagttagaatygggtygyggttygygtttatttgtttygttagtttttagaygtyggtgtttattgtygggtattyggtagggagagggtagygyggttgttgtaaaattttttygattggggtataatygtagttttttttttttttaatttgttttgaggatayggygygttggggttttggtttatggaaaygtttagagtttagtgatttgtgtattttatttygtttaygttttagagttttygtttaattttggtttatggatttttaaggtttattttaatyggattayggagygtgygtagygggattygtagtttgygtttttattttaggatttygattgtgtygttattygtggttttttttgtttygatttygattttttgagggttggaagattygggttggttgtygggtaygaygattttatttttagggttygaagttaggggygggggtgggygttttgtttgggtgtaaatttaagttygggtttygygttttttttgtgggttgttttagtttygygygt

SEQ ID NO: 7080 - DNA, 1266 bp, synthetic construct
  misc_feature 1..1266: note = Description of Artificial Sequence: Synthetic polynucleotide
  source 1..1266: mol_type = other DNA
yggttygggygttaggtagaattttagttygatgttgtygtygtygggggagagggaattygttgggagggatagtygggggttggggaaggaagagygggtgttgggagggtttaatattggyggagttttaggtggygaygygggyggygagagttgtttygaggygggggtttygggtaggtygttttttaygtagtatayggagtagaagatttgttttttggygagggaygggygtygttgatttagtaygtttaggattagttygtyggyggtttttaygygggttttgggttttagtttttygtyggggggygttttttgttgtttatttttttttttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygttgtttatttagtygtygggatttttattyggygttygygggtagygggggtagtggttyggttygattygyggtttygtttttgttttygggtttttttttttgggttgggaygttttaagtttttttyggggagttygtgtttygaggttgyggygygtggggagtttggttyggttygtygttttttttygtattttggygyggyggggtatygtttygggggygtygagggtygttygttttgggttygggygygttygttttatatgtagttyggggyggygtygtagttttagygagttttaggygggatagaggggtttgggaggagayggtygttagtttygygttattatyggtttyggttgtyggaygygyggttygagggyggtggttaaagggtygaggggtttgtggygtygtygyggygygtattaggaggtgtagtyggagygttggttagtygtagggtttttgggggagaggtyggagygggygattttttttttttygygttttatttatagtttttttygtygt

SEQ ID NO: 7081 - DNA, 1316 bp, synthetic construct; identical to SEQ ID NO: 6958
  misc_feature 1..1316: note = Description of Artificial Sequence: Synthetic polynucleotide
  source 1..1316: mol_type = other DNA

SEQ ID NO: 7082 - DNA, 10783 bp, synthetic construct
  misc_feature 1..10783: note = Description of Artificial Sequence: Synthetic polynucleotide
  source 1..10783: mol_type = other DNA
ygagtygggataaaggtttttaaygggagygggatatttgtttatatttygtttattgttygtagtttagtaatyggtttgtatttgtgtttgttygggttygattatttaggaygygtygaygaggggtttgttttaatttgggttattgttatttaygttatatattgggggygaggtagttagggttgtagaaagtygtygagyggttyggggagaggtgtttttatttagygttggtaattygggggtagttggggygyggyggygttygttgtagttgygygygaggaggattyggtgttygygygtttagtttggttygygyggaggagtttaggttgtgggaagattagatttggatttygtaggggtggttttttgtgttttttttygtttttagataaagtttttttttgatatttttttggggygaaygagtattaggtagttaatttatatttttgtattttttttttaaaaaagttttaattagaagaaggggtggtaaatgyggygtggttttttttaattttagygtygaggaggaagtgtaagtttygggaaagtttagtttttagagtygagagtggttggaaattttatattaatttgatttaatttggaaaygtggagygygtatttygaaygtatttaaggygtttaaaaagagattatattaaagaattygygtgggagaagaaaattggggagaaaaygaggtatygtygggttatttagygatttttttttttygtagttttttgggtttttatttaggttggagatataatttttatttttattttygtaatttygtttygtygttttttygttgttttatttttagttagaggttggagagggagggggtyggagagggagggataatagagggtaggaaagagtagggtygtttgtttttttttttattyggggaaagaggttygtagagtttagaggtagtagggttagggttygattttagaygaagttggagttttttatttttatttygtttttttygggatygttygtaaagtagaaagtgaattgygygttttttttggtygtagagaggtggaggyggggggttgggggtgggaggtggggggaggyggagtgaaggaaataaatgagtttttagtaaataaagggyggttggaagggggygggtygtttggtggtggttttggtyggttyggagyggagtttttttttgggttttgggttttttygyggttaattggaattaattatttgttttgttatttttagtatttatttttaagttttaattaaaatattgatttaggaggtttatagaagttgggtttttgttatttgaatyggattttgtttaggtaattattaaygatggaaaggagagattttygtagttyggttttygtttttttttttttttttaaaggygttataaatygttaatttttyggtttgtygggggtgggygygygggggyggggaggtaggaatyggtgaatgttaaagaggattttttttttttttttggtttttgttttgtttttttttttttttttttttatttttattttttttaagatgtaatttgttaaaayggtttttttaagtgtgtggattygygagygaygyggtggttttttgtatgtaaatattgggtttaaaaaaaaaaaggttygtttygtttttgtaattaattgataygttatattttttattttgttttagagggtygttggttgggagygyggagttttttaaaatttataattttatatttgtaaatattgtttttatttatttgatttttaagattygtttataygtggttaatttttgygtttttaatgtttttttttttttttttttatttttttttygttttttttttygtttttttttttttttttttttttttttttttttttttttttttttttttttttttygtttttttaggttygtgagtggagtttagttttatatggattgatygttygggtaatggtttatttttttttygttattagtygttatygygygtygagyggtygtyggagttygagttgaygtygttttggtattttttttggagttagaaattaaggtyggggttygyggygttyggygygtaggtygttyggttttttgygtttattttygygtgtttttaaagaagatagagagaggtattgggttgggttttattttttttttttttatttttagtttttttttttttttaaaaataataattattttaataattaaagttaatttttttttttttttttttagtttttttttttaatttttttttttttygttygttggggtaggggagygttaygaattgattaagtgaagttataattttgygatataaattttggggtttygaattatgtygttgattaatataaagayggggttttyggttaaggatattttagatttgtyggatattaaygatgaggagggttttgtggtygaaggttyggaggaagagaaygaggggttygagttagttaagagggtygggtygttggggtagggygttttggaygyggtgtagagtttgtttttgaagaattttttttaygatagtagygataattygtataygygttggttggttagtatygagggtttttagtattttygtaagtagtaaaatttggttgtygaggtygtggttttttttatttttgtagtygtagttygggttggaygttgggagtgaaaggggaaggggttatgtaagttyggatttttttattyggattygtagaaagatttttaatatttgtataggatgttttttgtttttttttttaagtttttttagtttygggaaagaatttggtttttaaaattttttttaatgygagaagttaaggagaaagagggagaagggttatattttttaggggttggtatatgatgttaattyggatygatggttttagtygtagttttyggatttyggtygttgggagggattggtttggygttttggaggtagttagygagtttygttygggtaygggtggagggtggggaggtttygggtggttygggtataaatagtttattttgttttttgygygattatagaggaygttttgtgtagtgtagggggtgtttagaaggttygaaagtagaaaygaaagtttttaaaaatttgttttaaatggtygagtygattaatgttgggattgtggggtattttttttaaaaatttgtttaygtttygtyggagaggaaatygtttaagggygtyggagtttttaattygygatgatttttagtgttatttttttttttaaatttttatttatattatgtgagttttttgaaaggygagtttttagtttttatttttayggatttttttttttattttgggaggtttygaygttttygttaggygtagaggaaggtaggggttatggtaaaggtagyggggttgggttgttaggygyggaggtttagggtygtayggaggatttagggtgtttygagtttggtgtaggttgygygyggtttttagaygtttgaygygtttttttttttttttttttttagtgtayggtttggttgtyggggygtttttttaggatttaagttttaagttttyggagttttyggtygaygagttatyggataatgataaggagatttygggyggygggggggaygtyggtaagaagygaaagyggygagtgtttttttttaaggygtagatttaygagttggagyggygttttyggtagtagyggtatttgtyggygttygagygygaatatttggttagttttattygttttaygtttaygtaggttaagatttggttttagaattatygttataagatgaagygygttygggtygagaaaggtatggaggtgaygtttttgttttygtygygtygggtggtygtgttygttttggttagggayggtaaattatgttaygygtttaaagtttaggatttggtagtygttattttttaggygggtatttttttttttgtttatagygygtagtygttgtagtatatgtagtataaygtttagtatagttyggttagtattttttagtattygatagtatattttttggtttaggtttagtagtggatttggtgagygtygttttaaygagattygyggttttaggtttaggttttatttyggyggyggtggyggygaggaggtttyggtttttatggtggttattattattattataattattattatggagtygagttgattttyggttttattagggaggygtygggaggttgtttgygtttttttggagtggtagattttatttatttagttttgtttatgtttttttttttgaattttgggagagggttgaattttaygtygtgtttatagaatgtttgygtagtttygtttttttgttttttttyggggggattaaatygttttagygttaatgtygttatttgaaaaygagaaaaagatygattttttatttttgttttygtgtattttgtaaaatatgtttgtgtgagtagygatattgttagtygttttttaaagtaagtggagaatattttaaaaatatagagaatttttttttttttttaaaaaaaaataagaaaatgttaaatatttatggttatgtaaaygttttgataattggtggtagatttygtttttygttgtaaatatyggtggtgattgttgttaaaatgatttttaggatyggtttgtttttygtttgggtttaatttttttttttgtggtttgtttgggtttgttttttgttttgtttttgtttttgygtttttttttgttttttttttttttttttttattttattgtgtaaatattttttaaatatggaaaagaaaattttgtaggtagggagttttttgttttgtttttygggtttttagtttygaatttggagtttagttattyggygyggttttttaatagygtygggygtagaaagttttygattttttaaataagaattttaataaaaattttgtgtttaaaaaagaaaaaaagaaaaaatttttgttttttygtttgttttattgygtygggtyggaggtttgggtttgggagtygggttyggtygttygyggggtttttataggyggtttttttygggyggggaggtygggggtatyggggttttggggygggyggggttttyggtgtaggttttttygattataggttgtatttygygtttaggattggggyggggaggagaaygttyggttttyggtttgygagyggtyggtyggaagtttagggtygtttattttttttygtattttttttggtttygygygttgtttgaatttygggyggtagygttyggttaygggaggaaaagtgatttygggagtygtaaaggygaggagagtaaatttttttygttggtttaaatttatgagtggtttttttagtttgagaagttgttgaagttattatattygatgatttttattttgttatatttgatttattttaygttaagaaagtgggtgggtgggggtttgaggttaagattggttgttttttttttattttttatttttttttaaaatttgygggttggtgttgatttaggagatygttaaggttgggggtgggaayggttagggygygygaggttttggtttagggggtttgggggaagtaygyggggttttgggttygggggagggaggggatattgtagttttttttaggatttttggttttaggaagttagggagygagaatttttggtaattttagtaaattatgtttttttttttttttaygtttttatttttttygggtttttaggttttttttyggggattggatttygggtttttttttttttagygttyggyggttygaattagggtgtgyggtttttttaggttagtttttgagygtggaattgggtggattgttaggaagtagaggtttgggggtggggtgagtttttyggatgggaagtgggtatatagtttygggtaygttygggaagggygtatttattttttyggyggggaayggatttygttttatttttgttgttggaggaagatttttttggtagatgttggygtatatttggttaygygggggagygttttaggaagtttggttaattggaggatgagttttttttttttatttygygggtttttaaaaatatttgggattttagtttagagtttagygggtgttgtagaygttgagggattgaaygtyggygtatttggaaattgtatttttgtttttttygaagttgtattattaaggttggggggttgggtggtagtgaggaggtygggtaaaaggagyggttttagttgattttttygttttttgtagttgatgattaggtttaatttaatatttaaagtaaatatgattattygtgygattaaatttgtgygtygatagtattttgygtagtagtttagggaygygatgatattttattttygygttttatatygtttttggataattgagggttyggaagtttttttaatattttagtaaaggtttttttttattttygggtttattttyggggaaagggtagtttttttaaatgttaaaaggtttttttttgttttttatattagtttggtaatgtttgggggtttatgttttattgtttttaaaggttaaygaattttttttaaatagtttgttgtgtaataattgaaygtttaatttgttttggtattaattatttaatatttatttgtaattttttttaattttaaaatttttttgggaggaaaggtgagggttttaagttttttggagyggagttgttagaaggtttgaggttattttgatttttttaggttttagggtttttagggtgagaatgattataagagatttttaggtttttagagaggaagggggaagygtggaaggtttttattttggtaggtttttattatttgtttattgaggataaatttggagttgtggttaggatygygggtttgtaatttgggtgtgygtttttgtggtyggtygggagttygggaggtggattyggygttygtttttttttgttttygggtttttatggagttaataaaagygtttgyggagttttgtgtggttttaattttagygttttgggagygtattyggygyggggttygttttagtagtttattttygtttaatttatagygggyggtataaaatygtataatgggaaagttgggagtyggagatgttagaggygtgtatattaaaaagggatagagaaaggatygyggggatagagagaggggaagaaggagaaggggttygttttttatttttygttttatttygtattatttagygygtttatygtyggtagtgaatttyggagttaggtagaagtttttttggggttttgttgggtttgttattgggtttttttgttatttaygggttttatgttggattttatatggttagttgggtygagggagygygaggagggattygtataaaatttaaattgtgttyggtttttaaattttgtattgttgtttgtgaaaggaagaygtattaaaaattygtgttatatttattggggaggaggttggaggaggggagaaaaagttatttttgtttttgatggtttyggagggygtttgtttygtttaggtttygtgatattgaaagttggattttttttattttgttttttttttttaaaatttttttttttttttttttttataatttygtttttataatttttttttttatttttataattttttttttttataattttttttttttttttatttttttttttttttttttttgtttttttgattttaaygttgggatgggagttygygaatttgygtttttagggtttggtttatttgtgygtattttgtttattgttgtgtgtgtattaggaaattaatttttgtttgggagttttgtattatyggatygttttggggtttaggaggtaatttagggtatttagggtttgggtgatgttyggttttttaygggtttagyggtttttgggtagatgaaaatttattttttgatttygtaatygatyggtttygaagygttygygygyggagtygtttttttatttatygygagaaaggttttgagaggttaagggtgtygtttagtttygggtttagttagatttgggttgtagtyggttttaaggygatttgygttyggtyggattatttggttattaatttygaagagttaaagaygygygygtttttttgaattatgygyggggatttattttattggttttttggtgygatgggaaattattttagaaattttttttaatagygtttttttttatgttggaggagggagatattttttttttaatttttaatgttttttgtatygygtgtttataaaatttagtattagggagatatagtagggtttttaaggaatttgtttattttttgttttttttaagyggtttaaattggygygaggtagtyggaaataatttgggttatgtttttttttttgtaattgttaggttaaaatttttataagtagtttttaaataaattatatgtattaaataaaaatagtttatgttgagttttgtggaaataaaaattggaatttagatatgttttttataaagttattyggtttttaatgagtagaattgagttggtggaaatttygattaatgggaaatttggatgygtttttttttttatttagtataayggttatatttagtagaattagataatttggtaagagtggaagtttttttttttaatattttttattttagatggggaaataatttatttttttatttattgattgttgggtttagttgagatttggtgtgtatttttygagtttttttaagagtttggttattgaaaagttaatttaatatttatygagtataaggatagtttttagaygtatttattaaggtttatygttaagtgattatttggattgaagataaaggttaggggagggggygtttaggtatattagattttttttatttgggttttttttatttagaattaggaaatygggagygygtttgtgygttgttgaagtttttttttyggtgttaagtggygggyggattagatattgtgttgggyggtattttaggaaatatgtatttgtggttttttgagaggttaagygtagtgatattttaaatygtgtygatatattattttttatttaggatttgtaaataaatttttgattttttyggygtattatagtygtygttatttygttaaggaagygatttgagttttattgtttttattaaygtttygagatatatatatatatatatatatatatatatatatatatttttttttygtattttgatttttaaaggttttattttttttttttygaggtatygttattaataaagaggygaataggttttagygtygttattygagtaagyggggaaatgtgggttagtagtttaggttygygygyggatttygygtaygttttaygygttttttygggtyggagaatygagygtgtgtygygtgttgtygtygttaggaggygttygagtttagygttttygagygtttttgygygygggttygggtagagttygggagtygtyggaggtagttgygtattagyggattygyggttygggtyggagttyggtgagtggtgttaagaggtggyggygagtyggaattttggggagagtygygagttagayggyggygggtgtttgggaggtgygagtygatttgtgttyggttgtggttttttygttatgtttttttttttttaygtgygtattatygttygttttagtttyggtttttatygtgtttgggtatagattatagtygattggtttaggagygttttggttattgggagggttttattaggygttagggygygttgttttygygattttagggtttttggyggygtyggtygygygggtggaygyggagagggyggtgttgygagggttyggagagtgggtgttygygtggggaggyggttygggagygygggagygatgyggaggagggattyggtttggttgtaggttttyggggygggggtttygggaaggagagattttygtttttygttygttttggattygggtttygtyggattttyggtttttgtygttygtygtttggaagyggggtaggygtatagtttagaygttagggagagaygtttygtygatttagatygtggggttagggttygggaggtaagaaygttttatatatagtagggtattttaggtaatttttatttygtgttgaggtttyggttagggtgtaaaggtgttygggaatggaagggataygagggtgtggaygtttygtattttatttaygtttggtgttttttgagaggttgggygtggggtagagggtaggggataagggggtgatattttttaaggttttttttttaataaaagtagggtttgtagttttagtttgattygttgattgttgggtggaatygttttatattaaaggtatygtggttttaaatattgttttttttatttttttaagttttygttttaaaattagttgtyggtgggtyggtgagggygtttgtagtatttaggtttttygyggggyggygyggttggataagaaaaggtttttyggttggggygygtagygtagtttagatatttgygggattygagatgttttygyga

SEQ ID NO: 7083 - DNA, 810 bp, synthetic construct
  misc_feature 1..810: note = Description of Artificial Sequence: Synthetic polynucleotide
  source 1..810: mol_type = other DNA
ygagtgtygattygtttgggygggattttttgagygtatttttttygagygygttagtgtttttgggagaggtttgtttgggtgagggattggaygtyggttttttygtaagtyggtyggttgagggtgggggtygaggyggggtygggaatagttttyggattagggtttagataatttygttyggygtttgttttttygygygtatttgtygggttygggggttgttagaagaggtygtagttygygtttttygggtttttaygtttygtagyggygttttttttttyggyggtayggattggttgyggygtygttttaagttygtttygygttgtyggyggggggygtygyggattagagygygttgygtygttatygtygtygttatygtygtygtygtygtygtygttagtagtatagygygtttygggtttygygygtygttagtttttggttygttygtyggtttygtygygttygttagtttygtagyggagtttyggttyggtttygggtygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttygttttttagattttyggggtgtttygggatttaggttyggtagtttttttttygattygtgygt

SEQ ID NO: 7084 - DNA, 1142 bp, synthetic construct
  misc_feature 1..1142: note = Description of Artificial Sequence: Synthetic polynucleotide
  source 1..1142: mol_type = other DNA
ygygtggagygyggtttyggggtagyggagagtggggttttaatatttagtatatgtagattttggggyggtgttgttaggggygyggattygggattatyggagtatttgtatygyggggaaagttgatagggygygygattttaggaggttgtygygtygtttggtgygtgaagttttagggtagyggagygyggggattttgaaggttgtygygtgtaggygaaggggtygtagggtggtygtttttgggagagtagayggggaagaaggtaaygggagggagggygtagygygagtagtttyggaygygggtttaggaattggtygygaggagygtaatttagtaggygygttagggttttyggatttaaggtgyggggtttygattgggygtttggaygtttygtgayggtggygtygttgttattgtttygaagygaggygaggttaggygttgygttttyggttgttygtttttttttttygtttygygtttagtttttttttttygtttygttttttgtttygttttttttttyggyggttgttgygtygygttttyggygtattyggagttyggyggggatygggaggtagagayggggyggtygtggtttygagggygggagttgagtygggtttygggatygaagtttggyggyggtttygggaggtagagygggtttttygggygatttttaggtttttttygygttttygtttyggattygtgggtagtyggggggaayggaagtygyggtygggttaatttygaggyggggaygtygygaygggaatttgaggtgggaattttgygygttgtagtttygtygggygttattaaagygygaatyggatttygagtttgtaaattygggttygggggyggttgtaygtggtygtggttttgaattttttgygggggtttygaaattygtttgyggggaggttagggygatagaggattygggagttatygttggtgygtggyggygtggagygygtttgttayggttaaggtgygggttyggtttyggtttattttaaggggttatygggatgygaagttygggaygttygtygtygyggtgatttyggygggggygtatttyggttgtgggtygaggtttttttttyga

SEQ ID NO: 7085 - DNA, 2885 bp, synthetic construct
  misc_feature 1..2885: note = Description of Artificial Sequence: Synthetic polynucleotide
  source 1..2885: mol_type = other DNA
yggaggtttygggaaagtttattaagttttaygygtttygttgatagatgtttaggaagyggttggtagggaagaggyggttttgtagtttatagagttttttttttattttyggggagttttaggtygygttgttttttattttttygtttttttyggtttgtaaygttygtggygttttttaataggttttagaaatttttttttattttgttttttaagtttggttatagggygtttygagtagggagtgtgygggtttygggtataygttgygtygyggttgtattagagygtttaygattttgatttygattygaagyggttttttagygggatagggtgttggygttggygttgttgttattgyggygygttttttygttttggtttttgygtgtygttagggatttttgygttagggttagatttaaagayggatygaggygggtgtttatttgggaygygtgygtttggtggyggaattttyggggyggtyggaggyggyggtyggggagtygagaagtaagtattagygttttaggatygygygygtygtttygygtygtttygygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygygtygyggttgggagggagaggaggtgggagagaaggaagaggyggaggaggtagygggygtygaggttttgggattygtaggtaagttagatygaygygtagagtygggagttttatygtagyggtagyggtagyggygggttygggtyggtttygggggttgtttatttatatgagtattygtttattyggygagttttygagtttaggyggygyggttatggtygagtttaagtygttgtygggggaygygtatttggtattaagttayggttaygyggyggyggttgygggtttygtttayggggyggygygagaattygaagyggttygyggttayggtatttygggttygggyggygattttttygyggygtttgtatttygygttttagtttaggyggyggagagtagyggygaatagagyggggaygaggaygaygttttygagtagyggyggyggyggygygggttagggagygyggyggaygggyggyggyggtygygagagtagyggtttttgyggtttagtattaaygygygygagyggyggygtatgtaygatttaaaygaygygttggaygggttgygagtygttattttttaygygtatagttygtyggtgygtaagttttttaagatygttaygttgttgttygttaagaattatatttttatgtaggygtaggttttggaygagatgyggygtttggtggttttttttaattagggttagggtttggtygygttygtaaaygtygygtttttgaygtttttyggttaggttattgtgtgtttttttttygtaggygtygttttggggttttgttttgataagtgygtygtttttttygggaygtttttygygttttgtaaatattgttaygagaagtygtgatygygygggttttyggttttttygtaygygtttttygatygtttttgtgattgtttttttgttyggataggaaaggtttggagggattttgtagattaggaggagggggttygatttygtttttagtttgtgygyggtggatagtttagygtagygggaagygttaaggtygtyggggygygggattgagttygagagtyggaygttggattttgygttygggaattygyggtatttattgggtattgtygggatttagtaagtttaggaaygggggtgggtagagtatttttygggtattgtygttygtttttaaaagaagattatygyggggttttagggttayggygaggaygggtattggttagatttyggataggyggttttggtttygggygtaygaaaggtggagaygaagaaaagtyggatttattggtttttgatttttttgtagtgggtttygygttttygttttagtyggtttttygtgttaaattgtagggtagtgttttgtttttgaggaygygygtggtyggtattttttatttyggtgatttygagatttygtagttttgyggagagtttaygatggtygtttgtagaggagttggatygygggygtaggaagatttyggggaaggttttttttaagtaggagtttgttttatttatttgggaattggaygtygtygtyggttgtttygaagtttgaggaatttgttttttaaatgttttttggtttttttttttygtygttattygttgtttgggaygttygyggggtggagttggatggagatygttttgygggttttttgtttyggggggttgygtggaggagggtttttatagttygygttttatttaattttgayggttaggggagggtttygtttagttttggtgtttagtaaattttttttttatygattttttttttttttygagggaggaggtygggttaygggtgagtaagttgttgygggtttygtgtttygtygggtgtgaayggagatgygttgygtagtgttygttttgygtagtttttagttttgttattattygggatttagggagtygggtagggtgttttyggggatttatttgttygygtyggtttgygtttygyggtttygtygtagtattyggttttattaatttaattttttyggttgtyggtaatgttaaggggagagggtygtygttttgtaaygygtttgtttatagygt

SEQ ID NO: 7086 - DNA, 1460 bp, synthetic construct
  misc_feature 1..1460: note = Description of Artificial Sequence: Synthetic polynucleotide
  source 1..1460: mol_type = other DNA
ygygtttagttggaatgtagagatygtygttyggttayggygtataggaygattygttygttygtygygattgtgtatgggtttygggatayggggtygtygttgataygygyggtttygtygtyggtttygtygttttygtygygttygtygygttygtttygtygtttagttygtagygtagtttttygygtagtttygagtyggggygttatggttttagttyggtyggtygyggggaaygttaggyggtagaygagtygygtattyggyggtttatgaaygtttttatggtgtgggtaaaggaygagygtaagyggttggtttagtagaattyggatttgtataaygyggtgtttagtaagatgttgggtgagyggygggagggyggtagagaagggggagagggyggggggggttygggtyggggtggggyggggggggtaggggtttygggtygyggggtgygggggttgygttaaattttygyggggygtttygggygtayggagggttyggygtttattygttygayggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttygtagttatygttygagttttttttygyggygtttggttyggttygygtttttygygagttgttttygttgggygtygagttygayggtttggggttgtttaygttygagygttygtttttggayggtttggagttyggygaggttgttttttttttatygttygyggygttygaggattgygygttgyggttttttygygygttttaygygtttatygagttgtygygggatttyggyggttgttayggggtttttttggyggaggygtttaggatygygtttttygyggygtygttygttggtttgtattayggtattttgggtaygttyggttygtatttyggttygttgtygtygtygttygaggtttygtygttggagagygtygagtygttggggttygtygtygatttgtgggtygaygtggattttatygagttygattagtattttaattgtagtyggattyggttygaygttttygggttttygtattaygtggtattggttaaattgggttygygygttatgttttgtttagaggagagtagtttgattttygygttgtyggaygttagtagygyggtttattatagygygtgtattttyggttaggtygtyggygtygttygggtttttgtagygttttttttygtagttttygygatygattygatygygtygttgtygttttgtttttttataygygt

SEQ ID NO: 7087 - DNA, 1560 bp, synthetic construct
  misc_feature 1..1560: note = Description of Artificial Sequence: Synthetic polynucleotide
  source 1..1560: mol_type = other DNA
ygttttttaatygaatttttttttttgggaatygtagtttagygyggtaattgagttatygtaatygggyggtggggaggaagggtggtttaggaaatyggygagggagaaaagyggtggaagggagagttttttttttggagyggttttagtagtataaagtgttggttatagygtttttttygtttttagattgaygagtagtggygtggagttagygyggaggttgttttttttttttttygagttygtagygyggagygyggtttagtattaayggagtygggggyggygtttttgggatggaaaagggttaaaggggaggagtggggtgggggtgggggttttattggtttattataaaaggatygttyggttgttyggtttttgtattygttggaaagyggtttygagttaggggttattgtaaagttagggtgygttatyggayggagaggggagagttttgagtagagtgagtaatatygtagttaaggyggaggtygaagaggggygttaggtattaattttygygttgttttagtttyggaggygttttagagygttttttgttttagtagagttattttgtttgygtttgttttttagtgtttttaattttgygttggaagaaaaatttttygygygtyggtagaattgtagygtttttttttagtgatttygggagtttyggttgtagtyggttttgygygtttttttaaygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattaygygttttygtttgtaygtttttgattagtagttggatttggagttgyggttygatagtagttttttggygttyggttttaygttttagaaygtggggygtaaattygggttygagaygtygttttyggaaatygatttggygtattgtttttatttyggtatygtgaatggygattttagttyggttgtygtttttagtttttgygagggygtgygyggygttttttatttgttgggggaggygtattttatttagtygttgttygtygttagygagygtttygttatygtygttttaggggagaagtygtyggtattattatagttttattttttgyggyggaatyggtagggygaygtyggyggtaygtgyggggtygtggaygaygagtttyggtygattgggaaagyggagatygaagaygaggaygaagggattgagggygaggaygaaggggtttagtggtygtygtaggattyggtattgtaaggygt

SEQ ID NO: 7088 - DNA, 5118 bp, synthetic construct
  misc_feature 1..5118: note = Description of Artificial Sequence: Synthetic polynucleotide
  source 1..5118: mol_type = other DNA
ygttttttttygygatagagttttygagtttagygtaggttagttttygttttttygyggtttttggtttttttgtygttagaaygygtyggygttagtyggtttatttggygtyggaggtgaggygyggtaggttgtyggygtttatagtygataygtggtggtgyggyggyggtatttggtatatgttgtaggggtagggtatgtygttttagtgttggaagttttygttygttttattgtygtygttttygttttttagyggggyggtygyggtagtagayggagatttgagtaggtygtgyggtggayggatggagtygatygayggtagttyggattygggtagagaggygttggatatagtygyggttgtagyggyggtagtagtygttgyggyggygggyggtaggatggggtggtgtatygyggggtgatgtgyggygtgygttgttgttgtygggtgygyggtggyggygggtaggggygyggagtgygttaggtygtygtaggtygaygggtggaagttagygtggtggttttygtagatttygtttattagtygttttattttttttagygagttggtgagtatgaggatgtagttgygygttagtagtagygtggygattttggaaagtttgygtatygaagggtygtgtgygtayggtatgatttygyggaggttatttatggygatgttgaggtygtgtatgygtttgygttygyggttgttgattttgagaygtagttgttgtagtttyggttttgttatttgttttttgttttttttggtggaygaygtagtygtygaygaygtagaygaygaggtgttggaygaggatgatttgaagttattgttttttagtttgtttttaggatgygygttygtagagtttatagygtygygtagttyggygtttagtttyggygggtagttattyggggtggaygaggatayggtgtttttagtgaaggygttgtygttgttgtttttatttygggtyggtagaaaaaggttatygggttttggygaygaygggyggttggatattaggttggygttygagtttatggttttaggggaagatagtygtygtagttttygtagggttttttttttttyggattygaaaatttttaggagaggaggagaaaagagagagaatgagagagagagagagggagagagagagagagtgagttagtgagagatagaaaagttgttttygtttgtatygtagtattatagygyggggtttyggtataggtggttygtggtttttygtttttttygttattatttttggttttttttttagttgtaygygggtatttataattaagttttttttattttttttttgtttttatgtaataggttattttagggagygttggtgattttyggggtgygggtggtattttagaggtttygggtttttagttaggtgtgggaaaattgagttttygggttggaataaaygagtgggaagtgagggtttttttttggggagaatggagatttagatagagaattaatgatttggttttttaaayggatttattttatttttatygatattaygtagtaaatataygtataygtatatgtatttagagtyggygyggggtttagagtttatgtgttgtatttggagattayggggagtttattagttgattggggtttgggtagaaagagttgttgtygtttygatttttygtttttggtgagggagatgtagyggtgagtgtggggaggatagaagagtaaagtygttttggagaaatggttygtagagtagggatttagattttttgtatyggagtattttgggttatagtygagttgaggagagtttgtttttgggatttaggttgyggttgttgtggggyggggatatttattttggatgygatttgaggagttygtttygaaaagttttaggggagaatttggtatygggygttggtgtygygtygatttataataagtattygtatttttaggggttyggtyggtttttatagttyggtggtagyggygayggyggtagyggtggygggggygggggyggggaataatgtgygtgttttggaggggttgtttygttaatgagttgggttygtyggggggttgggaagttgatgttattygggttaatttygtttaatgaaattygttaggtygggtataygttttttttttgygtataattaatgggygttygtggtygggagatttttggggagggattggaggagggattygaggaggygagggggaggagaagggyggtttaagggggatggagggagggttgagygygtttgggattaagggagaaagggaaygtggttaaatttttgtaaaaaatayggttattatagagttaggttgggggatgggatggtttggagattttgtagagtttaataaattaatttgatgttttaygtagtygtattttttgggatgygygyggaaaattttggygatttaggattyggggttggggttttttttttagttttttttttgtttggtttttygtygtttgtttttattttattggttttattaataygtgggtatttggygttttaaatgtaaaygatgtttaggtataaagtttttattattttggtgttttattygygygtttaggagatggtygtggttgtagtttygayggtagtyggtagygtttttagttgggggtagggatttgaggggtagagggygggtaaggagggaggggayggattttagaagagtgttttgaaagaatttataatttttttttaggttgaggatggtgtgggtatagggaygagttattttygtayggtaatygygttagtataagggtagggtygtgtttgtagttaaatatttttttatttattagtaggggagtyggatgatagtaagtatttttagtgtygtttttgtgattattataygttttggggtaggggtaaygttggtatttgtagtttaagtagggtttygttgtaaaaggttagtaaagagtttttygttttagtygtttgttttttggaattgtaaagagaagttttaggtttgggtaaggtttttttaygttgtgggttagatagygagatggaattattygygatygygttgggatatgttttatygattgtaggttggttttgaaatttgaaaatttttgaygatgaggaattaagttygaattggagaagtattttayggaggtagttgaggtayggatgtatttatttattttatagatgggaaaagttagagatygtgtgtagtaagtttatagaaaaaattgttaagtttttatagagtagttttgtttggattatagatgttggygttggyggttttttatagtataggtagttatttgttttttttagtttttaatttttttttygagttgaattttttatatttatatatttygaatttagatatttgtttttgtagatttyggatgttagtatttgatattgtgagygtaygygygggtatataygtatatagttttttagggagtgtgaggaaygtygggttattttygttgttggggaatttttattgtgtaagtayggttttaaaaataagtaaataaattagtatagtaaataattggtttttaagtagtaaagttataaaataaataaatataaagagaaatttaygttattgtttttagttttgagatatgtttttttttgyggttttygttagaagtttagttygttttygttttygttttagtttygtgttttttggagtattattttttaattygygtgttttttagttggttttgtagttattygttaaatatgtatttaaaatatgaagaattgaagygtggtgttatgtygtttaayggttataaggatgatttataatygtttaattagtagaatttgttattyggaygaygtagggagygggggggtggggattagaaagggttygggtatttgtagatgtttttttygggtttatttygttaatagtagygaggttatgtgtggtgygygttgtggggttattagtyggggygyggagttgtgygtttgttagtgtagttaataaatattagtaggygtaaygtgygygttttttggttgtagtygttgaggttagtttagtygtyggtaygtgtttyggaattyggtttttttttttgttgttgtttattggtgtttgttttgygatygatttgyggyggtgagagtaagyggttttaggttttttgygygttyggtttagtggttggagttgggagttaggggtgaaagtygaggggttygttttggtatggygygagtttagagtttggaaggtaaagtyggaagttttgtgttgttgttggttttttttttatttggtaggttttttttaatattttttygtygtyggagtagtttgggaggtyggggaggtttgtgtygtttttgggtttttttggttttggtgttaatyggatgttgagtatttttyggtgtgttttttatgtttttttatttygttttaggaataattagaaattagatttyggtgtttaagtttgttttggtgygttttggaggygtttttaggatttgttygggttttgygttyggygttyggggtgggygatttgggygggttttaggtattgyggtttttattagygygygtagttggggtttttttttggggaatggagtgtttatttgtagaggttaatgggtttyggtttygggagtttttggttggttttygygttttggtgttgttggtttttttygtgttttttttttttttttgtgttttttttttataaaagatygggtgygtgtyggggtyggtttttgttggatygtygggyggttygggaggagttygtgttaaatyggygggttttygyggggttttagggygtagattttttattgtttttygggtttttttygggttttttttttgatttttttttttttttttttygagtttttgtttatatttaggttgygtttyggtttggttgttaaatagaaygaygtttttgygtagagttgattaggggtggyggygggaggtaaggttttyggtatygg

SEQ ID NO: 7089 - DNA, 1423 bp, synthetic construct
  misc_feature 1..1423: note = Description of Artificial Sequence: Synthetic polynucleotide
  source 1..1423: mol_type = other DNA
ygttgygggataggtttttagagatygtttygggayggtygtgayggttttygagggatatgagagaagaggagyggygtttaggtaagttggattttgyggtyggaattygygtagaaaygaaaatttttggaaggggtttagtttygagtttyggaggyggataagttgagttttttggttgtattttttggaggttgttggttgtagaygtygtygttttttaagggyggttgttatygygtgygtyggttagattaggtygyggtgttttyggtattttygygtttyggyggttgtattyggtttttttttaygatygaggtttygggtatygygttttttttttyggaygttttgygygaygtygttttagtttttattagtatygagggtagttygyggttattttataaaygttttagtgtygtaatygtttttatttttattatttttaatgtttgtaayggtttttaatgaggttggaaaaatattatttttygttaaaagygatttygagttaggaggagygygtattttygyggtttttttttttatatttttttttttttgattttttttttttttttttggttttttttttgtttttygtttttttagtagtygygtgttgggttttttttttgttggggtyggattttttttttyggtygttttagtttttgttttttygttttttttttttttttttttttttttygtttttttttttttttttttttttttttttyggagtygttagtygygttttaaattygagtagggygygtagtgtttaaatttgttygygyggttygygtttttggtttygagggygygygtayggataygygagtatatttatatttaygygtatayggataygygygtattygaagattttygygygttygtatttaygygtatttggttaygygygtgtattttygtttaygygtttttgtttygttttyggygygtatttygggttygtaagtygygygtyggggyggtygttttgtttygygattggygggagtyggagtttttttgaattyggygtttatattatgggttgagttygtyggygtygagggagttagtgygattyggttyggygygtayggttaaggtaygygygttggtataygygggygyggataygygyggatatataygtgygggataygttttttttygayggyggygttaatttttyggtaagtttagygttttaygygatttgttyggtttttaygttggttatagyggttgyggggayggggaggaaggtagyggggtggttttaggggtttattttgtagggttttttygayggygtygggataggtggggygtttagygtygggagggayggttygttagtgyggggttttagggaggygygtgtagtygggtgygg

SEQ ID NO: 7090 - DNA, 1384 bp, synthetic construct
  misc_feature 1..1384: note = Description of Artificial Sequence: Synthetic polynucleotide
  source 1..1384: mol_type = other DNA
ygagygttttttgaagtgayggggtygggaygygtagggaggyggtttaagaagygygttttaggttagtttagaatgygttyggtygygattaggataayggygggtggggttgggggyggttgtygggyggggagyggtttygygtttttagttattttttaagagtygttgtttttttaattttagttgttagaggttttgtgattggttgyggtaygatgattygygtayggattggttgtttygggtyggggggtygggttygggggatagaattygttttygaatttttaaagagggtatttttyggtaggagttggtagatttaggaggtgygatagattygyggggtaaayggattggggttaagagtygggagygygggygtaaaggtattagggttygtttagggygtygygtagtayggttttgggggttttgygggttttygggtgygygtttygtttttagttatggggttygtagygttggagattttgggtttggtgttgtgtttggtgggttgggggggtttgattttggygtgygggttgtttatgtggtaggtgatygtttttttggattataatatygtgayggygtagattatttggaaggggttgtggatgtygtgygtggtgtagagtatygggtatatgtagtgtaaagtgtaygattyggtgttggttttgagtatygaggtgtaggyggygygggygtttatygtgagygtygtgttgttggygttygttgygtttttygtgattttggygggygygtagtgtattatttgygtggtttygggttyggttaaggygygtgtggtttttaygggaggygtgttttatttgttttgygggttgttggygttygtgttattttgttggttygttaatattgtygttygygagttttaygattygtttgtgttygtgtygtagaagtaygagttgggygtagygttgtatatyggttgggyggttatygygttgtttatggtaggyggttgttttttgtgttgyggygtttgggtttgtatyggtygtttygattttagttttttygtgaagtatttagygtygyggyggtttayggttatyggygattaygataagaagaattaygtttgagggygttgggtayggtygggttttttttgttagttaygtttgygaggygttggataagtttggggagtttygtatggatygyggttttygtygggtagygyggygygtaggtttttyggaaygttyggttttgygtttygaygyggtttttggattygtttttgtttgygttygtagttgatttttttttgttattagttyggttttgtttttaatagayggaatgaagtttttttttttgtgygyggygt

SEQ ID NO: 7091 - DNA, 1361 bp, synthetic construct
  misc_feature 1..1361: note = Description of Artificial Sequence: Synthetic polynucleotide
  source 1..1361: mol_type = other DNA
ygtygaggatgtggttttygtttttygtagtygtygtaggagtttttgtttttaaagyggtaggtaggggttttagygggtttattttaatttgggaaggtyggtgygtttttttatagatttygtagggygttttttttggggattattgaagttttggtatttttaattttagttttttygygttaygggaaaygaagaygatatttttttgaataatttyggatgtgttattatagaggggtattttatattggtttttattttaatttttatttagtatattgtttgtttattttttaaatttygtgyggattgyggtatttagtttygggggattttttagttttgttttttygattygygtaggtgygttygtttatttaagggtagggaggtatgttttttygggttttttyggtygtatggtttgtttgtttttttggtttttttttttygtattaggaggggygtgagatagttaggtygatttttatttyggtagtttgyggygatyggtygtttygagygtagygttagatatttgggttggggggtgttagtttgaygygtaggaagggygtagyggygggagggggttttattttagatttgggaggtttgtttggygtyggttttygttygtttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygagtygggttttygygtttgtgtggtyggttggyggtyggggttygtgtgtttttgygyggyggygtgtgygtgtgygtaygyggggattaygttygttyggagtygtygtygtygtygttattttttgttyggggtygagygtagygttttttttgttygtttygygyggygyggtagtttagtttggtttygttttgygggagaggygtygttttygtygygaagttaggttgggygttggagggaggygatygattatygtttttttttgtttattttataggttggggagggggtgttgtaggttaatgagygttygggggyggggttagatygagggyggtgyggtggggggygyggtggggggygtygggttgtttaattygattttattygtagtatagattggagtaggagttgyggygggaaattttagyggygggggtygggggygt

SEQ ID NO: 7092 - DNA, 1175 bp, synthetic construct
  misc_feature 1..1175: note = Description of Artificial Sequence: Synthetic polynucleotide
  source 1..1175: mol_type = other DNA
yggagagtygggatttygaagtttttattgtttttgtygaggygtyggygtygttttttgtgtttttgattaygttagttttygtygaggaggygatattttttttygygtttttygatagygagyggtyggygtttagygtggaggggttyggaggggttttgtaygygygygtggttygaygygaggttyggtyggttygggttyggggygagattgggggtttgtygttgtygttatygttygagygtaggaaatygtygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtygaatayggtagttttyggattygygatttaaygtygygtttttyggggttgttygaggaggygatagttttygttgygttttygtygtttagggttygagygygygtygygtttyggttttttggagtttayggaygtyggyggtttttygygaagygygtygaggttgtttttatgttggtygttgaygtgygyggtaagattygtagtttgggtygygtygaggtggttttgggygygtagggttttagggaaaagtyggygtttttatagaaagttaagygtttygtgtygttagtttygttygttygygygtttttagygatygaaatttyggggtttgagaaggyggygatygatttgttygygtttgagatttttyggaagaagatttttatttagaagtygtygygtaagaagagtygggaggyggygggygagttgggtagggygggygtatttattttgtagtaggttgtggttygttygygygtagtttttttagtttygtagygtygttygttattttatattttttaygttatygggtaygggyggttttttattggtygggtatygygyggttagyggaggttgygttttattggtttaggttttgtagtygtttttggattggagtagtgtgttttggygggaagggtttatttygttggtygaggtttgataggygtttagygggygattttttttttattggtygagttatggagygtttygattagatagygt

SEQ ID NO: 7093 - DNA, 1087 bp, synthetic construct
  misc_feature 1..1087: note = Description of Artificial Sequence: Synthetic polynucleotide
  source 1..1087: mol_type = other DNA
ygtttgtagttyggtygygtggaggtgatygggyggaatttygagggggygyggggagagttgggygggtttatygttttagyggttgttgttaggggtygygaggttttttttgaagatgtagygtagtatattttgtatatgagtttagaggaagaggaagtgtagtyggyggaygygyggyggyggyggygggggygygtyggggttggagtyggagygygtygggygttgggygtagygagygagagygyggyggtygygggtttyggygagggatagaygtatygatygtyggagggatagatataygattaygyggygttatygtttaygtttttatttatyggygtttaagtttttttygygtygttttttttgtatggtataaatttttttttygggayggaataygttgttttagggagttygygatygygttttttttttygtyggttttatayggtaggyggyggggggggygygatagggtttggggtgtygatyggtataggttttttygtttggttttatggatygggtttttggygggtagtgggaatygygygtggygtttttttgtaggttgttttttgtyggggtttyggagttgttagagtagtattttttggttygygtyggatggggatttgggttgatttttgggaygtttggattttgggttaatttttttttgyggggaaygggtgtaggggagttatttttggagygatgtagggagaggtatttyggagtagtttgttgggggtygtaggttttgtaggtttagaagygtttaggaaggaygtagaggtgggggagtttggaggttataggtgggtttaggatatattgtygttggggttttyggaaaagaataggagggagttggtygyggagtttaggttttyggggtgygygyggtttgggtggggtagggtggaggyggtgtttgattgtttttttgygtgtgttttgggaggtgggtttgttttggggatagaggtgttggaygtgtaggagtagatatgtygygygtttygaggaagygtyggaattattagaagtatagggaygygggtgtyga

SEQ ID NO: 7094 - DNA, 693 bp, synthetic construct
  misc_feature 1..693: note = Description of Artificial Sequence: Synthetic polynucleotide
  source 1..693: mol_type = other DNA
yggtttaggtattygggtagagggatgatttygygttttgygaaaagtaataggyggttgtattttattttgygttagtttygggtyggggtggttgttttattttygtggtttagggaggaggygttgggtgygtatgtttaggggtgtgttygttgttagggttgtagyggtygttatttttaattagttgtaagtygagttgtttatttgggatygggtyggttyggygggtttggttttyggygaaggyggyggygttggtgygyggyggttggggygygggaygtaggtagtgygtggygyggttggygttttygggygtygttatygagygagggtgyggtttygggyggtygtgyggggtaygatttggttygygttgttgyggyggtygttgtagattttgttttaggygtygtagttttgtaggaagagtagataaagataggagagaggtaaagygtygtttgtttagagatgtagtyggtttagttaatagagggaaatygtttttaaatttaggttgggaatgagggaggaggggygaggyggttggggattagaaaaagtagtagggaattaaygtgatagttagagtttagttagtgtttygtyggygttgttttttygtttygyggttgyggggttyggaatggagagaggaggygggggttgagygttggttgtygg

SEQ ID NO: 7095 - DNA, 5065 bp, synthetic construct; identical to SEQ ID NO: 7063
  misc_feature 1..5065: note = Description of Artificial Sequence: Synthetic polynucleotide
  source 1..5065: mol_type = other DNA

SEQ ID NO: 7096 - DNA, 307 bp, synthetic construct
  misc_feature 1..307: note = Description of Artificial Sequence: Synthetic polynucleotide
  source 1..307: mol_type = other DNA
ygttttgggggygatatygtyggggaatttgatgatgggygayggygyggyggyggygtggtttagtaggtagtttaggagatagagygtttttaggggattygtgagygygtttygggttattagygtttttatygtagygttttttggtttygygygtygttygggggtygttggttyggtgygtgtggtygtttygtygtttggttggagtttgtttygyggygtagggttgygtttygagggttygttggttyggtggtttggggtttgttyggtttagyggtttatggttyggttttygygt

SEQ ID NO: 7097 - DNA, 1563 bp, synthetic construct
  misc_feature 1..1563: note = Description of Artificial Sequence: Synthetic polynucleotide
  source 1..1563: mol_type = other DNA
yggtgttttygtagttyggaygttagygttagggattygttataattttaagttttttttyggggttgggtttygtatataaataggtagtataaaattaggatttagttggggttygtatttttttttgtttagattygagtygttttagttttyggtygtygygttyggagttygttttaattyggaaagtggyggtyggttgyggggtaggygggyggtatttgtgagtagttttagtyggtgttttagtatttttatttyggygttyggygyggttyggttttgggtggyggygtyggggtagygygttyggtygagtyggggagaggagygygggagattyggagyggagyggtaggagagygyggagygaagyggtaggagtagtttatagttaggagygttttttygtttttaaygtygygtttttttttttaaaayggtttaaaaaaatttattaattgtatggtygygtatttttaaaaaggtattygtygttatttggtttyggtgaattttaggaggyggaggaagggygyggggtgggtgyggtgatatygtgggaggtggtttttygtgttygtygttygaataaagagatttygtygttttygggygtygyggtggggggtygyggayggyggttgggggtttttagygyggtygggaaggygaggaaggagagygggagtygyggggaggagggggygtygttttygyggaggygaaatggggygggagygagtyggtgygggattygyggggttagggtygtgygtggggttggggtygtgttyggggttgggttgggttgggyggggaygygygtagtagtygyggyggygagagaagttggttttgggtttaggggygagggygtygtygatttatygyggagatgyggaygagatagaygygtaggyggggagyggggtttyggygtygtygaygygygggtgtaggtgygggtagttaggagttttttygygtgttygyggttgtaggggyggaggtygggttgggggyggtgygtygygggggygtgttygygtgggtttggygggtgtgggygttyggttygyggggyggtgtygggtttggggttagtttyggayggatygyggtttttygygygtggttttygttttttgygyggttggggtgttyggtgggygggygggagggygagyggggatygygaygyggagtttgggggatatttyggtygattygygttttygtygattttttattygtttygtygygyggattgtgttgggtgygttgygaggttttgttygtttttttaggttttttgtggtygygyggygtygggttttygggggaggggayggygttgtygtagtttttgtttagatttttaaggggaattttagatttgtagagatatttttattttagygtttttgygtttgttgtttygygttattygtygtygtygtttgggaatygagggagaaaagtttttagggtygggaagaattaggggtttaggggtttttggggygtygttttttttttttygttttyggagttyga

SEQ ID NO: 7098 - DNA, 512 bp, synthetic construct
  misc_feature 1..512: note = Description of Artificial Sequence: Synthetic polynucleotide
  source 1..512: mol_type = other DNA
ygattygaggttgtttattyggtttggtatgtttyggygtttttggggtttttgtatttygttggtttttygttgtggtgtttygtagttygattatttttgtgtttttaggagtttattttgggyggtagggaggygttgygtggggtttaygagttttaygttgttatttttattagtttttattttttaggygtttgttttttygtattgttaggttttgttttygtagtatttggtagatttgagttyggtttttgttattttttygygggagttttatagtgattttggaggagaagtagtaggagtttataggttatygygttyggtygygygtgaagtttgtgtagtygtatggtyggttygttggtttyggttttttgtygayggataygttgttgtttatttagaggttgtttygggtyggtttagtygtggatttagtgttttgtttagtttyggagtttggattgggtagggagtyggyggggtgygttgatttgggtygg

SEQ ID NO: 7099 - DNA, 1070 bp, synthetic construct
  misc_feature 1..1070: note = Description of Artificial Sequence: Synthetic polynucleotide
  source 1..1070: mol_type = other DNA
yggygttyggggttygattggtgggaggggttyggtagaggtttygtttygagattttagtaygtttygtttygttttayggtgtagtatagatttygyggagaaygygagtatggtyggaaattatygtttttattttttggygggtttygagggaaggtygggaaygggygggttttgttggtttagagggygttaggggtagttatyggyggttygggatttttttygtygygagygygggggagtttaggttyggtttgtygggggttgggtgaggttgyggattaggtttttaygtttttygygttygttygygtttgttttaggtttttatygyggttttttttgttttyggggtygttttgttttttatagattttattttygggggtygtttttaggattttygttygtttttttttgattyggtttttgttygtttygtttttttttttygggttttttatttttttttygtyggtttygatttygggggygtttyggatttgtttttygaatatttttagtttygtttttagtttgyggagaaggggtygaggagataggaggaagagagygagagtttaggggaygaggaggaagttatygagaygyggagattygaygaygtygagggaggtataggtyggggaagyggtagtygggggyggagygggggatttgggygggttttttttygttttgtttttgtttttttygtttattttttttttttttttttattygttatttatygttatggygttttygattttaggyggygagtgtagtygtygttttatttttygtagtttggygygtattagtttttttgtyggtgggygggygttaggggtagggtygaggttygggtatattttttttttttygtttatttggygygggaggtttatttttygagagtagttgttttttgtttttttttagggtayggatttttygggttagtygttgttttagtatttgygaggataaagaggaggttttttygtttggtygtttttttggttatayggttygtttttttttttttgtgtttttygyga

SEQ ID NO: 7100 - DNA, 766 bp, synthetic construct
  misc_feature 1..766: note = Description of Artificial Sequence: Synthetic polynucleotide
  source 1..766: mol_type = other DNA
ygggaattttaygtttttgtattagttygggggttyggaygagttygggagtygttggtygttaattatygygyggtggagaggygggygttyggtttyggygygttgggggagttagttggygttgttttttttatygttttagaygtttatatygatatagatagaygtatagaygggygggtagatatygatagttttttaatygtttgygttttagtttyggtttagggagtttttygtattttttggggtgtygtaaattgtagttyggtaggttygygtygggagaagggagggygygtaggyggtyggaggaggggaggttttagygygttttygttgygatgtgaayggyggyggtttttatttggagtygtatttggggygtygagtttyggggtygyggaaagaatgygygtygttygtgygtttygtttgtygygtttggttattygtagtygtygygttygtatttgattatggagtgygtttttttgttygygtgtgttttttyggttgygggttygggttygtygaggggtttggygggattggggygygtggttaaggtaggtgtygtygagyggagtttygagagygggtggtagggggygttygaygttagtttygtygygttttttaygygygatgttatttttttttttgtaggygttttagttgtgttgtttttgttgtgygtyggtygtygyggttttagttagtgatagtagtagyggygttagyggattaaatgatggttygt

SEQ ID NO: 7101 - DNA, 363 bp, synthetic construct; identical to SEQ ID NO: 6874
  misc_feature 1..363: note = Description of Artificial Sequence: Synthetic polynucleotide
  source 1..363: mol_type = other DNA

SEQ ID NO: 7102 - DNA, 2919 bp, synthetic construct
  misc_feature 1..2919: note = Description of Artificial Sequence: Synthetic polynucleotide
  source 1..2919: mol_type = other DNA
ygagygygtaatatgagttttaaaggttaaatttyggttagttaggagtyggaaggttgagttyggttgatttgattttgagttttttyggagttatttygtataggygttygttttgtttaagggtaygygaygttagygggtagtyggttttygtgaagaatggtttttaaataatttattttatttygttgtaaagagagggataaaatgggttttttttttttayggatgtttagttttttgggtaggygtatggtygggyggygtttagttygtagtttygattyggatattttattgtattttttttttttyggtttttttttygtaygggygttygagagayggataaagagttggggttaagtttgagygtygggtayggttaggtttagggaaggaaggttttyggtagatatttgggtattagagttggtgygaggaggaaaagttgggaggygaatttataattttgggggtggagggtaggtaggggaggggaattaggttaattttagtygagtgagtttttagygagttggggtttyggatgggaggtttgtttygygttttaaagaaaagtaaatygtttttttaggttygttyggattgtygaagtttttttggaaaaattttttttttttttatattaaattttgygtygggtttygttttttttygggtaggtagyggygtaggaagggttaagttagttygttttagttgatagttagttgattgggttttgattgatagtttygaaaagtttttttgtttttatattattatgttaatygyggtygttttygtygttttttattggttyggagtgttagttaattttttatttggatttgaygttaygagtgttataaaatttagtaattgttttaaattttttttgttggattagaggttttaaaatttttttttattttttagttgtagttygggttgtttgtyggtttggttttttttttttttttttgttttttgtttygtttttttttaggatttygttattttgtttttttaaaaaaaggtaagaaagaattaaattttttttttttttttttttagtygggttgtatttttgttttgtattttgtatagaggtagagagygygygagggagagagaggaaagaaaaaaaataataaagagagttaagtagaagaggaggygagaagtatgaagtgttaattttttygtgttaaggttygygtygttyggatagaygttygtygygtttttagtttygagyggaygtygygygygttttgtttgtagttygggtyggygaggygagtttttttttatgtaaagygygtagyggagyggygagygggggaygtygygtatygggtygggtttttttagtttygtygtygtagttattatygtygttatygtagttygyggaggattttttygagtttgaagtygtyggtttggygygtaaggaggygagygagtaaggaggggtyggggygagygagggagtatattggygtgagtaggggggagggagggygggygyggggggygygggtagggygggggggtgtgtgtgtgagygygttyggaggtttygggttagttatygtygygtaagttagaagygttttagttyggtaagttggtttattygttggttatttagtatagttygttggttttttttttgtagtttatttggyggagyggyggyggyggyggyggyggyggtaggagaatggtattagaattggtaatgagtaatttygatttgtttattagttttttggttatggaatatgttaatgatttygatttgatgaagtttgaagtgaaaaaggaatyggtggagatygatygtattattagttagtgyggtygttttatygtygggggttygttgttttttatttttatgagtaygtygtgtagttyggtgttttttttttttagtttttyggygtttagttygggttygggtagygagtagaaggygtatttggaagattattattggatgatyggttattygtagtagttgaatttygaggygttgggttttagtttygaggaygyggtygaggygtttattagtaatagttattagttttagggyggtttygatggttaygygygyggggygtagtagttggtygyggyggtyggggtyggtgtyggygtttttttgggyggtagyggygaggagatgggtttygtygtygtygtggtgttygtygtgatygtygyggtygtygygtagagyggygygggttygtattattattattattattattaygtygtyggttattattattattygayggtyggygygttyggygtygygggtagygyggtygtttyggtyggtggygttgggggygygggyggyggtggttyggttagygttgggggyggyggyggyggyggyggyggyggaggyggygggggygyggygggggyggggggygttttgtattygtattaygtygtyggyggtttgtatttygaygatygttttttygaygagtagttggtgattatgtttgtgygygagttgaatyggtagttgygyggggttagtaaggaggaggtgattyggttgaagtagaagaggyggattttgaaaaatygyggttatgtttagttttgtygttttaagagggtgtagtagagataygttttggagtyggagaagaattagttgttgtagtaagtygattattttaagtaggagatttttaggttggtgygygagagggaygygtataaggagaaataygagaagttggtgagtagyggttttygagaaaayggttygagtagygataattygttttttttygagttttttatgtgagtttgataygygattttagttagttattttgataagtgtttygygggggttyggttygg

SEQ ID NO: 7103 - DNA, 2267 bp, synthetic construct
  misc_feature 1..2267: note = Description of Artificial Sequence: Synthetic polynucleotide
  source 1..2267: mol_type = other DNA
ygggygggggagggggtttgtyggtagagaaagtgyggagagggtagagtagyggttyggggygtttttgtaggtggatatgaaaygtaygatatgtaaatgaatgtaaagtgtatgtaaatgatttggtttygggattygygggaagygagggtttygtatyggattygttygggaggttgagyggggggagygygatttttgtyggttaygtayggaggtggttttgggtygggttaggygtygygttgggggygagygyggggtagggggygggggyggyggtygaaggagygattttttttttaattttttatttttttattttttttatattttttaattttygtttagtttttygygyggtygttagaagtygyggttttaaagttgygaggttygyggtygtygattgttgygaggtgggtgtgygyggtttgyggagggggagagggtgggygtaggygggggtygttttttagagtygygttttttttayggygttygtattttttaattttttygttygttttygtttgygttttttygygtygtttttygtaggaggyggygygttygtygtttttttttygygttttttttttttttttttgttttyggygtttygtatagtttyggtttttatggttagtttttagggygtygtttyggtggyggaggygttgggggyggttttyggyggyggggagtttttttttaggtyggygtttyggggyggagttgagygttatgggygtygggygggaggtaggtggygtagyggyggyggyggggggtaggaggyggaggyggagygygyggggygggggtygyggggtttygtgagattttygggygagygygyggygttggagttataggygyggyggttggattyggygygggtygyggaggtyggagatygtttygggyggggtgygygttttgttttygygyggggtggtyggagtygagttttyggtatggtttaggyggtygtttygygygttttagtttygtygygygtttgagttyggtgyggygttagaagatagygygtagtygtttttgagtygtggaggyggggattaagttggaaggagtagygattttyggatygagtygygagtgtgygtygttygtygttygtyggatttttyggatttttygatygtaagtgtygtgttygtttygygygtygtygtygttttatttygatttygttygyggttgtygttttyggatttgygtygtagtygygtygagygtaygggtygtttttaaagttggtgtttayggtagggtggagttaattygtttagygtttatttattygggttgagygtagtttttygtgagtagagtttgatttgygggggttgyggygaaatttygaggggaaygaygygttygggygttgggagtttygygggtttttttggggtygttyggtttttttaataaaggtttygyggttygygtgayggagattygggagtggggaggtygagggyggttttgggagaggtagaggtggyggyggtyggtttggggaggggggtttagagtttttttttgttttttttttttttgttygggttttyggygttgtttygtaggttaaaggtggttygygttgggggttttggattttgtttggtatgyggtttttggggttttgayggtygygggtttyggtatagtygggtggtagygatggygygtatagtttttgggaagygtttatttgtgttgggtaggtttygagttaggttgtgggaatagyggggagggaggtgtgagtttttgtggagggatagatggttggaaaygtagttttagayggttgattttatttaygtggagtagaaggyggttaggttggtggyggygatttagagtygttgggtttygaatatattgyggggttggygttttttygtttttgygttygttygtgtgtgttggggtygyggtygggttgtgtttattttttatttattttgtgggttgaggtyggttgattttaggtttattttagggtttaggaagaaaaattttttttttgaaaagagagtaygtygygtgtttttgtgggtgggggtttgtyggtagttgttaggtttgtggttttagttagggtgyggtttttgtgygttyggttygggtgtgygtttttttttttggaygaggaataggaggtttttagggtagttatttyggyggaygggtyggtyggggataaggggygggggtyggtttttygg

SEQ ID NO: 7104 - DNA, 265 bp, synthetic construct
  misc_feature 1..265: note = Description of Artificial Sequence: Synthetic polynucleotide
  source 1..265: mol_type = other DNA
ygtagtttgygatygatggagtaggaggygygggtgttgagagttgygggyggttttggtygggttyggygtttgttggttttygtttygtgggtattttgtatagtgttggggttggtgttgagtttygaggagttgtttatygygtagttygygttttattgtygatyggattttaygttgttgtttttagygttgygygttttgygyggattygygttgttggaygtygttatttygygtttggggtttaygygagtygyga

SEQ ID NO: 7105 - DNA, 374 bp, synthetic construct
  misc_feature 1..374: note = Description of Artificial Sequence: Synthetic polynucleotide
  source 1..374: mol_type = other DNA
ygaatagygttttgaaaygtagaaaygtgtttattygaattgttaaygygagygtagagtttattgataaagtaaaataagataaatygggagttagaaaatttagygatttataggatttatygtgatgttttttataaatgttatygygaaaatagtyggatttgaaaataaaygygatttatttggttttyggaaggggagaaggattygggygaaaggygttagttttttttygttygtttygtagaygtagygtaggtttygagttttygagyggyggttttagaattygygggttattygggagtttttttygtagtattagtygaaagtttttagygtygaggagggygggyggttgtttttttyga

SEQ ID NO: 7106 - DNA, 1133 bp, synthetic construct
  misc_feature 1..1133: note = Description of Artificial Sequence: Synthetic polynucleotide
  source 1..1133: mol_type = other DNA
ygaatagygtttttaaatttagaaaygtgtttattygaattgttaaygygagygtagagtttattgataaagtaaaataagataaatygggagttagaaaatttagygatttataggatttatygtgatgttttttataaatgttatygygaaaatagtyggatttgaaaataaaygygatttatttggttttyggaaggggagaaggattygagygaaaggygttagttttttttygttygtttygtagaygtygygtaggtttygagttttygagyggyggttttagaattygygggttattygggagtttttttygtagtattagtygaaagtttttagtgtygaggagggygggtagttgtttttttygatttygtttygttygygyggaygttttyggttttaygyggggattatttygggattttygtyggatttygygygttygyggttaatttgygtgtatttgygtttygygttaygttttyggygttttaygtttagtttttattgggtttygttttttagtggttttaagtttygttttttygttggttatygtaagtttygtttttygaggtttygtttttgtaaggttygtttttttaygatttaggtttygtttattayggttagttygggtttaggtttygtttygataygatttaggtttygttttyggttagtttygtttttygygygtttygtttagtaattttygttgaattyggygyggtttttttagygttgttttaygtygtagtttagygtttggagttygygygtttygagtttttgttygtttatgygtagttgggttatttaggtgtatttatttttttgttgtttygtygttttttttgtttttatttygtttaggttttgggtgttttttttttattttttttggygtttttgttttaggttatttggtygtttttttgggtttttygttygggggyggtttttggttygayggtgtygtagaygygygygtataggttagtttygyggagaggttgtttttaggggttaggyggggggttgagttagaggttggggtttgttaggagyggggyggtttggggygtagtagtattggagttgaaggygagggyggttygygtygg

SEQ ID NO: 7107 - DNA, 2358 bp, synthetic construct
  misc_feature 1..2358: note = Description of Artificial Sequence: Synthetic polynucleotide
  source 1..2358: mol_type = other DNA
ygggattygttttttaagyggygttttttttatttttygygaatttttyggyggggtttgtgtggattaagggagattagagatttttygtygttattttatttaggyggagayggtttattygaattygtaygggtttttttttttttttggaatttgtagttggtttttttygaatgtttgttttttttttttttttaygaaagaatagtgttttgggattyggggtgyggggtagtygggttygttggagttgtttagtgyggggaagagtygtygagattgggagaaggggygttggttagggaggagayggggtagggagyggattygygattygtattttgggyggyggttttygygttttagtygygtttttygatgatttttagtygygaagggygagygggygggggttgggttgygggttygggttttaggaggtttgyggggtyggggaggggygtggagtggttygaggatyggtttggggattgggggtaggtgtttggayggaygygggtygagtatttttttygggggygggygtagtgaaaatattttgggaggyggygtygygyggttgagygttgttgttttgggaataggayggygttyggtattgygagttgagagtatttttataaattttgtatgggaggygtttygtgagygggggyggggagyggagygagagggagggagttagagagtaagggagggagggaggaggagaggagggggaagtyggggggaggaagggaggygtttygtttygtygatygttyggttttgtaaaygygygtygggygtttttttyggagttyggyggtgygtgygagygtttttttgttgtagtygyggyggyggtggttygagggggyggagaggagggggttgyggtyggtyggttagggggyggygtttttttttaaaatygtttgygaagtgtttygggtggtagaagtaggtygtyggtttygyggagtaagtygttygtttyggggttgagtaagygygyggggttgtygggtagtattayggttgtttgygggygtyggtgttttyggygyggggttggagtttattatgtttttgyggggtygggttatygggtaygagyggattttyggtttgttttygtttygaygygttyggattagttgtagttggygtttagggatttgaatttggatttygggagggagtgygtttaggtygatttyggagyggyggtttygtggttaatatgtttygtaaaggtgagttggagtygtaggggtaagttgaagttgaatgygtttyggaaagagtygygagttygggygtygttyggygtyggggttttyggtttgggaagtagttttyggygggttggtgggttttgtygggygtattygtygaggggttgttgttggggtttagttttygttagyggttagttgtgagatayggggttttttttatggatygagtggttaggtttagagattyggttyggaggggttagtyggagattagagtgagyggtyggtggtggaaggggagtyggttttttgggatttttgttttgttgggataaagttttgtatttgtagtttttattttttgygygggtataygtttttgtttttgtygttttgtggaggtygagttygtayggygttttygtgtagttagyggttagtgatygygyggttygggygtttttygygygttttagttttttagayggggttyggaygyggaygttttttttgtagttttgttttgatygttagggatgggttttgggtatttagyggttgagggtggggagyggttagygtttgatgtttagttttttaaatttttattatgttgggagyggagggaygygaaagtygtgtygttagtgtgygygatyggtgtatagtttaatttgaggatagttggtttygygattatygtagttagaygttttagtagttyggttyggtayggagygyggtaaagttggtgygggtatyggggaagtttygtygygtttttaygtggttgttaygyggggygtygtttttygggttttgggagggtaggtgattaygtygggagtttaygggtttygttattagttgttttagtttttgygtttgtttttttttttttaggttygagtaggttgtggygtttygtygggatttttttygygtttggttyggttaggaggttgagaagtygyggygtttgyggttggttgtttyggttttgygggagyggttgaggygggagtttaggtagtygaggggtttgatttttgygttttaygttttagttttaattygtttttgtttttatggtaatagatygaggtgtygt

SEQ ID NO: 7108 - DNA, 1050 bp, synthetic construct
  misc_feature 1..1050: note = Description of Artificial Sequence: Synthetic polynucleotide
  source 1..1050: mol_type = other DNA
ygggygggtagttgyggttgttgaggttyggtggggtttttttaagaygygtgttygtatttgttygtygggygtttgyggggtgtagygtttattggagygygatagtttttgggatagaggaggatagtggtttygtttttttgtgygatygtttaggagtttygggtyggagagtgygagyggggaaaaggggttttgtatttagagtggggyggaygtggygaggaagttaggggggatygggaagygaggttygyggtgyggagggygyggggygtggggggatatttttyggagagatatyggaggggyggaagtaaggagatggaaaggagagggagatyggggagatagatttgagagatttagaggtttgtagagagttttattygggattttttagagtttaggaaagagtagatgyggaygygggagggygttttaygttaaagygggtagtattagtgattaaaataygtttygtttggtagtttygggaygtatttttgtttyggtagygtaggagaggtttggatagygygagatgttagggtttaggttgtttttagagggttggttygaagygttggagtttaaagaygttttttatygtygtygggtggtagaattgggggtaggygygttttatagatttygaggggtggtttygttttagggtygyggggaggygttttygtgyggggyggagttgttatygttttttttttaattttyggggattgtggtttttttttaagttygyggygtttttagttgttttttattygtttygttygttagtttttttttygygygatggtttyggygttgagttatgtttttaagtttaagtttttygtgattttgttygttatttygtttttgttgttgttattygttattttgatgttygttaaggttagttgtatttttaggtagtttttyggatattyggygttttgtgtttattaaygggtatygatttygggagttttgagttggagygtayggatttygyggggagtatagttttttyggggygygygt

SEQ ID NO: 7109 - DNA, 1731 bp, synthetic construct
  misc_feature 1..1731: note = Description of Artificial Sequence: Synthetic polynucleotide
  source 1..1731: mol_type = other DNA
yggtyggttttagttgttatttaggtaatttyggagtygtygtagatatyggatttattggaagggggygaagtygyggggaggaatgggggatattggggaaggggygtygtttttgtygttttygttttttttagtgttattgggyggttgttgyggagttygygttattttttttttattttatttygttygtttggtttygtttggtygttggttygygtttygttgygttygttygggggttggttyggttygggtttttgaygttattagtaagtttgttgttttyggygttttaygtgtggyggyggttagyggyggtttaggaggtagtyggtgagygtttgygagtagagtggygggggtygttgataggtttygygtagtttagtttagtttagttaygyggtttataggtggggtttaagagtagtttggagtaattyggygttayggagaggggtggayggttttgtaygggttttttgtttttygttygggtagagggattyggggggatttygttttttggttgagagaatttgaattygggyggagagaaygygtttaggygggtaaggggattagagaaagtyggggttggaagttattgtygttygttattgtttggagygtayggagygtagaggttyggtagtygygygtgtttttayggggatygagttagtgatgtaggatygttgagyggagattygygtygagaagtttttyggggtyggggttgagaygtaygttttygatatygttgttaagatttygatttyggygatttttgyggggaatygaggggttaaggttgttttaagtttaggatttgggygagtttaagaygatggttttttaagtayggattygygttttttttttygttttttygattggaggtagggattttgygyggggttttygggatttygttttttygyggagtttyggtygttgtttttygggatagttygtayggttataggggygtayggygatgtggttttygtttagygygttggttygtyggggggatgttttggtatttgtyggggtttaggtttagtatggtyggygygttgttygaygtygttttyggttaggatggttttttygggttyggttagtgttttttttatttyggtygagtygttgtttygtagtatttttyggaagtttttgttgatgttttgttttttgtttaygtttttttaygttttttattgtttggtygagygttgttagattttgttyggtttygtygtggggttgttyggyggyggygaggaggygggggtttttggtggyggygttttggtyggaggttygagggagttggyggtgtggtyggyggyggtatagagaaagygttttttgtaattgtygtagtggyggaggygtyggtygttygygtttygygaygayggygaggaggyggtttgggaagaagagttttttggtttgttagggggttygggyggtttyggggtyggaagtatygtggtygaggtttygtyggggattttggygttgtttttggaygaaggtagtaagtagttgtygtaggttattattatyggagtgaagaagggyggtaygygggygttgttggagtttttgygygtgtatttygaygtgygygtygtgggygtygagttttattttttygatygtagttaygataagggtttygtttggtatyggtgagyggggygggttygg

SEQ ID NO: 7110 - DNA, 3535 bp, synthetic construct
  misc_feature 1..3535: note = Description of Artificial Sequence: Synthetic polynucleotide
  source 1..3535: mol_type = other DNA
yggtygygttaggagttgttggtgtagtttaggaaygtagtgtttggggttagttgyggtatttatagtgggttttttyggtagttygattygtygggttatygtttygggttttgtgttttttggattygggagttttgtttgttagtttagggagatggttygggaggaygaagaatttttygtttttygyggtttagttaagtttttgyggtygttygggtttagtygttatgygtggtygttygtagygtagttttygggygtaagtyggtagtygaatttttygggttgygttgttygttgtaggygygyggygagggtttttaygygatttygttttttatttagygttttttagttaattaaaaagaaygtggtaggtggagggtagtygtttaagagattgygtgagtttttttgtggggatttttatagtttgttttaggtgttttaaaatygtttgatattaagggtttagttttttttttgttagttttttttaattyggtttaagtgtgtttgattttagaaaattttaggttgtttyggggttttggygggttttatttggaagggygttagttatagtttgtygtttggttttggaattattattttaggaggagggggagtggtggtggtagaagttataataatataatyggtgataatagttaaygattagagaggtttttaygtgtttgygaggtattttatygtattagygtatttattttttttatttttgtttagaatttgtattatttttattgtatagatgagagtattaaggtttaygygattagttaggaygtgaatttaggygtyggattttagagattttatttttatttattagtgtttygagaatgggttatagttygggaayggtgggaaagatgattgttayggttggttaaatttygagatttgggtaatttttgataataataaaaaattattaaggataaaggggaaggggtaggaygaggttgggaagggagtygttttaattygyggggttagtttttttttattttttaatttatttaggtttygatagtggggtgggtatagggagaggggtttagttattttttttttttttgtttttttaagttttgagygtttgtgaagttaattgggtttggaggggtgtttgaatgtygtgttggttggggttaygggtggagattttaaygaaaatgtgggggtygttatttgggtttttagtygaagatagttatyggaggtygaaatttagattttttgtttattygygttttattygaagttygggtaatttaatagtttattttaaagattagtagttgyggaaagtagtgggtagaggtagtgattgtgatttyggggttattgtttttttggaatttgattygtaattygattygagaatagaattttyggaagtygygatttygaagtaatttttattttttaattaatgggtttygaatattttttgtttyggaygtgtaaaagtttygyggagataygygtttttgttttttttattttagtatygagggtagggaggyggaaaygggyggyggtgttyggaggttyggaygtttttaaagtttygygtygttttagtyggttgtagtgygygtttttgttygatagggattagtatagttttaygtttygygygtygttygttygttaggyggaggygtygggttattygttyggtttattttttygagtttaggyggttygygagygaggygggtttgatatttttggggtttyggtaattaggyggattgtaataaaaagttaatagattttgyggtttygtygggaygtygyggtttttattttttttttttatttgggaagtagaagttgttttagaagttttttgagggyggagatygattaaaggggtttagaatatttttagygtttygggtttygggaggaaaaaatttaaaaygagttataaaataygattygagtyggatatttttatggttagagggtggttygttttgttgagggyggttttagtygttgttttttttttttgyggygaggtygtttgatgaatttaagggtattagtgtttygygagaattttttgtgggttgtgaygagaattaagyggagygtaatttttatygtattyggataggatgygttgygtaatttgtygtagtttttttgttttatttygggtggttygaagttgtaattttgttaattttttattataygttatgttttttttagtttagggtttgaatygaygatggagattttgtttttggtagggaaatttatyggtattaagygaggtttttgtygtagttgygatygaagaaatggggttyggygtttayggygygtaygtyggggtgtaygygtagaaattttagtagygttygygtgtygtttttttttaygtygatgatgatggtttgyggtagttgtttgtttttagatttattgaaaaagttggagatggggtttggggagttyggtatttygggattttgttttttygggttygtagygttttyggttatttttttgtttgaagttagtggggtggttggyggygttyggaayggtagtttggggggygtttygttyggagttgtggttagggttggygggtygtgtgyggygygggatttagagtttaggagtagtagtttyggygyggyggygtaggagtyggygtaygagtataggaatatatagagttagaygtagagtatggygaagagtagygygagttttttttttatyggyggygggggyggyggyggttgyggtaggagtyggtyggggatatygaggtaagatttgtygttatttaggygttgttttatgygttgttygygggygyggttagggatatggtttagtatatggygtgggtttygtygggtagtgagygtagagagggtttttyggtaygttggaygttygggtggttyggtttattgttttygtgtgttygyggtygtygttgttgttgttgtttttttttaggtggyggyggtagttgtagyggyggyggtttttgatatgttgttyggtaggagttgtaattggaayggaaagtygggayggyggtaattgttgggygagggtttgttttyggggygygaygaygygttyggggttaggaggaygttgtattttygygttttggttattttagattgtgygtatygtygtaygtyggggttgtttttttgtagttttaagaattgagtttygagtagtttyggtattttttygtagaggttgtagaggygaattgygtaggaagagagttgtggatygaggtggagtgggyggtttyggttttttagagtgaygggttgttttatttattaaaaatttygaaygttatgtaaatataggygttttttygagagtttagtagttaattygtttttaggaygagggggtgtggaaaggtttttgggyggtgtagggyggttaggggttgttattggtttyggaataaggggygggtttaaaggggygg

SEQ ID NO: 7111 - DNA, 2896 bp, synthetic construct
  misc_feature 1..2896: note = Description of Artificial Sequence: Synthetic polynucleotide
  source 1..2896: mol_type = other DNA
ygattttyggtygygaatttaagtttgtygttttygtygygtttattttttagttttttttttgtttyggygttattttaggtygaygtttttaattaaaataagttttttttttaggagttttttttttttgttygaggtttagggttagtagttttaggagggattttttttttattttatttttttyggtagaggtgygagattttattgttagtttggttattygatygygygtgagattggggygtagggtaggggggttattgggtaggttttygtgyggggagtggggaggggtttttaggggaagtgtttgaagttatttttgtagttttgtttagattyggaagtygtygaggaagggaggaaggygggggtggggagagygygattttaagygttggygggyggygaggaggggtygtagyggttygaggaagygtttggaggygttaggggygtygagtttttagggaggtygygttttygggaagttttttatyggttgttyggagtaggatyggaygygyggatygtttttttyggttygattagtttyggggygtagattgygaatttgaatagaattttttttttttttggtatttttygtttttttattygtggttattagtttygttattttagttttatgtttttygttaatattatattygttaagatygtttattaatgttttgtggaggaaaggggaggggggaatttttagtataattaaattgtggttaaaagyggttaaaaaaaaaaaaaaaaaaaggaaagaaagaaatttttttttttgagatygatttttttaattagygtggaaaatttttaaatatgtaaattygtaattttagttaagattttggygtygygggaggggtgttygyggygggyggygattttagtttgtagtttyggatttygggtaggtttgygygyggyggygggtygggggttyggggagttttggygtttatagtagttygtygaaaatataaagtttygtygttaataatatttgygggttttttttgggtttttygggygtyggygttgygygtttygtygtttttttttttttygtygttttttttttttygygtaygttttttttttygttttttttagaaygyggtggttagatgagatttttgggagaaataaatgtgagygttygtaygaattttttttttygttagtygtttgtaayggttttaggttygtttttttttttygygttttygygygygtygygtttttygygtttygygttttttttttagtagtttttgygagygtttttagtagttattatttataggtygtygggggttaggaggtaattagagayggtttygtggtygtatttattyggtaagygygatgttggygyggggygygygyggggaggggygygygatgagggggtttggttgygygtagttygygttttagatttgggggaagggaggaggaggagggggtagggaaggaggaggygggygggggggygagagatgagttygggaagggagygggaggagggggygtyggggagaygtttttttggtttttatygyggggtttyggggttattygttgygaggtttygaygygtttagggayggggggtgtgagtgtaagagtgygygygygygtaggygtgtgtatgttaaagatagaggaggggagggagggaaygttttaatatttttttagtgatttaygagtttgygggtgaggttttggttgtgygtttaggttygtgtgtgtattaatgtggttgtatatttttggtttgttttaygagtgaatgttayggggtttgggggggggggtttggatataagttagtgaatgtgtttttgggttttagtttgattgaatgatgtggygttgygtggggttgtgtttgtgygattgtttataggggggttgtgtgatttygtgaggtattgygtgggtgggattgygtttgtgtgyggttgtgtgtatatgggattgtgtttgygtggggttgagtgtttagagggtagttgtgtggttatgtgggtttgtttgygagtgggttggtgggtgtgtggggtygtggggttgygtatgtaggggtagtgygtttgtayggggttttgggttaatttaaagggttgtggtgggtatttgtaggyggttgygtgtgtggttggatttgygtggggtttgaggtttggygggtgggggttagtttttttggygtyggggatygtatygyggtagaagagtygtttaaggygttaataggtagygtyggggtygyggygtagygygaygtgtagtagyggtggggygtagagagaaggyggagaagaggggggtttttatygygygttttttttagtygtattagagaygtagtttggagattttgtygtttgtyggtttygyggttttagaagtatagggtttgggggattttttttagttgggggagaygtttattggtygggaaggtagygagaattgagattygatgattttggygtagtatagaagtatgyggtaaggatygttaggagaggtgggtygyggttyggagatagtygagaattaggtygagataaagaagagygggatyggggattttggggttaaatygygtttttaggtttttyggyggtygaggggagygtatttaaggtyggygygtggagtttggyggaggtggygygggttttttttygttgtagttttagtagtygttttagagttttgggggtaygtaattaggygttatagggtagggttayggtgaggggggttttgagtgtagttggygggygtygagtttyggggttgtgattgagygtttagttggttygtttttttttyggtygtttatygtttaygt

SEQ ID NO: 7112 - DNA, 2567 bp, synthetic construct
  misc_feature 1..2567: note = Description of Artificial Sequence: Synthetic polynucleotide
  source 1..2567: mol_type = other DNA
cgtttttaacgcgggagcgtagtgtattttagtggataaattcgagaatcgtacgttgtttttcgtttttatttttgtttttttcgttcgcggttttaattcgggatttaaatgtacgagttcggtgaatgtttcggtaggagggcgagggtttagaggtagtttgtttagtaaaaacgatagttgtgttttggtgggttttgggttattttaggtagaagttagagaagttcgagaatttcggcgggttggtaaagtttgtcgagaagggtttttttggatatttttattacgggttttaggttcgaatttttttttttatttggttttggagttttagatatagataagtttcgggcgcgtcggcgggcgtatgtgcgtgtgtgtttatagcggggtggtcgtcggagttttttaagaattttagttttttcgttttagttgttcgttagttgtgagcgttcgtcgggttcggaggttattcgtaaatagttgggtcggtagttgggagtttgggaggtttttgtttagtttcggggtttcgagaaaggagaagggggagcggagtggttgtttggttgtggttttttttaatttcgtttgcgaagttttcgttgggagttcggagttttagtttttttcggtagtttcggttttcgcgttcgtcgcgtttagcggtcggcgtttcgtttcgggtttcggggaggaggcgcgtcggggtagtcggttaggatattgcgttgttggtttttagagttgcgggcgcgtttggtcggttttatttttcgggttgttggggcgggcgtcgttgtttcgatttcggacgcgcggaattttggagattcggtcgtttttcgttagggtcgcggtgttgttttaggtttcgggcgggcgttttttttcggttatcggtgtatttcgttgttcgtttgcgggaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttgcgaaaggttcgagagaggtcgtaggttaggattggatcgtcgggcgtcgtcggatggtgttgttagggtaatcggatggtacgcgaagtcgttcgaggtttcgattcggttacgggggcgtttagtggattcggagagttattttggggagggggcggtttcgaagaaggattgggtgggggcgtatggagcgggggttgcgcgaaaagttttttggggcggagttgagttacgcgggtcgcgtaggagcgtttgttcgagggtcgtttacgagggatttttttgttcggttgcgcgggtttttgcgttgatgaagttatcgcgtttcgggtcggagtttcggcgtttttgtttcgaatttagcgaagttcggttttatgtttttaattatttaacggttttttatcgtttagcgt

SEQ ID NO: 7113 - DNA, 573 bp, synthetic construct
  misc_feature 1..573: note = Description of Artificial Sequence: Synthetic polynucleotide
  source 1..573: mol_type = other DNA
cgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcggaagcgggggttgttgcggtttttgttgtcgttttttttgttgtcggtcggcgcgtttcgggaatcggcgtttaggtagttagggtttggagagcgcgagcgttttcggaggcgcgtggttagggaggatttcgattttttgggcgt

SEQ ID NO: 7114 - DNA, 383 bp, synthetic construct
  misc_feature 1..383: note = Description of Artificial Sequence: Synthetic polynucleotide
  source 1..383: mol_type = other DNA
cgttcgtcggtttttataggggcgaaattaggtatttatcgtgacggcgagcgtgatagcgttcggttcgattttgtttagatgtttatagaagatggagttgacgaggttgattataaagattattaattgcgtaagaaattgcggaggcgcggaaagtaaggcgcgtttatagtcgtttttttttttggaagttcgcgtttatttttgcgcggcggtcgtttcggaggcgtcgggttgggcgtgaggacgtcgtatttattattgggttcgcgagcgtcgttagtttagtcgttttttttcgtaggttcgggggtagcgtatttcgtaggttttataagtcgttacgttattcgagggttcggagtcgttatgggggtcgg

SEQ ID NO: 7115 - DNA, 853 bp, synthetic construct
  misc_feature 1..853: note = Description of Artificial Sequence: Synthetic polynucleotide
  source 1..853: mol_type = other DNA
cggcgcggggtgaggttcgggggtcgttttattgttgaggttcggtcggttggggtcgtcgttaggcgcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgtttttcgtgtcgtggatgatgagtacgggcgacgtgatttaggatattttttcgatgttgcgggaggggcgtggagcgggtgagatttagcgttcggttcgggtttcgtttcgttttcgttttcgtttcgttttcgttttcgtttgggtcgtttatttagggaaggcgtcgaagtagtaggtcgttttggtgttagggaaggcgacgcgtatgttcgaggtgagcggcgagtgtagtattatcgcggtatattcgtagcgcgaggttaggtttacggtgggtatcgtgtcgatgttttgtcggtataggatgatgttgttcgggttgatgtcgtatttggtagcgtcggagtagggttagtcgcggttttcgacgcgcgtatattttttttattagcgggcgttttcgggtttagtttcggatgcgattttttagtttttttatttagttaagttagtgggttaggtttaggttttatattagtttcgagggttatttttagtttttaatatcgcggcggtgggcgaagttagcggtttcgtttcgttttttgcgttgtcgtttattggcgttttttagttaggatttgtagggatttcgtttacggagtgtttttggggcgg

SEQ ID NO: 7116 - DNA, 1062 bp, synthetic construct
  misc_feature 1..1062: note = Description of Artificial Sequence: Synthetic polynucleotide
  source 1..1062: mol_type = other DNA
cgaggaaggaaggtgggcgtagaagttattttaggcgtgacgcgtgacgttcggggtacgggcgtcggggggcggaaagcgagggttcggttgggttagggatattcggggggggtcgaggttttgggtttcggcggagggaggggattgggagggaggttatcgtttcgggttacgcgggtgattcggcgggggagttgggggaggggcggcggggttgggttggggttttcgggtcgggattggggtcgggttagtttattttttcgttttggtcgaagcgtagttcgagcgtcgcgacgcgttttacgcgtaggaagtcgtcggggtcgcggtcgtatatttcgaatatttcgcgtaggcggcgtacggagcgtagtagagtcgcgggggcgttcgattagttcgcgtcgttcgttattcgggtcggttcgtagtttagttcggatttttcgttcgtcgcgttcgtcgtttgttcgtcgtcgttatcgtcgcgcgtttttcggggtcgttcgtttgggtttgcgtcgcgtagttttcgttcggtggcggtcgcggtcgattcgtgttagtagcggcgtcgtagttttagtcgttttggaggggaagggaggggaggggagggaaggagaagagtggggaggggaaggaggaggggtaatagggggcggggaggggaggggcgggggtcgcggcgaaaatgggagggagagggggaggcggcgggggcggcggcggcggggacgttgtagataaaaggagttcgcgttttttcgagtggggcggtttacgcggggtcggtaggcgtagcgagttgttaacggtcgcgtttttcgcgattttagttttttttcgcgtttttagttttttttcgcgttttcgagtttatttttttttttggatattcggagttatttaaaggttttgttttgtcggaggatttcgcggggtcgcgttttttttcgttattcgtgttcgttgtcgcgtttggcgtttttcgagcgtttaggatgttttgggggttttttgtattggcgcgtttcgtgattgtatttatttcgg

SEQ ID NO: 7117 - DNA, 918 bp, synthetic construct
  misc_feature 1..918: note = Description of Artificial Sequence: Synthetic polynucleotide
  source 1..918: mol_type = other DNA
cgcgaagttttcgcggcggagagcgttgcgcggggagataaagggaagggatagggatcgtagggatagggataggagcggttgtcgggttttgggttttcgatcgttattagatatgttttcgagtagtcgaggtaaagggaacggatgggaaaggaaaatagaggagcggtttagaagggcggttcgttgcggtggtggggcgcggattcgggaattcggggcgggtagggtacgggcgtattttttttttttttttttttcgttcgaggtcggtagcgtttttcgtttcgcgttatgtatatttattgtggtgatgagagttcgcgtttcgtgttcgttacggttattgtgcgtttaataaaaataaatattgtcgaggagtcgtcgcgatgcggggcggacgcgcggttcggaaaggggagggggttttaggaagagttatattcgcgagtcgggtttgggttaggggcgaggggagagcgttaagattgtttcgtcgtcgagggcgtcgatggaggtataggggttttcgtggggcgtttcgagagatatcgtgtttggtcggcgggacgtgggttggttttttattcgacggagagaagcggtatttttattttcgggtatcgggtttgggtttcgagcgggggtttttggaatataaggtagtgggggtagacgggtttgggtttattttaggttgggaaggggtttgagcggggcgttttgattggattcggttttggcggatcgaaggttttaaaagattttgtatttttaaagatttttgtagatcgttatcgtttaaggcgttttaggttcggttttatttatgggaagggtaggaaagaaagttgggagcgttttggggcgcggggtagagatagcggtgttggaggcgcgttgtggaggcggcgg

SEQ ID NO: 7118 - DNA, 865 bp, synthetic construct
  misc_feature 1..865: note = Description of Artificial Sequence: Synthetic polynucleotide
  source 1..865: mol_type = other DNA
cgagttgtgtcggttttcgcgttttttttattttttttttttttcggattttcgttttttcgcggagaggttttgtcgttttaagagtcgggttagcgattgataagtaataaacgttgagcgttcggttgcgttggagtcgttcggagttaggggtttttcggggcgtaggtaggcgtttttcggttttcgggttagtttttattttaagattttcgtttttttttcgttttgatacggtatttaggattttatttattgggtttaaattttataggttttttttatttaggttcgttttttttttgtttattcgttttcgtttttgggttttttttttggggtgttggttgggagaattaagtttcgttgtttattgatattggttttcgtttttgcggtaggggttttaaagtggttttaggtattaaggtggtgagttgtgaggggtttcggtatttgcgcggttttttcgggggttgtgcgggttgggggtatttagaagttcggtattacgtaagaatcgtgttgttagcgttttcgggggttggggagcgagatagaggttgcgttgggtttcggtggttttttggtttttttaggtagttaatattataattttttttgggagggggttcgtagaagggcgcgcgttgtttttttcgttttttaagttgtagcggggcgggtcgggagttagggttagggtttggagatttgggaggggatcggtgttagaagcgaagagttagggttagaaagttaggttaattaaggggggggcggtgcggataaagacggggtgggggttggtcggggtagttatttagtgattttatttttggttttcggcgggcgcgtacgt

SEQ ID NO: 7119 - DNA, 408 bp, synthetic construct
  misc_feature 1..408: note = Description of Artificial Sequence: Synthetic polynucleotide
  source 1..408: mol_type = other DNA
cgaagcggggagaattcggttgggttgacggagacgttatatcgcgttaggggagtaggagttttttcggagcgggaggcggggcgtcgtgtggttgcgagcgcgttttttggatgtttcggtcggcgcgggggtgggtgggcgttttcgttttatttttggtttcgggcggttagtcgcggtgtgttcggagggttttgcgagggttgtgggtggcgggcgagttttagcggcgtagtagaggaggggttttcgagcgagcgtattagggagaagggggttcgtgtaaattttaggttgacgatcgcgtacgcgtttttcgggttattagttttgtcgtttttggtggggtatatcgaggagatcgtcgtggggaatcggggatcggattgtttgatagtcgagcgt

SEQ ID NO: 7120 - DNA, 2245 bp, synthetic construct
  misc_feature 1..2245: note = Description of Artificial Sequence: Synthetic polynucleotide
  source 1..2245: mol_type = other DNA
cggattttgcggagtttcgagtttcgggtgaggcgatgtttagattggcgcgaagcggggtgtttcggtagtagcgtagaggtttattcgttttttcggtcggttgtagcgggcgcgtttatattttgtaaaattaaaacgttttggaaagcgtttggggttgtaagtgacgtttgatacgagcggcgggtcggattgtcggtttttcggtttttttttggtttatataattcgcgggtcgtttttatcgtttacgaattttagcgggtagacgttggacgtgcggtttggttatttttttaaattttagcgttcgattcgcgtcgtagggtcggtcgcgtagcgcggggatcgcgggtgtttaggttcggagaacgagcgtcgcgtttttagtcgcggtcggggaataggaattgtcgttagaggtatcgttttttttttcgagattgcgatattgattaagggttcgtaggcgcgggcggtatttattttttcggattcgtagttcgtcgcggaggggaaggggtaggacgcgtttttaagattagggcgggggcgtgcggagtcggggagttgtttgggggcgttggggcgaggtgggaatttcgttttagagtttttagtttcggggtcgaggtttgtaggaagggcgtgggaggtggaatttttttttttttaggcgtttgttcgagagtttagagcgatttttggcgcggagtcggttattcgggtgggcggattttttttttcgttaatatttcggcggtttcgttacgatttttttttttatttgagtttttttttgtttatttaattttggttttaaaggtttagagagttaggttgtttcggagtttagtttttttcgatttaagtacggtttttttagcgttttcgtttttattatatttatagtttagtttcgtttcgcgttcgttaggggtcgggggcgttagcgttcgagggatggtcggcgggttgttattttgacgagacggagttgcgggtgtttttttattttcgggttcgttcggttatcgttttgaatgttcgggttttacggatattttagagggatcggcgggcggttgcgggttcgggcggtacggggtgggcggtcgggtttttcggtcgttgtttggtgaggagatgttcggttcggcgtttttcggtttcgcggttcggttcggttcggttcggttttcgttcgttttttttcggggaagtttggtcgtcgtttttcgacgtagttcggttcgcggtcgttttttgtcggtttcgttttcgttattttttttacggttcgcgtcgtttttcgtttcggtttttcgttttttcgtttagttcgtttttttttttttttttttttttttttttttttcgttttttttcggtttttttttcgcgtttcgtttttcggtttttttttagttttttttcgtttttttcgttttttttttttttttcggttcgttttttgtgtttcgtcgttaggattttttttttttgcgttcggggtttgcggtagttttcggggcgcgttggtagtagtggcggtcgtcgtagttcggggagaagtcgggaatgggggaagggggtcgcggtaaaggattagtttttcgttcggtcgaggtcggggtttgggaagttttagggatttggggtgatttgggttagggtgtttaggtgaatttatgagggcgaggttattgggggttagggaatagggcggtttttattgagcggagtcgtcgcggaatttagtgaggttgcgatttgcgtttgggtagttttcgttttgcggttggttaggaggagtttttcgtcgtttttattttagtcgcgtcgggcgttgggttcgatttttagtatttttggtattgatgtgtttggtgcgcgttgagacgcgaacgttttgtaagatgagtttttatttattcgtttttttttttttttatttgtttattttataaattgagtgtttggttattttggtttaggtaagaggttggatttgggaattttttggatttgggagttttaggatgaaagggagacggcggtgttttgtaggataagcgggtattgaacgttgtttaggggaaagtcgggcgcgtattgcgttgtagcgcggcgaacgttgttaggagttcgcgggtagggcgtggggaggatatagcgttttttttcggtcggtcgagttttttgggtagcggtgggttttttcgttagatttcggggtcgt

SEQ ID NO: 7121 - DNA, 2972 bp, synthetic construct
  misc_feature 1..2972: note = Description of Artificial Sequence: Synthetic polynucleotide
  source 1..2972: mol_type = other DNA
cgattattttcgtttttttacgcggttttttagggaagaagcgaggcgtttgagttagattgggttggaatagtgcggtaggggttcgtttttcgcggagttgtttttttatttattatttatttagtttagttcggtcgtttacgtacgtttatttgttgttttcgttttatttttattaggcgtattagttagttcggcggttttggttatagacgtttgaatgataaagtgtttttattatcggcgcggttcgttagtcgattcgtcgggacgcgttttggttttagtttttttttttttatcgcggtttaggaagaaattcggatcgcgtatagttattttagatcgagtagtcgcgcgtcgaggcggaggcgggagtcgtaggggttgtagacggtaggtttttgtcggggtatatttttttaagcgtttaggttttttacgtttagtttttttttttttttgggttttcgcgcggggattttcgtttttgtttagattcggagtttaagtcgttgtttttttgggattcggtttttttttttcgtttttttggtttacgttcgtttattcgcgtttgagtagcgtttttaattagcggcgttagttagtagacgtgttcgcggtcgtttttaaattttcggacgtagttataggttttgatagttttagggaattggggttgagttttcgggttggggttcgtattcggatagaatttttgtttattttattcgtaggttttatcgtcgacggattttggggatagtgttaatttttttcgttttgttgggaaacgtagtcgtgatttcgagttgggatagcggttgttttttgaaaaggtgggggagtatcgagttgggaattaggtcggggagtttagttacgattttggtttaatttgttgtgagattttggttaagtcgtttaaatttttagagttttagttttcgtatttgtaaagtcggaatttggggcgtagtgttttgatgaaagatgttggcggggagagtgaagacgtttttttcgttgttagattttttagggtattcggtttatggttataaagtaggttatatttgataatttcgtcggattattcggaggattcgtcgatttttgtcgagtcggtggttcgggatatcgcgttatagaattcgaggcgttcgggcgttttcgtttcgttaggtgtttagcggtttgtatcgagagttaggagaggtttagatcggatttcgatttttcgaggcgcgggagtttacggagcgcggtgggcgcggcgttcgggtcgcgtagttaggtggggagcggcgcgtagttttagattcgtaggtaggtagcggcggattgtatttgtttcgtttcgtagcgttttttgtttgtcgtttttcgtttgcgtagttagagttgcgcgcggttaggaagggttttcgtttagtgcgtttcggcgttttgtatttcgagacgtagttatcgttagttcgggtaggggtatattcgtttcgtttttcgcgattcgttgcgttgttttaagtcgtgagaatacgcgcgtcggaggagttcgtcggtcgtgggggaatttcgggagcgggttcgtttcggcgaagtgggtattttttttttagttttagattcgtagttttaatttcgggattgggagaggtcgcgagtaggagcgcggggataggcgttggaaatgtttaagtttttgtttttttttttcgttttattgttttttagcgggtaggcgggatttcgattattttagggttcgcgtttcgttttgttttttttttttttgtttttatttttttgtcgttttcgtcgtcgttttttttttgttttttttaatttattttttaatttttttttcgttttttaattttttttttcgacgttttttttttttattgtttggtcggtttttattgtttttgtcgggttttttttgtttttagttttttcgattttttttattgttttatttcgtcgtttcgggtttttcgttttagtttagttcgttttttttatttttagttttcgtttagttttttttttttttttcgttttggttttgttttacgattttttagagatcgagatgttgaggggaaagttttttcgggatttcggtattcgagtgttttttttcgaagaatttgggtatcggagagttttatgtttttttttgaaagattttttttagtttttttatcgttttttgcggtatttgaggatcggtattcgtgtttcggttttgtttttatttttattttggagagtcgtttttgcgtttcgggaattttagattttttttcgtggtttcggtattagaggtttttttttattatttatttttagtatttgggattttaatgttttgttttgtttttttggtggcggcgttcggtttttttcggagttttgatttcgggaaagggagcgggtttttttcggttaatatttatttttagaagtagtaatagtagtaggcgcggttcgtttatggcgcggtcggtggtatttgtttttatcgttcgtttttcgcggtagcgttcgatttttagttcggttcgttttgcggattgatggggttgcgttgcgttgcgttttagcgttttttttgttcgtcggagttggtcgcggttcggttcgttttggttgcgggcgggagaggttgggtgaagttagtgttgcggtttcgttttcgtttcgtttagttcgtttattttcggaatcgcgttcgttcgttttgtcgtttcggggtgggaagtagaggtaaagggagggcgtgcggtttttcgtatttcgttgcgtttttttttgttttgttttttagagttttttatttatttcgttttggtatttagttttcggttcgcgttattgcgcgttcgtttcggatgttgtgggttcggggattagggcgtttttattgcggtttttgttttttttcggttgcggttcgt

SEQ ID NO: 7122 - DNA, 1026 bp, synthetic construct
  misc_feature 1..1026: note = Description of Artificial Sequence: Synthetic polynucleotide
  source 1..1026: mol_type = other DNA
cgatcgttcgggttcgagtagcgggggcgtttttagcggcggtaggcgcgggtgcgggggagaggagtagaaaagagagtagtttgaggggtcgagggagtcgcgttcgaggtcggcgcggtggggatcgcgggtttattattagttaagtttagttatttaattatttgtagagttgttgtaggtataggtttaggttttcgttttttattttttcgcgggtgatgcgttttgatagcggtcgcgggagcgggggtaaaggcggtagttggggcggcggcggcggtacggtcgagtgtttcggggttgtcgtcgtcgtcgtcgcgtttttttttttttttttatttttaatcgtcgtttttttttcgggtttcgggttttgtttttggttttttttttttgtcgcggttatcgtggtcgtttttttttcgggtttttttatcgaagtttcggtcgttttagtttttattagtttaggttcgggttcgggttcggattcgggttcgggttcgggttcgggttcgggtttcggtttcggttcgtcgtcgtcgtacggttcgcgaaattcgtttaggaatagttttaggaagcgtcggtaagttttttttttagggatgtagtcggttatcgttgtttatgttttagggtagatcgggaaaggggttgggggaagtttaggaagggtaaggggttgtttttgagtttagggtttcggtaagggcggttaacggtcgtatcggtacgagcgattagtattaggttgtttggagagggttttcgtaggcgtgcgcgtcgtcgagtatcgacgtgcgcggttcgggggcggagcgcgtcgtttttttcggatttggagggaaagttggtggcgggcgcgcgtagggtttagcggcggtttattttttatttttacggagagtttagtttacgttgtttagagattgtcgttatggtaatcggttttaattaagtattgtagggtttttttcgtcgagttcgcggagtttaaaggatattttattcgttcgt

SEQ ID NO: 7123 - DNA, 10207 bp, synthetic construct
  misc_feature 1..10207: note = Description of Artificial Sequence: Synthetic polynucleotide
  source 1..10207: mol_type = other DNA
cgttggtttcgtcgttagttttttgggttttttttttcgttggcgttgtcgcggggttataggttttatttgagatgttagtatgtgttgggagaggtggaacgggaagggcgcggcggtgtttgttgcgttggtcgcgggatttagttcgtttgcgtttagtttcgcggcggttttaggttcgttattttcgtcgttgtcgtcgtttgttatcgaggttagtaggtgatttatgtttatggcggagaaggcgttagggtttatggtgaattgtttagggtgtaggaagagcggttggtcggtttttagcggtttaaagaattgttgttcgtgtaagtggttggaaaaggttaggtcgggtaggtgttcggcgtttaggggggacgtattgtttgtttgtattattagcggcgttaggttttgttttttgttttcggtcgtttttttgcgtttttcgtttttttttcgagtttcggcgcgttttttttttaggttttttaggtcgaacgggtcgttttcgtcgttttcggtcggttttttgtttttttcgggattacgtcgttttcgggcgcgttcgggttcggttaagcgagtggggttggcgttgtttggagtcgggttgcggtttagcggcgttttcgtacgtttttcgtttaatcgtttaggtttcgggtcgttgttcgcggcgtacgatttttttttagttgcggggagagggcgcgcggattataggggtttgggcggaggtcgacgagtaggattagggatattcgggaagggttgttttcggggaggttgagtcggaggagttgttggagtcgggtaaagggtagttgtaggttatttaatttaagattttagatttatagtggaaggaatttagttttggagaggaaattttatagttatagaattatacggcgtttaaggggttaggttcggagttcggtcggattttttggttatcggggatcgttttcgtaggggagtttcgggacggaaattttattttagatattcgtcgacgttttttttttggttttttaggttagcgggtggtttagtaaaagattagtttagcgatttgaggatttttcgtcgttatttttttgtttttttttcggttcgatttttatttcgggttcggtgtaggcgtagcggattgggcgttgcgttcggggaggtgggtggttttcgcgcggggggagggtcgtacgacgaggcgtttgatttcgcgttatcgcgttcgggtttgtagtgtttttcgtataagcgtagagacggtagcgttagttgttttttggggatgagcggatgaattaggttagcggggagtttatttttttattttttttgttcgttgttttcgcgggtattcgttatagggttgttgttttcggttttttattttttttttcgtcggtcgttttcggtgtttcggaagtttttggtaaacgggttgttgtcgatttttagttgtgtgatttgcggggattaagggggcggcgttaagttaggtcgtggtttttttagcgtggtcggtggtatttcgaggttagcgggtgttggtcgtagagggaagattcggggagcgtttatttggtatttattcgtttgggatgggacgtttcgagttgaggtcggtgggagggtttcgcggaaagcgacggggtttgttttttaaaagttttattcgaggaattatttttagataggtttagatagttttatataggtttaaagtagtgttatagtgtcggaattagtttaagtatgtatattcgttcgcgggtttgcgtaagttaaacgatttcgtattcgagtaggcgcgaatagagattgtagtttatacgtaaggttgtaggtatatataaagttaaattatatttacgggttcgtatatacgtaagtgtgtatagatataataaacgtttacggaattaaacgaatttatatgtttttataggtatttaatatattttaaacggggtacgtatagtttagcgtatattttggtttataaagttataacgatcggtacggatattcgtatttttttttttattcgatagtggcgtataagggtataggtttagaggggtgatgttttgttttattagaataagggtggagaagtcgtaagtagaaaaagttttttgattggaaggtaattttttaagcgttttttaaggggtttggggtttagattgatttagagtagtagttaggagtgttttggggggttgtgttatttgttttattttttggtttttttcgagagagtgaaaattgggtttcgggttttgagtatcggtagagtttgggtagattgtttcgggcgttttttttttatttatatttttatttttgagttaagaaataaacgaataaaatgtaaaaatgttagcgcgggttcggagttttagttaattgttaagtaaatatttttattagaacgacggtttagttgttcgttcgttttaggggagtttgtgtgtgcgcgcggtgggattgagagggcgttttgaggattttcgtgagtgttgcgcgtatggatgcgaggttcggtgttcgggggcgggtcgtaagagcgcggatttcgtgtagggggtttcgaggggcgatgaacggacggttgggtttgtacgtgttgaggggcgttagtgtaggggtttagtttatcgttcgtcgcgcgtattttgttattttggtaggtagtgacggcgatgaagtcggttttcgggaatacgtaggtgcggaaggtgttgtaaggtagttttaggatgtcgttggttcgtattatgtggaagcgcggttggtatttgtgtatggagtttaggatggtttgcggggagggtgggggttagtcggtagttattagtttcggttcgagtttttttattttttgggtatttgatttttttttttttattttttttttttttttttttttttttttttttttttttttttttatcggtttttttttttttttatttttttttgtttttgttttttttttatttttattttttttttttttattttttttttcgtttttttttttttatagttttttttttttttgttattaaaaaaaattttttagttggaaatagaaatgagatagagtaaaaataaaataaaataaaaaataaaataaaaaaattaattaaaaaataatttttttttataaaagaaatttaaataaaataaaataaaatagagttttataattttatttttaatattttttttttttttggtattggtaaattttttaattttataaagaggagattttaattttcgggggtttattaattgttttattttagaatgggtagttttttttattttatgaaatattattttcgttcgttggggttttgtttaggtataaatggagagaatttttaaattttttttttttagttgggtatttgtttgtgggaggagggaaaggttttagggaggttgggggggtgggtggggagggtggtttaatttttaaattttttagttttgggggagggttagggacgcgggttttggtagaagggtgatggataagttgaggttatgggtaggttttttaagttcggtatttataggttaagagtagggtgattttcgtggtttagtattgtagatttagttttggtagtatttgtttttttattgacggtataagggattttttacggtttgaggaattgagattgtgagttgttagttattgattttattattttttaggtttgtaaaggagagcgttggggtttaggtttaggtttagtttacgtagattatagggtagtgattcgggtaggggtattttgggggtttgtttagcgtttttttttgggagattttgtcgttttgtttttttgtttagttgtagtgttgggttaataagtttttgtatcgtttttattttgttttaatatttacgaagtcgtgtttgttagagatgttgttggttagttttagtttgtggaaggttataggtttagttatttattgttttttcgtggttgggttgtttgggtggatgtatatgcgtttgggtattttagggtcggttttgttcgttattatttagcgcgagttgtggaatttatagcggtaatcgttagcggttataatgtttattagtaggatatatttggtttttttgtttaggtcgttgattcgtattttgaagggggggaatattcgtttgggagggagggaagggaggagattttattggaatcggttgttttaggttttaggattttattttttttttatttattttttttcgttgcgtatatcgttgtcgtttggttgttttttttgtggtcggttgttttgtttttttattattgttcggacgattttatttgtggttgttgtttttaggagattttatttttgtttgttagatttttttttaaatagttttttttaggttttgtgtttagatttggggattttttttttttttgatttgagatgaaagttgatgtttaggagagaagtttaggttttttagaaatattttcgtttttttttaattttttcgaaattcgtttaggggaaatatttatttgggacggaagtttttagaaataaatttggagggtgtttgtattgggaattgggttatagagtttgataagatattttggtcgtgtagttcgggggaagagggtgaattcgaggtttggattttcggtggttgagtcgaagggtggaggggtcggggttgtggttttttttaggttttaaggtttggggcggcggatgcgtttagggttcggatgttcgcggtggagaaagggtttttagttcggtgaggcggagggttcggttgattcggggttcgttgttaggaatcgagtaattagcgtggggttagttgggtttaggttttattaggggtttcggggtcggagtagagtttgagagaggttgaatttttttcgagttcggagacggattcggacgtagaagagcgagagcgcggggcggaggagatcgttagggttaagtcgcggggttttttttgcgttgggatttagaacggttggggttattttttagtagtatgttttcgttttattttattcggaggattttagcgtttttgttttaaaaaaaaatcgtttcggtgttaaacgagaaaagttaatttggttgttcgtgggagcgaagcgtggcgttagggttagaatttggagtcgggagtcgggagtcgggagtttttagttttgttttgattcgtgtagtttcgtgttttagttcgttcgttcgttcgcgcgttttttagtcggtcggtagttttatttttcggatttggtgatgattattttcgtgtttagtttgtggaattggttttatagttttttggtttttagcgttattttggggtcgttttttatttcgttttcgggttttaggtttttgagggagcgtagatgcgcggcgggcgggtgcgggtttagtgtcgagacgtgtagtttcgtttcggtcgttgttgtcgtcgtcgtcgtcgcggtcgtcgttttcgttaggttcgggtcgggtagcggtttggttagcgcgtcgggcggtagcgcgagtgtcgggaagaaggagggttgcgtcgtcgttagaaaggcggatatggggaagtcggcgggtcgtggcgcgtggaacgggtggtaagttatggcgttggtcgttagcgtcggtttttttatcgggatattcggtttaggcgttcgggggtcggggtcggggtcgggggcgcgcggttcggattttcggttcgggcggcggcgcgcgcggtggacggacgattcgggtggcgggcgtagtagttgtttttcggggtttttcgttcggcgtatcgtaaggggtattcggttttgtgcgcgggggcggcgggggttttgcgcggggtcgggttgggtcgggttgagttggttcgtttcggcgtcggggattacgcgcgattggttagattttgtcgtgatttttggaaaattgtgattattttatatgttttgtttagttcggattttttgcgttaacgagttaggttttttttgattgttgattttacgttttttggattaattgtgggttttcgggggcggggttttgatagtttaggttaagtttcggtcgggagggggggtttgggagaaggtgtcggaagttttagtagtaagaaaatatgttaatagaataaaatattaattaatgacgggtcgtcgggtttcgagatttttttttttgtttcggtttttatcgttcgttcgcgtttgcggttgtttgcgtcggattggagagcgcggagggtcgatttgattcgtcgaaagggtttgaggcgaggggagttcgggtttcggggttttggggaaggattcgtagtcgtacgtcggttttaagtgtaaagtattgatacgatttcgagcggagagggggcgttttttttttttcgcgtttagaggttcggtcgttttggttcgagttttagtttggttttcgatttagtttcgggtcgtggcgtcgtttgggggtttttgcgtttcggaaagagatagtaggtattggaaagcgaggtcggtgggcgggcgagtcgggaggttcgggcggtcgaggttcgggagcggattttaggtggcgggagttggtgagtggagttatggtcgagttttgttggggtcggcgcgggcgggagcgggacgcggttttgcgttggggaaacgcggggattttttattcgcgttcgtttttatcggaagattcggaaggaatttggagtttttcgtaggttcgggtttcgttttgagttttttagcggtcgggaggagcggattttcggggttaggaaggtgagcgtatttttcgttgagtatagggcggtatcgcgcgggcggatttcggattttttattcgcgatttaacgaattttcgttttattcggtatcggagacgaaagtttttttttttcgaaatatcggtttttttttttcgttttgttaattatttttttagtttttttttatttttcggaagcgtacgttttttaagttaaggagtgttgagtaacgcgtgagggagttggggtgtttgcgagtatttgtgattgaagtttttttttttgtgattagttttcgttttttgtttttcggtagttttagttttttttttatgaagtgatggtgtgtgtgtgtgtgtgtgtgtgtgtgtgtgtgtgtgtgtgtgtgtcgggtttcgtgtggtgttttttgtgcgtagcgagagttataatttaaggtgtgtacggggagagtgaagcgattacgtatttgtttttaatcgggttcgggcgcgaatatttaggttgatttttgaaggtcgttttttgaaggaaaagatagagtatgtattagttacgggtgatatttttattcgtataatcgcgtggtgggcgcgtatatttaatattgatttatgtaggcgttcgtttattgcgtatatcggtcgtagggtatttcgttgttgaacgttgggagtagcgtttgaaggtcggattttttttggtagtgcggattcgggatcggcggaagtagtatggtttttgcgatcgttatttttatttttcggggtcgattttagggtttttataattttttattatcgtatatgtgagcgtcgtttttatagggttttttttacgatttcgtttttggttaggtcgtattttttttagtattttttttttggttagaacgaatttttgatttcgagttgcgtagtttacgtagacggggtaggatttattgtagttttttataggtaaatatttgttggttttattttaggcgagatgtggtttttcggggagggattcgttgtggatacgtttgcgtagtcggtgaggtgattagataataattagggtagttttttttagtcgggaatttaggtatcggtttaggaattcgtgaatatattcgtaaagtcgcgcgcgcgcgcgcgcgcgtgtgtgtgtgtgtgtgtgtgtgtgtgtgtgtagatatatatttttgtttttgtaagagtatgtgtatatttaaatgtgtgcgttttagatattagtttattttattagtttatttatagttggtttaggggttcgaggtttgaagagtttgaaatatttaggtttgggttatttgatcgagaaatttggcggcgatagtgtagcggttgtatttggggacggcgattttatttatagtggtatcgattttttttttggtttttcggggttttgttcgggttaggattttattattcgtttcgtttcgcggtttcgcgattattttgaggttttgttgtagtcgttttgaagagtttgtagcgatttttagttaaattttttagttaggaatgttcgaggtttatcgaaagttggcgttggggaggtttgggaggttttggagcggcgtcgtgaggttttcgttgggttttttttttatttaggtcggttttttttttttttttaggaatttttttttttggcggagtttcgggggtcgagtgtgcgtgtttttttaagaggtttcggggggcgtttcgcgggtcgttcggggttggagggggagggcgcgggcgggggcggttggcgttaggcggtcgaggttttataataaagtttcggtttttgttatttcgtatcggttaggtttcgtagataggcgggggacgcgcgttcggtcgtttttttttttcgtaggcggttttcggttagggcgtcgggcgggtttgggttggtggcgcgcggtttgtgcgtttcgcgtttttcgtaatagtgaaatggggcgggagcggggacggtttgggtcgggtggggtcgcggttttgagtttggcgtggttgttttttcgtttttcggtttcgttatttttcgtagggttaaggggtattgttgggatttttttcgggttgagtttttaggtggtagggggttttcgtcgtttttttttttgtgtgtagggtcggggttgcgtgatttcgcgggtagtgggtagtaggaagttcgggttgtgcggtcgcgtggtagagcggacgacggatttgcgttcgagtgacggggcgcgggttgtagattggtttaagttttcggtggtagacgaatgtgtttaggttaagtttaggggacgtgtgtggtttcgtgttatgggttcgttgtgagggtgtcgttaggtcgtcgattattgtttggacgtgaggagtgtggtggtgaaggatattttttggatagagtcgttttttattacggttttttcgtcggatcgtatttttcggagttttggcgttagttagttcggtttagcggtcggatcgggttttttcgcggttttaggtttggttggggtgggggtcgcggtttcggtgattttagttcgtagcggttcggttcgtttcgtttatttaaataaattgtcgttgataggcgcgtagtttttttggagtcgtcgttttttcgtcgtttttttttcgttttaattatttcgcgtagggtggggttaattggttgggatggggcgggggacgcggggagagcgggcggttcgatttttttttggtcgcggggtggttcggggaagcgttttcgtagttacggtttgtgtggtttcgtttttggttttttcgggggatgcgagggtaaggtttagtttggtagttgtgggttttggaagggcgtcgttttgtatttaagggcgagattacgcggtcgagaattaaggtcgtatttcggatggatttcgggtgattttttcggagttttggggaattttttaattcggggagttgtagacgatttattggtttcgggtcgcggtttcgcgggtggtcgttgtacgtttgagatatttggttcgtagaagttaggtgtacgtttgtgtatcgtcgtgcgttggatgtgtatggaggcgagatcgtggttatggatgtttgggattacgggagcgtgaacggggcgatcgattgagtgatttgagagacggggtagagcgtaggaaggatttttaggacgggtttatttgcgacgggcggcggtgggggagtggggggtttgtcggcgcgtttataggttttgggttcgcgttcggaaacgttttcgtagggagcgggtcgggatttttcggagtagtacggtgacggcgtgttataattcgggttttagttgtgtcgttttcgt

SEQ ID NO: 7124 - DNA, 2392 bp, synthetic construct
  misc_feature 1..2392: note = Description of Artificial Sequence: Synthetic polynucleotide
  source 1..2392: mol_type = other DNA
cgaggcgtatttgtttcgagtgttaggtttggggacgcggtttcggagaggggagaggggttcgggaatgcggcgggaggggtttcgaggggtagcgggtcgggtcgggtcggggcggaggtggcgggtttcggcggggcgggttttcgcgggcggcggtgagagttttcgtatagtcggttgcgagttttgggagtaggaggcgcggtgcgtagtttagttcgggacggagtcgggcgtcgtgcgagtttcgggagggtcgcggggcgtaggggcgggtcggggttagcggattaggtcgcgttattcgttttcgttttcgttttgtcgcgttcgggtttcggcgttcgcggagttgagattgagcgcgttagtttttcggggtcgaggttttgggatagatatcgcgagggaggcggtcggcgcgggttttcgtcgcgggcgtagcgtttttttttttcggtaagtggcgagcggcgggcgaggggtattaatttcgtcgttaatttggggttgggttttcgcggcgcgcgagtaaggacggcggagatagaggcgggatattcggggggttggatttacgtaggattttcggggtttaaggagggggcggttggaggattcggatttttaagaatttggttttgggttttgattcgggcggtcggagagaaggcgaagaagaggtcgagtagataggcgcgcggcggacgcgagagaaggacgcgggcgaagcgtttaagacgttcgtttttagggtcgtcgagttttttttttttttcgtttggcgcggtagtatcgcgggattaggggagtttgggttgtcgcggatttaaattgttgttgttggaagtcgtcggggcggagagcggggaatagggtcgggagtgggggtcggggttgggatttattagagcgaggggttggaaaggagtcgagaaggtgaaagggggttgtgcggttttttagtttagtgttttagtttttttaggtttgttgggtatttgttgcgtattcgtttcggcgtttagattttttttttcgtcgcgagtttcgttttttttttttttagttttgttttattttttttgttttagtttagtttttttttttttgcgatttgggagaatcggagtgggtttttagagtagtggtattttgtagatgttggttcgtgttcggttttcgggtttttagagcgtaaagggaagggtaggtagagagggtattgggcgagtaagatttggcgttgggttttggttgcgtattagtcgtttgcgtcggtttttgggggtttcgtttaggattttcgacggcggggaggggaagtttcgagttttttgttttttgtttacgcgggtagggcggggatacgcggagtaaaggtattcggtaatttgaatttttaggtgcgtttcgcgattttgtaaggagttgttgggtgagtaagacgggaattttcgttaggttttgatgtttattttattcgtttattcggttttttagttttggtcgtttaaggggatttttggttcggttttttagttttcggatggtggcgttattttagtttagtttttgatttcgggttataggaaaatcgaggaaagatatttatttggggagggtattatttcgttggttgtattttagagttcgtttaggttttggcggtgttagtgattttgagtttgtttttaaattttcgaagaataagagcgtgttaggggtaggtaggtaggttcgggatatttgggttcgtttagggttttcgggcgggtttgggatggtattggggtcgtttgttaggttggtttggtttttttattgcgggattcggggttacgatttagtttgggggagtgggggtgggggtttcggagtcgcggacgtcggcggggggtagcgtggggcggggggcgtcgggtgcgtggtgtttagtttggtcgttaggaggcgtggcgcgggttttcgttcggagtcgtcgtcgtcgtcgtcgtcgtcgtatcgcgagtgtttttgagtcgcgggtgacggtggttttcgttgttcgcgtttttttttttcgcggggggagtttgatgttacgttttttatgaattatttatcgtcggtttaaaaatatttcgaattttatagttcgagtgtaagagattgttgcggaggggagggggcggggcgtttcggtggttagggggagttcgggcggggttcgcggagacgggggtcgtagttttggaggagtaagaatttcgtgtttttagtagtggggtaagttagaacggcggtttttttttttggcgtttgggttcgggttttggttgggtaaaagggagggagggaaattcgacggtaaaggaggggcggtttatcggaagggtagggggttcgg

SEQ ID NO: 7125 - DNA, 564 bp, synthetic construct
  misc_feature 1..564: note = Description of Artificial Sequence: Synthetic polynucleotide
  source 1..564: mol_type = other DNA
cgtttttaaatcgtttatttgcgacggtttcgcgagcgtgcgtagtttagtttttttcggacgttttcgttttcgttcgggtatatcgtgtttcgtatcgaggtagagaggggtacgcggattttagtttttgcgagtttttttgttcgtcgttattttatatttcgtattgttttagttgtcgttttagaagatgtatcgtttggcgcgtaaagcggtgtacggtttttagttcgcgcgtagtagtttggaggggcgttagagttttcgttttattttttggcggtattgttttcgggtagttttttttttttttttttttttttatgtttttattttattttgggacgtttttaggatcgaagaggtaggagggggatcgcgaggggaaggcgcggagttggggaaggaggagtagcgtcgggcgtagtagtttagggcggttcgggaggttgcgcggcgttcgcggatttacgttttaggatagaggacgtagtttcgagtatcgtacgtggtttttagattttttttatttttattttggcgattacgagagggggtcgg

SEQ ID NO: 7126 - DNA, 3277 bp, synthetic construct
  misc_feature 1..3277: note = Description of Artificial Sequence: Synthetic polynucleotide
  source 1..3277: mol_type = other DNA
cgcggtatggtggttttcgcgtgtgtgtgtagcgtttgtaggtgtttcgtttagcgttttttgtataatagttgtaggttggattcgagggtttttttttttggggttttatagtgtttagaggtttcgttagttttagatatcgttttaggtttttttttttttttgacgtcgtttattttttttttttgcggaagggggatacgtttttttgtgtcgaggtgttaggtcgttgagatttgttgttttggaggaaaagttaggtagggtttttggttttgggcggttaggaaggttttacggttgttggggatagagacgcggggttaggttaagggttttcgtttcgtttaaatagtttgttttgggtagggtagggtttttttttcgcgttcgcgcgttttcggttgggtacggttcggttttaggtttgacgggcgcggtttttttattggacgcgtgcgggagggcggcgaggttaaagcgttggggttaggagggtattcgtttagcggttttttacgggagttggggtagaagacgtcgcgatttcgcgcgggtaatttttttcgaggcgcgttttagttcgtggcgttgtcggcgtagatttcgcgtggggatcggcgaggttaattttttttgcggttcggggtcggtagagtacgtaaggggtcgcgggtcgcgtgggtttgggcgcgtcgtggtgggtaagcggggttagcggagcgggaattcgtatatttttcgagcggagtcgaggataggttcgtgcgggtcgcggggtttttttggcgttaggaagcggcggtcgaaggagataacgagaacgtagtttcggtttagggaggtttaaaagttgagatgttgaacgtagacggcgggcgttcgggggttggggggcgggtagaggtcgttattttttaaaaaggtttttatcgagtcggtttttgttttcgttcgaggggcggacgttcgatttcggtattcgggattgttcgtgggtttttgttggttggggatttttagttttcggttgcgcgtagggaaaggttgtagaacgtagagattagagaagtcgggggcggcggggaggggtcggggggttacggttgtagttcggtttcgtagtttcggagttttagtttttttttttgtattacgggagcgtggacggagggattttcgaggttttgatcgttttgatagtttcggggcggggcggggcggggcggttgcgttagttttggttttgagtttttagttcggcgtcggaattcggatcgcgatttcgggagtcgagtttcgcggtttagatgaaggcgcgagtgcgcgggtgtcgggtggggtgtttgagcgagagcggagttttttaggtggacgtttttagttattttcgggattttttttgttggtttttgggtttgagaagtgggcgcggttggatagacgggaaatagttttttacgtataggtggatattcggggatatcgggcgcgcgcggcgtttggtaaggggaagttgttggagacgcgggcggttgttttcgcggggttttttttcgaagcgtcgttgcgaacgtttagtttcggcgacgtcgtttgttcgcgatcgggtcggcgtcgcggataggaaaggttcgattagttaggtttgttttcgagaagtttttagcgtttcgttcgtacggggtggggattgatagtttttcggggacggggtcgggtttatagagttcgggagttgggggaggggaggcgtcgggggtttcgattcgtgggaagtttttgtatttaggttgttcggcggttttttaatagtatacggatatttaagaaacgcggggcggttcggtgattttcgttttggatttagtggcgtcgcgaggttttatttcgagtcgttgattatcgggtattcgggtgttgacgatttgggtttttgggtatttagttcggttttaaacgatttcggtttaagggtgtttagtgtagttaggagggtcgaatcgaattttatttttcggacgcggtggtttttcgttcgtttggagtttcgtcggaggttcggggatattacgtaggtggtttattttcgagttcggggtcggagttcgatttttttttttttgagttttcggagttttcggggtagtagcgtcggtttaggcgggggcgggggaggagggggtcgcggtagtttttagaagggcgggggggacgcgagcggaggtagtttcggtggcgcgttcgtgagattttcgtcgcgtcgcgggttcgggtcgcggataattaaagcgggatttttttttcgttgacgtcggcggttcgaggtttttttcgcggcggtataaaaggcgcgggtttcgtagcgtaggcggtagtgggggtttgatagcgcggcggtgtggatcgcgcggtcgaagagcgcggcgtttagagcgcgggtcgttcgcggagttatagttcgagtcgggttttagtcggagtcgagttttagtcgagtcgagtcgggttcggagcgttcggtgttcgtagttatgtcggtcggtcgcgtcgcgcgtatttgtgcgttgttcgttttttgttttttgggcgtcggggtttaggatttcgggtcgacgcgttttatttgtatttcggtgttcgtggacgtcgatatgtgcgtcgcgttcgtggtcgtcggcggcgtcgaggagtttcggagtagcgtgttgtagtttcgcgagacggtgttgtagtagaaggagattattttgagttagaaggagattattcgcgagttgatcgttaagttgggtcgttgcgagagttagagtacgttggatttcggagtcggcgaggttcgggcgggcggcggtcgtaagtagttcggttcgggtaagaatattatgggcgatttgtttcggatatcggtcgtcgagacgtttagttaattcgggtaaattttgtaatcgtttaaaattcgtttggagaatttcgaggttcgcgcgcgttttcggtttcggtttttttttcggttcgttcgtttttttgtttttttttatttcgttttttattcggttaggtatttttcgttttcgttttagtcgcgcgggtgttcggtcggtgttttttcgcgtttgcgaggtttcgcggcggttattcgttttagttttttgttaggtcgttttcgtagtcgtttagaggggatcgcgtcgcgggttttttagtacggttttcgcgtttcgtttaacggtgtggtttttttcgtttttgtatttcgtagtagtatagtcgt

SEQ ID NO: 7127 - DNA, 5692 bp, synthetic construct
  misc_feature 1..5692: note = Description of Artificial Sequence: Synthetic polynucleotide
  source 1..5692: mol_type = other DNA
cggacgttaattttacgaattttgttcgggttgggggtttgggacgttttttttggattttaggattcgtttgtacggagttatagaatatagcgttatcgttcgttcgagtttaggtattttttttttttttcggggtttgcgtcgtttgtacgttttttcgtagattttcgcggaaacgtgtatagtagggttttgaatagaatttaggttgttttgagtcgaatttttttcggttcggggttgatcgtgtttatttaagtcgtcgtttcgtttttcgtattttcgacgcggggttatttttttttatttttttttttatttaggcgtttttttcgatagcggagggagagttaaaaatttataattcggcggcgggattttgtcggttttagttgggcgatttgggcgtattcgtcggcgacgtagtttcgggttttagcgtatagaattcggtcgttcgtagtttttttcgttagttacgttttttgggttttttattggttaagtcgttcgcgttttcgcgtgattttattggtttgcgtcgggggtttagataaagggagtagtcgcggagggcggtgattgggcggggttgggggcgggtcgggcgggcgcgcgggtcgggcgggagtcgcgcgttggagaggcggggagtacggcgttgggggaggggcgcggtgtttcgggttcgggatcgggaggcgcgggtgtgcggcgaggttcgggtgttttttttcgtgggggcggggcggcgggggcggggcggttttacgtgggtggggttgggcgtttcggagggcggcggtcgcggggcgcggggcgttgggatttcgttcgttttttcgttttgtatttttttcgtttcggggtttttgttcggacggcggtcgtcgtcgtttcgtttttttcgagggtttcgcgttcgttttcgtagttcggtcgggaatttgggaattcggacgtagaaggacgcgttcgagttaggattcgtcgcggggtttttttggtgggtcgtggtcggggagaggacgcgggttttggcggtcgaagacggacgtagcgttcggaaaggcgagttaggttttcggtttttggcgttttttgtgagttggttcggcggggtgcgtcgtcggggagggagggattggtcgtggggcgagtagtcgggcggggagtggtttttgggggttttcgttagcggagggttcgcgaggtcgttttcggagcgtcgttaggtacgtgcgttttttttgtttttcgcgtttttagagcgtattttcggtagggaacgaataaaatttcggttggtgtgtaagagtttttcgttgtaaacgtgtttttttgcgggattcggggagtcgtcgaacgcggggtagatttcggtttaaagtgtttttgtagtttttattagggatttttttttatttttattttgggttcggagcgggtgttagtttggaaatgtttgttttttttgtagtttcgattgaattcgtttaggaggaggtgcgttttgtttcggttttagagttgggaggatcgggttttgtttttcgaagtttttttatttcgtttttttggaaaatgcggattttttttagtagggatgtttagttttgagggggttgttttcggaggaagtttgggttgggaaagttcgatattggttttaatttggcgggtagttttttttgttttggagtagttttttttagttttcggagtttcggatttatacggttaggagacgtttatgggttttgggggtattttgcggggttcgaggaggtcgggtggtttgggcggggttcgaggaggtcgggtggtttgagcggggttcgaggaggtcgggtggtttgagcggggttcgaggaggtcgggtggtttgagcgggttttttttttttttttatgtgtacgttaaataaaagaattttcgaatagttttggggatagaatttttcggaatgtgagtttgtttttttcgtttttttttttaggaaggataggggttttttaataaaggtaaggttgcggttggagcgggttgaagggaaggagcgttgttattttggggtatttgatgaaagagaaatttattttttttttttttttttaaaattagaggtagttgagttagagttttttttatttttttatttgattaatggggttttatacgatgtttgtatttggggtgattgggtttgaagatttttagaagtgggaaaggattttgtttgtgtgggagattggaaagttggtttttattcggtgggggatagaatttttatggagtgaaatggattttaggttattttgcggaagattggaaatttaaggatttgacgggggggcggtgattttgtgtttttttttttttttttttttttttttttagtttagaataaagggcggaggcgaaggaggtaagatgggtggtgggttcggaagtcggagtcgaaagaagaatgttataaaagttttttattttttagttttcgcgtatttttaaatagtttattagagtttgggtggggataaagtgaatgatcgtttagagtcgggtttggtatttatggttcggttttcggcgcgggcgttcggagttcgggggaagtttttttagttcgttttaagtcgcggttggttagggcgagagaggtcggggtatagcgcgcggttttttttgtcgttttcgaggatcgagattcggggttcgcggttttttgattgcgtaagttttttcgttttttttgtttttttttttttttcgtcgaaagacgttcggagcgtatattcgtttgtattaaagttagggattttattttttttaaaataaaataataagttataaaggtttttgattttagtggaaaaggcgtcgtagatttatggtttttttaaatttttatattttaattatttttgtttttagtttatttatgggtggtgattaataaaatgattttttattttgaattttttttttaatataaaaaatgtaagtttcgttttttttttattcgtttggatggatttttttcgtgcgggaagtaaagaaatttcgtttttttcggttttatcggtttagggttgagttgttgttttcggttgagcgaattcggtttgtcgtagtattttttaagtattttcgtttcgtatatttttaattgtaatttaagggagaatatttttttcgtttttttttcgtttaagggtatttgtagggatttttttttagaagttttgtcgtgggtttagcggttagaagggttatttcgtagagcgggttttcgatagttttagttcggttattttttaaattgcgtttttttgggtttcgtattgggcgcgagtttggggcgtttaagggtttttattgaggaggaaggttgtcggatcgagttttcgttatcgtttggcgtttttattttttatttttttttttttgttcgttttttcggacgtcgatttggagatggtaggaaaaaaaaaataattagatggaaattaaagattagtttgggtgcgcgggcggttttcgtcgggtcgggttatgttcggttcgcgttttataaatttttttcgcgacgtgataatagtcgcggtttcgtttttttgggaatttaggaacgtatcgatttttttcgtcgttcgcgtaagtttttttttcgggagcgagaacggagagtttttggtgattttgatttttggttagcgtaggacgttttaggttttagttagggtattatgtataggagtggaggaaggtggaagggaaggggtttaatttttatttaagaaagcgtagtaaatatttatatttcgtaggttaaattaaatatattattaggggtcgtattttttttttttcgcgtcgtttgagaagggggcggaaggaaggacggagaagggtgaggggcggattaatttttttttggcgatttttttgtttggttcggatattgttgagtcgagtggggcgtttaggagttagcgaggggttttcgaggcggtttcggttcggtttaggtgtgcgggtcgcggtggggcgtaggttcgtagcggagttacgagattttcgcgttttcggttgacgttcgggcgtttagggtttgcggttttacgtgcgatttattcgggagttgcgttttagacgtttcgtggagcgggggagaatttgaaggaagtcgtggcgcgtttagatattttaaaaattcgaattaattgggaaaataggaagggcgtttttaaacgcggagaagatatttcggggtggggaaggatgttttttaaaaattatatttttttgttgtggcggttgtttttgattttttttattattaaaagaaatgttgttacgtttaatttttgttgttatgagatatggagggggtagtttagtattttgaagtaatttgataagtttttaagtagtaaattcgaaagggaggtcggcggtttaggtatagtttttttgtaatttgaatttataatgaaagtatttttttttatggatataatagattagattttataatttaatttatcggaatggtttcgtttaagggagtttcggttgattttattacgttaagttaaattggatgtttgtggttttaacgaaaagcgatcgtgatataaaatatataatttttaaagtaaaaaattagcgggttggattttgtttttttttttatttttgttttttatttttaattttttagtgtgggaaatacggataattatttgtgtgtgttggtttttatcggggagataggcgttttgggtttttttttcggcgggttagaggtttcgtcggttagtgcgtacgcggcgtcggttttcgattaaggtttcggttcgttttgttggttcgtttgaaacgtcgatatttttagcgtacgattcggggtttcgggggtatttatggggttcgaagtttttgtttgtcggcggcgatcggatagttttttcgggcgcgtagggtagaggaagcgttttcgaaagttttcgtacgtatttacgagtcggttttgcgcgggtatagcggtagtcgcggcgggatattcggtagggttttcggcgttattttgtgttaaaaattgcgttttcggagattcgggtatcgtcggcgtcggtagttagagcgggatttagtttttatcgcgttttttattggagtttttttcggtttttcggcgagtgcggttcgtggggagtgggcgtcggcgcgaggaagtttttcggttcgggcgatttcggtttttgagcggtttttttttacgtcgtcgttcgttaggtcgacggaggatcggggcggggacgggggttttagcggtttattttgttgttatttttgatttattttttagtaacggcgcgtttttttttcggttttttcgcgaggtttgttgaagacggatttagttttcgtagagttggggaaggacggatggacggaaggtttagcgcggtttatttttttttttcgtcgtttttcggttggtaggagtcgtagcgatagtttcggggagcggggtttgttttaagatttttttcgcggtatcgggagttaggcgtggtcggaggtatcgcggttgttttacgtggttttcgtcggtcgttatttcgcgcggggaggacgcgtgcgtgcggtgcgtggtcggcgggttgcggggacgcgt

SEQ ID NO: 7128 - DNA, 7937 bp, synthetic construct
  misc_feature 1..7937: note = Description of Artificial Sequence: Synthetic polynucleotide
  source 1..7937: mol_type = other DNA
cggcgggtttttagcgtagttttgcgcgtttttttcgaatttattcgcgtcgtttggtgatttttagggttttaggcgtggtagttgtttttattttgatttttttcgatatttatattaaagttatcgggaagagggttgttttggaggtttgggttcgttttgttaaggattgattttttcgggtagggagttagaggggatcgttcgagaggattcgtttttgcgaggtttagtacggcgttttacgttttttttttggagtaaattcgtttcgttttttttttggagtaaattcgtcgtattttcgtttgtatcgaaattttgagcgtcgtttcgcgttatttttagttcgcgttcgcgttgttttttttttcgggtcgtaggttgagaggttgggtcgtattttggttacgttttgttcggttttagcgggatattagaggtattcgttaaggtaaatgtatttttgtaaatttattttcgttttgatattttaaggttttatatagaaataggatttgttcgttttatattagtagtttttattaacgttcgttcggcgtatatattattttaattcgcgaggtcgcggcgtattttggtttttttttttcgttataatagtcgttttgttttcgtagaaagcgtttcgttgttttagtttcggaacgttttagggaggtgaatgtagaatgtagaaaagaggttttcgtggaatttagatttgtaggagggggcgggggagggtggcgaggcgcggaaaggttttaattttagtcggtttcggggttgttttttcgagattttcgggggagggtggttagggaagggtttttttaagtcgcggcgacgtagtttggggggttggcgggacgcgcggtttcgtttagcgtttaggtagttatcgcggtcggggtcgggaaatgaaattaaagtttttttgttttcgggagcggaggggtgggcgttttgtttcgttttcgaacgttttcgtttcgcgttcgtttcggtcgagtattgatttgtgtgcgaagttatgggtaacggcgacgggaagtattttttcggttggaagtgtgcggggggttgcgcggcgggtttagtcggggcgagacgcgcggcggtagcggcgttgcggtggtttaggttttcgcgtttcgatagtagatgcggcggcggcgtaaagtcgcggttatttatgtcgggtttcggtttcggttcgtcgtcgttttttcggagtagcgcggtcggggttcgggggcggttcggcgcgcgggcggcgtagaggcggcggcgttcggggttataggcggtggtggcggcggggtcggttagtacgcgggaggattgggtttttcggcgggcggtcgcgtatcgagttagcggtcgttgtgcgggtttatggtttgtggaggtaaaagtagaggagatacgggtgattggggggttcggttcgttcgggggttttcgtttcgttcgtttatttattttttttattttttattttcgtcggttcgagcgagcggcggttaggtcgggtggcggggtcggggcgttcggtgttttttcgtcgtacgcgcgcgtagtttagtattcggggtttcgcgcgcgtacgtatcgtttcggttacgtttggttcggggtagtcgggggaatttagtcgtattgttcgtcgtttttcgttttcgttttcgcgggtttttgtagttagggcgtcgcggcgaagaggttgttggttttgttgggtgataaaaatttaaatttgcgaagttattacgtatattcgtatatatatatatatatatatatatttatacgtatatttttttttttttttcgttgtttaaaggtgtttcggaggaaaaggtttggggtttatattagttttttttttttttttattttatgtcgaggtttagtttttattgtatttcgtttaatcgaataattatgttaattaagcgagtaattttattgattgtaatttaagagttttttttttttttaataattttttttttttttttatttttattttttttatgtatttttcggtttatttttttgaatttatcgtggttttttttttttagttttagcgggattagtttttgtttttagtatcgcgttaggattttaggtcggttttttagagtttcggaggttcgtaatcgttatcggtattatttgggtcgttacgtcgtagtgttcggtttgttgtttcggagtcgggagttttttgttgaggttgtaataattatttcgttttttaattaaattcgtttaggatttttttttgcggattgggggtttgggggtgtgtgtggggggggtgtttttagagttagaatgtttttttttaacggtttaaatcggttttgggatttttttttttagcgtttgtcggggatcgcgagtagaggtcggttttcgtttcgggtagtatcgggcggtttgggtacgcggggtttgcggcgtttagttcggttttttagtcggggaaggtgggttcggtttagtataattttttgttagtagattttgttcggatttcggttatttaaaataatttttatttttatttttttttatttttatttaacgcggagtatttatttaggcgaaattggggataattttagattttgggtgcggagggtcggagttagtgatagaagttgcgtgtattatcgtgtttttaggcgttttttcgaaggcgttttttggacgtattttatatattattttttattttttaaatacgtattgttttaatgtttattatttttaataaaagggagatggataggtttgatatttttaattaggaattttgcggaaaattttgtgtttttgtagttattttattatgataataaagcgattaagatgttttttatttattgaatatttttttaaattgcgatattttatggttcgggttttaaaacgttttatttgtagattattttgtgtttgatttaatttataatcgaaaatataatgtattaagtgaatatatatttgtttagttgataagtttttttaatatttattcggagagtttttgtattgtaaataaatgggtttatataaagagttttttttgtttggtaattatatataaaggcgtttggggtttttttttttttggggatcgttagtttttttttcgggtttaataaatagttcggtttttaagtttcgatttcggtttgtaaagcgagcgttcggtcgttagggttcggagagtgttttggcgagggggttgcgagcgtaggggttaggggaggggttgttcgggttggattagggacgtgggggtttttagtttcggtcggcgtttttcgagtttcggagggcgtcgggcgggataaagggaaagaaggaaagggagggaggttagaaatttgtagttttaaaggcgtcgaaggtcggagaggggtcgggggttgcgtacgcgggggtgttaggttttttggcggtttttagggagtcgtgtgtgttgtgtttttgttttgtggttgtttttttttttttttttttttttaataagaaattttaaagttgagaaagcgcgagttgtcggcgattttcgggacgcgggttcggttacgaagtaataattttaattttttattttttgcgggcggatcgtaggttcgattgttttttttttattagtttgttcgattttttaagtaaataggaggtggattattgtcgtttgtttgcgtcgttacggttttgatcggattggagagagtttttttttgtgtttttttttttcggggagaggtcgcgtcgcgttttcgcgtttgttcgcgtcgggtttcgggggtttggggagtttgaggcggttaggaagtggggcgaggaagggcggttatacggttcgagttgggagttttatagtttcgtagcggcgacgtcgttattcgtcgagtgtcgaggttcggggtttatttttagtttagttttaggagaggtcgcgtcggaggatcgcgaggacggcgtcgtagcgttaggtcgggttgaggtaagggaggaaatggagcgaaaagtggcggcgggtagagggtttcgggcgggcggagaatcgttgacgagggtatttcggaaggaattgaatttaggagtatagggttttttttcgggaaggtagggcgtgattttggagtcgtcggttttttttgtcgcggttttaggcgtggttggcgcgttttaggatttggagtttttataagtttgttttgttttttgtttttgtatttaaaaattcgtttttttttcgttcgtttgtcggagattaggattttggttcgtttgttttttttcggcgtcgttttcgggagcgcgggcgcggtggggtttgtaggtcgggttgggattaggcgcgttttggggcgcgagtggttcggtcgtcgtcgtagaattcgttttttgcgaaatagtcgtattcgttttttgggagagttatgagaattggggtcgcgtttgattttcgcgttcgaagaaaattagttcgcggatttcgttatacgggtcgtgattcgagtttcgcgcgtcgtttcgaacgcgcgcggtgaaaacgtttcgttgcgtcggttttgttcggttttttttttttatttttattttttcggaaaaaaaaaattttgaattgggaacgaagattcgaaaaattcgttatgattattttttttttcggtttttagtttcggttcggaaggttttttagggtagcggtcgtgggtattacgattcggttagtttttttcgtcgcggatcgatcgggtagggttaatttaggattgtttcggggaggggagtagggtaggggagcgaatgttggggttcgttcgtgggttatttagaattgggcgtacgttggcggcgttcggatttcgtttattgttcgttcggtgttattcgcgcggttcgcgttagacgtagtttggcggtttttgttttgttttcgagtatttgtttttaatgttgggtgtcgatcgagataataagcgtttagagtaaagtaaggatgtattacgggggtaattttaaatcgatcgataagattttttagagaaaaaaaaatcgtttatagtttatattttttaagaaaaaaaaaagttttaatattttaacggattttgttaaaagggaagatatatattttttaatattataattttgaattttttttgttaaaaaaaatgtaaaattttaaagttagaataaaaaataaaataataataaaaatataaaaataaaaaaaaaatgaaagtaattttagttatttattggaggttgttttttggatataattgaatgtaatataattaaattagtaaatgtgattttgttttgtatttttattggtatttttaatgtgttgattgttgtattgtaaatgtatcgtttttataataacgattttagcgagtttatttagagcggtttttaaatttgtagtttggcgcggcgagttacgggttttgtatattaataagttcgtgttatttagttcggaatagttagcgcgttgattggtcgcgtagttttttacggtcgggagttcgtgttatttattcggcgtaaataggttttttaataggttggcgtcgggttagggaattgttaattaggaagtagcggggttattattaagttcgatggcgtttaatttaagttcggcgattgcgtagtttttttgcgtagattattgttgttgaatgggaatgtggtggcgtagggcgggagagggagttggagcgagcgagtgcgcgtgtttcggcggagggggaggcgtagatatagatatagatatatatatatatatatatgtttaatttagtaggtttaacgtttggtttttgtcgtatagaaggttaagggaagaaatattattattttttaaaagtagttgttttttttttttggaatttgtttggtaggtggtaggtaggttagatttttaagtttagaggtttttttaggttgtttggtttatttatcgttttgaagttgttgtttgttcggattcgagttcgcggatgtacgtacgtacgttcgttgtttgggtagtaaaagttttgaatagttcgttcggtttttttttttttatgatttggggattagattttgggaagtgagttttgagtttttagtcgtttatattattggtttttaattttatttttttttgttatattttgtaatagagtagttattaaaatgaaaattagggatttattgagaagataaggattgttttttttttatttatatttagatttagaaaatatttttagtttggtaatgggggaagcgggtatggtgtggtaaattatgtatagtattttttaatgttgttttttgtttgtttatttgttaaatttttattttaattaaagtaagttattgaataatttttatcgtaattagatgtaaattatttttaaaatatttcgtaaataaatatttttgttagaatttggttttttatttaaatgttatttatttttagggagtcgaggtgatgttttagtggcgatggatatatttatttttgtttttttttttttatgtgaatttttgtttttttttttgggggaaaaaaggatatttaaattaggagttaattgatagatttatacgtattcgaaattttttatcgttttatttcggtagggatacgaaagagttaaatttaaagtttgttgtttttttgttttttcgtttttattttcgttttcgcgggatcgttgggattggttggtatttcgttagtggattgtttattatcgagtgtaaataaggcgttgattggttgttgtttagttcgtattgggttttttgaaaaaagtaattattggtttcgcggttttaaggcggtttaaggtcgtttgatgaaaggagataagttggggatcgtttttaggattttcgcgggtcgatcggggtagttcgggagtcgaggtgcggcggagagttcgcggattaaaggaatttggagagaaaggggaagcgggcggtcggtttcggtcggttttttttttcgtaggttacgtcgatttggggtggggggttgcgggtcgcgggcggggatttcgggatttttcgtttgtttgagtcggggtttacgtcggcgttcgtttcgggcggttcggttcggaggggagtttcggagagttcggggttcgtaggtaagtatcggcgtttcgcgggtcgggtcggggacgtaggataaggcgcggggtttatttcggttggttcgggagtggcggtcgcgcgggttcggttttcgttttcggcgtttttcggtttcggcggtcgggatttttcgcggtcgagtttttggttaggttttaggtcggcgttttcggaagcgacgtttggcgggtcgcggggtacgagggggagagtcgggaagcgtaaattttcgaagcgcgcggagattcgattagcgcgcggttatttattaggttgggggcgattgaattaggtttttgggcgcggtcgtcggttgggggtgtgtggcgtcgattttcgggtttttgtcgtggtttcgggaggttggagtagcgagtagcggttttagcgagtgtgtcggggaagcgggtgttttcgggtttcggtttcgcgggtgtaggcggaggttgttcgtttttcgcgtatatcgaggacggtcggttcggtttcggagaaatggcgtttgagaaaggaggggaggggaaggttttcggattttgggtagggattcgtcgtcggggattcgcggagtttttcggggatggaggaggcgcgagttggaagcggcgcgcgagttcgagcgcggggttaatatcgtggggtttagttttttttggttcgggtaagtggacgcgtttcgaggtttcgggtttacgtagggcgtttttcgtagacggcgt

SEQ ID NO: 7129 - DNA, 1408 bp, synthetic construct
  misc_feature 1..1408: note = Description of Artificial Sequence: Synthetic polynucleotide
  source 1..1408: mol_type = other DNA
cgcgcgcggtagtttcgaggtagtagagcgcggagtcgggagcgcggggagcgcgggtcggcggcggcgagggaggacgggggcgtagacggtcggcgcgcggcgcggttattatgggcgtgcggtgagtagtcgttcgggacgattttttcggttgcgcggcgttcgcgcggagtttttcggtcggcggtgcgtttttacggttattatgaaaggtagggcggcggtagtttcgcggggttttgggcggggggaacgggtttcggggcgcgcgggaggttacggaggtgtttttcgcgcgaatttttttttgggttgcgggttcggggagtcggggttgttagggcgtcgggttcgtgcgcggatattgggggcgtattcggttttcgggttaggcgcggttggagatttcgaggttggggttttgaagcgcgtaagtatttttttttttatcgcgtttttgtaagtagtttgaagttttaagtcgttgtttacggattttcgtttttaattttttaattgaaaaaatttgtcgaggagagtggaggtatcgttatttttttcggtcgtttttttacgtcgtagcgttttttacgttcgtttagtttttttttttttcgtttttagtcgtttttcggttcgagcggttttcgcgttggcggtcgggtgtttttttcgggattggggatgtttttcgtgcgttttcgttatatttggtaatgattaggtgttcgaggagtttagttggttcgggaagtgtatttggtatttttttttattagatttatcgattggaaaatagttgttttcggtttcgcgttttttttacgtgttcgttttggggtgtgtttattggtgttttggggtgatatattttagttggttagtcgttttttgcgcggtgttttttgtaggtcggtttatggaagtgttagatgttatcgtattttagaaagaagtacgagaaggattgtagggtagttttttgtttagtggaaatacggagatttgttagcggaattttgatttatgtatgagataagtaatcgtagcggaggtattaaagagtcgtttaggaatgggttcgcgtggtgtttatataaggtttcgtgtgagagttgttggttttgtgttaggataatatagttttgcgtgggtgcgaaatgttatttgatcgcggttatttcgtttttagtcgttatagatttggcgatgtaatcgttttgatttttagggttgtcgttcgagggaggcgttcgggaagttttaaggcgtttggaaagtaatttttggttttggaaagttttttttttgaagggtagttttcgcggaattaatcggagcgatgatattttattaatttattttttttttaagggcgttaggtgtttacgtcgggagatttcgg

SEQ ID NO: 7130 - DNA, 208 bp, synthetic construct
  misc_feature 1..208: note = Description of Artificial Sequence: Synthetic polynucleotide
  source 1..208: mol_type = other DNA
cgttttcggggtcgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcgtcggatttttttttttttttttttacgttcgt

SEQ ID NO: 7131 - DNA, 805 bp, synthetic construct
  misc_feature 1..805: note = Description of Artificial Sequence: Synthetic polynucleotide
  source 1..805: mol_type = other DNA
cgtcgttcgcggagtttgattttgcgttaggacggaggaggttgtgtttatgtaattgttttgaagtattgcggtggttttttttttcgcggttgggagggtaggtaggacgaggttggtttttttcgtacggtttttgggcgtgggttttcgtcgtagtttcgcggagtttcggtgttttttgtaatagggggcggggggaatagcggcgagtagttttgggttgcggttttttttttacgttcgagttttttgcgtatcgtcgtcgaggacgcgcgttcgagtttagtttttacgtcgcggcgcgttcgggttttttgttgattttaggtaattttttcgtttttcggagtgggggattgcgagggggtttcggttttacgaggtgcggaggaagagttcgaggtttggggcgaggcgcgcgggatagtggggttgacgcgtggtttcggcgtcgcgcggtttttcgaatttcgagtttcgcgttcggcgcggtcggggtttttaatcgttttttcgttcgtcgggatttttatcgggtcgagtttgcgcgtcgcgtttttcgttcgtttcgttcgttgcggcgtagtagtggttgggtcggcgcgtagagtttgagtttcggttttcggtttgggggtttttttgggatttttggtcgaaggggcgattcggttttcgcgtttttttttcgttaatttgtataaatttttcgttcggggcgttatgttttaagttgtttttcgggttgggggcgagcgcgggtcggtttttttttcggggaggtgcgggggatagggggcga

SEQ ID NO: 7132 - DNA, 2462 bp, synthetic construct
  misc_feature 1..2462: note = Description of Artificial Sequence: Synthetic polynucleotide
  source 1..2462: mol_type = other DNA
cgagcgcgcggttgggaggcgggtttagggcggggtagagcgcggggatcgttcgggtatcgggcgtagttaacgagcggacggggagggcgggttcgcgagggttgagcggcgcgggttgttataggcgttcgaagcgcgttgtaggtggtaatttggaggtgtcgttatcgtagttgcgggaggagttcgggtttggcggttttttttagtttttaggagttttttttcgtcgtcgagttcgagattggatttcggagaattcgaaggaaagagtttttgcggagggatttgtgagtagttttatttttttttgtttttgcgttattttttttttttaaggaaggttgtgtttgcgggttgcgaataagtttcgggaggggttttaaaggaaggtttcggtgatttaggtgagcgtttttttttttttggtagtcgggcgtaggtcgggagcgtcgtttagtttcgtgggtaggggcgcgggtgcgggtcgtttgtttttggttcgaggtcgatgggggagaaagcgaggaaggggcgaggttggttcgatcgggggttgtttggtcgggttcgttcggaggcgatagggatttttagacgggtatttggagattagggacgagtagagaggtgttttgagggggatagagggtttgcgttcggtttaagttgatcgggatcgatcgtttgcgcgttgtgttggagttgtcgcggaagtcgggcgcggcgtttttgcgaattttagagttagtgcgcggggttcggcgagcgtattagttttcggtttttcggagtttaaggttttggaggacgttattttttttcgttcgggtaatttttttttcgtttttttttgtttttattttttcgcgtcggtcgtttagtttatttcgagattttgtgtttttgttagcgcgcgttagttgttgttgttattttttttttcgttttcgtcggagttggagcgatttggggtttggtttttcggtttcggtagtttagttgtgggttggacgcgagtggggttggttagttttttgcgaggagggtaggagtgagcgcgggttttttttttagtgtttttttcgaattcgttttcgtttttttgtagttcgaatcgttagtttagagagcggagttttagaagttagattttgttcgttttggggaaacgcgggggaggggggggtttttcgggaaggtgcgaatttcgtagatgaggttagagttttcgtttttattttagcgttttagtttttgtttttttgtttttaagtggatagtggttttgattttcgtatttcggtttgtggcgtggggggcgttagcggtagtgtgtgtgtgtgtgtgtgtgtgtgtgtgtgtgtggtgtgtaaggatgagcgagtgcgatttttcgggaggtagaggcgtaggagttagtttttttagttcggcggagtcgtagggatcgttttttttcgtcgttagttgcgcgtagttgtatttcggtaatttcgcgttgtcggttttttttttttagttttagttttcggtatttttacgattaacgcggaattttaggattaaaattatttggttaaagggtgcgggtgggggatcgaggcgttttcgaggcgaatgaggttgttttttaaaattcgggaggcgtttttcgttcggcgttgtattttttcgtggttcggttgtaaggatttgcggtggaggtttggcggaggcgggttcgcgttttagagagagcgttacgttattcgagaaggcgacgttgggggttgttgagttttttaattttttttggcgcgttttgtttagaagtcggggagtttttggtcggcggttggcggggaagcgcggcgcgggaggtggggtggtttggttggtgttgcgggagggcgtttcgggcgcgttaggggttgcgtgtcgcggttggagggcgcgtcgggagttgcggcgggttcggggtattcgagtggcgttggaagttgagtcggggttcgtagggttcggtgatcgttttggcgtcgtcgttgcggattcgggagtagtaattacgcggcgcgttcggtcgttttttcggttcgtcggtcgcgtttttcgttttttttttgtagaagtgaagtcgtcgtttgggttcgttcgggttggcgatttttgcgttagaaaagtttgaggtgttggaggcgaaattttttcgggagcgaagggcggcgtttataagataaggaaagggaagacgtcgggttttggcgggtagcgtagtagcgggagggcggcgttgagcgttaaggatttcggaggcgaggcgaggttaggcggatttaatttagttaggaggtgttgttttcgtttttggggtttttttataggtatttggtgttagttatagattttcgttttcgttagttcgtaattttttcgtaattttttttgaagtgcgatggattaagattgggtcgcga

SEQ ID NO: 7133 - DNA, 990 bp, synthetic construct
  misc_feature 1..990: note = Description of Artificial Sequence: Synthetic polynucleotide
  source 1..990: mol_type = other DNA
cgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgttaacgtcgtcgtcgttattgagttttcggcgtattttagtttcgggcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcggcgggcgggcggtttttggcgtttatatattcgcgcgcgtatatatatattacgt

SEQ ID NO: 7134 - DNA, 2274 bp, synthetic construct
  misc_feature 1..2274: note = Description of Artificial Sequence: Synthetic polynucleotide
  source 1..2274: mol_type = other DNA
cgtgtcgggttcgtttttacgtcggattttcgatttcgatttatagatttttttcgtgaggggtttttttgggtttagaacgttttcgcgcgcgcgtgtaggtatatacgcgtatatatttatacgtttgttcgtatatcgttagtgttttttttttttatttgggattttcgggtagtcgggttggatgaataagttgtagttggtcgcggcgtttcgttagggggacgagggtggggagggggagtttagcggggcgtagggtcgtggttagggtttggggatttgttcgttttttttcgcggtcgttaagttttatcgttgggatcggcgaggaattttttttagttttttcgtagacgttgtacgatcgcggggatttttcggggtcgttagtcgcgtcgggtagggggcgatagggagggtagggtatcgggagatcgtcgtcgtcggagcggtcgttagttttcggcgatcgttgcgggcgtagtcgaatattagcggtttgggttcggtcgttgttcggggtcggcggggatcgcgtagcgtttacgttaggcggttcggcggttgtaattgggaattttaagtaaagttttttgttgttttttttgtagtcggttagggatttaagagtgtaagtcgtttaattttgagtattagtttaggtcgcggaaggacggcggtcgagttggtagtttcggttggggagttcgttttcggggttcgttcgtttcgttcgttcgaggattgggtgtttgttagttttacggtttttcgtttagcgttcggtttataggtagaagcggtgttcggttcgtcgcgtttttcgttcggtttcgacgttagttttagggttttattattagggagttgtcggcgtttcgggcgtttcgcgtcggttcgcgcgtttcgggggcggtagaggcggtttcgtttatttgagaacgtttcgttcgtcgtagttagtaaaagttcggttaaagtcgttaggtaagttttaagtttttttatggtgttgagtgcgggtcgggtcgtttttcggcggcggtgggtgggcgcgcgagggcggagggggtcgggagttttggtttcgaggtagcgaggagagacgggtaaatagtagagcgttaagttaagtttttaaagtgttaatagttgtagaagttcgaattttagcggttttaggggcgcgggtatagggttttgggttttttttttttgtttttggttttattcggcgtttggcgtcgttggtagagggagcggagggcgagttcgcggagttaaaattttttttcggtttcggttgttgagttcgtcgttttttttttttttttgttcgggattcgggattcgagttgttggtcgtggtcgtggcggtggtcgtggtcgtggtcgcgcgcgtttcgttcgtcgtttttttataggtagttttaagtttagtttcgggcggcggcgcgtcgatgatcgagttcgcgtcggttgcgcgcggggtttttgtttttcgattgattggcggtgtttcgtaggtcggttgaagggagcgtttacgttacggtcgttcggcgtcgtcgcggttcgttagagggcgtgagcgttcgtgtttcgtcggttcgcgttcgagcgttttcgggagttcggttgggggcggtttcgcggttatagttattatcgtcgtcgaagcgggcgttagtcgcgcggggaggagcggttatcgggtttttttcgtttattttttcgtttcggtcgcgttttttattttggtagttggttttggggagggtgattgtggaagaggttgcgtcgtcgttagaagtttgtttcgggttacgagtcgcgagtagtttgtgagcgcggtcgggcgggattagcggtttgcgatttcgcgggcgcggttaggcggtttcgagtttggcgtcggacggcgatgttatcgtatagggttagttgtattcggagtcgtcgggtttgcgttgttcggcggttgcgggaaaagcgagttaggagatcgttgaggtttcggagggttgcgagtttttttacgtcgcgggcggagcgaagttggcgggcgtcgggagatggcgcgggagtcgggagcgtcgagtttcgcgatcgttagttcgttttcggtcgggttcgtcgggtatacgtcgttggtttcgagtattggcgttcgggaagtagggcgcgtttttgttgttttgcgtttttattatgtttcggtgtttcgtgtgggttcgaagcgagtcgtaggtagtatacggaaggcgg

SEQ ID NO: 7135 - DNA, 882 bp, synthetic construct
  misc_feature 1..882: note = Description of Artificial Sequence: Synthetic polynucleotide
  source 1..882: mol_type = other DNA
cgaaggttgtggtcgcgttttcgtcggttagtttttagtagtagtttatcgtttttgtttcgcgttttcgttttaggttcgtacggttttagtttcgcggggattagtattgagtcggtttcgtcgtcgttttagtgacgggttgttgttgcgggaagttaatcgtttagcgtttggaggagggcgacgaggtttttcgcgcgagcgagtattagaaagtagtcgggttttttcgttttatgttggttcggttggcgtagttcgatcgcggtcggtgtttgaggttgggggacgttttgattcgcgtcggtcgtttttcggtggttttgggcgcgtttcgtgtagtcgggaggttggaggcgttgcggtcggaggagttgggggagttggcgggcggtttggtgtgtttcggtttgcgcgaacggttattgttggcgaggaagtcgggcggcgagtttaaggttagggagggtcggttttggcgttcggcgcgtttcgcgatttgtttggttgttcggggttgttgtataagtcggtgatattgttttgcgggtttacggtttgtgagcgttgcgtggagttggggttcgcgcggttacgggcgcgggcgcgggcgcgggcgcgtgaacgtagtgttgagtcgtttgttggagaggtttttttcggtcgagtgttcgttgcgtaggttggagggttaggcgcggagtttgtagcgttagtagtagttcgaggtcgcgttgtttaggtgcgattaggttttggagttgtgatttggttgtggggtcggttcgtttttttgatttttgttaagtttagcggttggagttaattcgcgggtttgggttttcgagcgttttgtttaggcgtagggggttatttcgt

SEQ ID NO: 7136 - DNA, 4359 bp, synthetic construct
  misc_feature 1..4359: note = Description of Artificial Sequence: Synthetic polynucleotide
  source 1..4359: mol_type = other DNA
cggagcgtttaatttagtatatcgttttcggtaaattgcgagtaatttaaagtagttcgtttagtagggaggggagttggtgggaggggggtggatttcgtcgttcgtagaggtggggagatttggggggcggtttcgtttttaggttgtagcgtgggtttggttttttgttaagttaggagcgtagttcggagttagcgcggttttcgggtttttgcgtttatggcgagggtcgcgggggaatagtttttggtaggtaatttgtcgggtatttatttgagtttttcgtatcgcggttcgaaaatttgggagcgttttaggataaagggttagttttttggaattagtcgtgtgtgattagtgtgtgttagttcgtatgtgggggttttagtgtgtaattaatttagttgtttatcgtagtttcggagaaacgagtacgtttttttgtacgtgtttagggcgggtgcggcgggtagtgtattgtgaataaagtcggttatttttcgcgtcgtatttcggggacgattttcggacggtttttcgcggagagtcgggcggatgagagcgtggtgtgtgtgtgtgtgtgtgtgtgtgtgtgtgtgtgtgtgtttgtgtgttttgtgtttttttaaggagtcggaggcggttcgcgaggtagggatttgttttaatttgttttatatttggcgcggttttttcgaagttcgggtggcgtttagggtcgggtaggtacgcggaggattagtagcgttcgttgtagaaaaagatatcgttaatttttatttagaagtttatattgttttgagatttggttttttatttttttttaaaaaaaaaaaatgtaaattgatggatgggttttaattgatgcgtaaaatgttttttttgagagtaagataggagggttagggaagggggaaataggtagttgatataatttttatagtttaattgtcgagaattcggatttggaggtaaattcgaggacgtattcgaggagtaggcgaggttgttttttagtaggacggtttggtatcggggcgtattgttggggatttgattttttcgtgtttttttattttagggattcgtagttggttcgcgcgttagggtatatacgggttgcgggagaaggtgaaagttaggatgtagtacgagtttcgagagtggtttgggttgtgttttttaagagaatagtcgaggttttcggcggttttgggaagttgtttttgggtcgggagagcgggaggcggcgacgtaaggacgcgttcggagtttgggcgcgtcgggggcgggcgtttggttggaagtggggtagtgttttttatgggaaagcgagattcggcgagttttttggttgtttttttagttttcgaggtgttcgttttcgcgcgtttgaggtagcgtagttcggagggcgaacgaatggcggttggtaaattttgagtgagagtgcgtttcggattcgaattgtcgaattgtggttgcggtagggtcggtcgagatataagttcgtttttttcgtttgttcgatgggttttagggagattttagttttagtttggtggagcgtttcgttcgagggagttgtgttattttgtttaggggtagggagggcggcgttttgggcgggtggggaagggtttttgtggtttttggggttttaagcgttttttttttcgtttttttttttatcggttttttttagttttttttgtttcgttttttttcggggttggttggatcggcgcggatttgttttagatttacggggagcgttttaggtttttaatgatagtttaaatgtggttgttggaaaagtcgaaagggatgtggttgacgtggggcgtgtttcgtttttttgtaagagtcggaaagggagttgggagtcgcgcggttggttttaggttttcgcgtttcgtcgttagtaagtaggtgggggagtcgtcgtcgtcgttagttttatttcgtttttaagtttcgttcgttgcgttttggtcgcgggcgtcgagagggtgcggggtttcgtcgtgttttttttattttgtttattaatttgtttgtttcgtttcgtttcgggcggttttagatacgggtttttcgcggtagtattcgcggttcgttcggcgtagtcgtcgtttcgatttttcggtttcggggggtaatgagggggtagtggaaggggtattgtttttcgggtattatttagagaaacgagatcgtttcgttttttcgtcggttttttttttttttcgttcgggttcgcgtaatttttcgttagagggtaagttgggagtgtttcgtttttatcgatagtttttttttttttttttttttttttttttttaaagtttttttagaagtgggagtcgggtgggggaggaagaaggtttggttagttttcgttttttattttattttttcggtttaatttgtttttttttttttttttttttttattttttgcgcgtcgttgttttttcggagttgcgttcgggaatgataattggagcgcggtttttttaagagttcggttttgtttttcggtagttgaaggttattaaatataaaagtttttagcgttgcggtttaatatagcgtatgcgttttgttcgaggattggtagagagacggtaatatggcgagaatgtttggtagcggggattgtaatattagcgcgggcggtagcgttagcgttgtcgtcgtcgtcgtcgagaataatggggagcggggcgagggcgagcgcggcgcggggggtcgcggtcgtcgttatagtcgttcgtattattgtagcgcgggtgaggaggaggaggaagaggaggaggaggacgagatttaggaggtgtagataacgggggacgaggaggaggaggaggacggaggtggggggttggaggaggacgaggaggaggaggaagaggaggagatggggttggattgggacgagtttttggagttcgaggattcggtcggggaggagttggagttcgagtcggtttatatgattaatatggattagagcgtcgcgttggagttcgaggcgtcgtcgcgattgttggcgtttcgggttcgcggtgggtcgttcggggacggtttcgagttggatttcgacgtgttgtagcgtttcgagcgggttcggttgagcgagaatattcggttggttattcgttacgtcgtgcgtatttttcgggagtatttgagcgagaaggcgtagagttcggatttcgagattatggataagggggcgttgtgtcgcgtgttgcgttttttttatgtcgaggttcgttttaaaagcggttagttttatagtaagtcgtcgtttattagtattcgtagtttttttaatcgttattttaatgagttttcgtattgtcgtacgttcgattttattaaggatttcgagttgcgtagcgttaatttgacgttggtcgcggttattcgtaagttcgaggagtagggcgtcgggtcggtggtgtagaagtaagttattacgcgcgtcgatttgcgtaagttgtatatttttagcgtttttagtattaatacgtttttcgggttgtttaataaggtttggttcgagacgtgtatgtatttttgtattcgcggtcgcgagaattagcgtgagttggaggaggatttttttgggttggttatggacgaggacggtcgtaagttcgtttattttaagtttttcgggttttattataagtcgcgttcgtcgtcgtggagtaagaagcgcgtcgagagtagcgacgaggagaatttgtttcgtatgtatgagacgggtatcgagttttgtttttacgttagtttcgttaagtatttgtcgaaacgtaattttttttgtaaggcgtttttttagcggtttcgggattattgtagcgagggcgatgtgatttggtacgagaataaagttatcggtaagaatttgttaggtattcggatgtagatgttttttaaggcggttaagttttttaagatttatattaattattgtatcggcgtcgtttttatcgttacgtttaatagtatcgcgggtattggtattaagttgggttcgttcgtttcgtagggttgttacgtcgaggttttgaacggggcggtacggtattatttttattatttttttatttattttttttattattatcgtttttagtcgttttcgttggggaatatttatattttttttaaagatagttaggtcgggttcgacgtgaaattcgaggttgcgtttaagcgcgttttgtacgagtttgtgttcgggtcgggggaaatttgcggttttattttttttaaaagattttgtattcgtttttcggagtttgtggatgcggtggtggtggttttcgtgaaatacga

SEQ ID NO: 7137 - DNA, 2762 bp, synthetic construct
  misc_feature 1..2762: note = Description of Artificial Sequence: Synthetic polynucleotide
  source 1..2762: mol_type = other DNA
cggggcggtgttcggcgtattttaggttttttttcggcgatttttcgcgggttgtagtaaaatacggggcgtttcggcggggcgggggcgggcggttgtcgcggattcggtcggttatagtcgtagtttggtggttttcgattggttacgacgcgggcggggaggtttggcggaggagggaggcgggggcgagggcggcggcggcggcgggaggaataggagaggggagcgggtcgcgtagttaggtagcgcgtggggcgagcgcggggagagcggcggcggttcgtttaggtcgcgtagcggaggtcgagcggggtgcgcggtcggcgacggagggcggcgcgcgcgagtgagcggcgtagggcgaggatcggcgggcgggtgtcggtgcgcgggtagtaggggcggttgcggtagtagttgcgcgggacggagtcgcggcgggagagatcgcgtcggtttttcgttttatttttttgcggtcgaggtcggagaatagtttttaattcgtcgggggatcggaaagaggagtcgagaagcgtttttcggtttttacgtagcggaggcgcggagtggcgggattgttgttttttgtgggtgtagtacgtacgattcggagcgtttttttcgcggcgttgttttcggcgttttcgtcgcgtcgagcggttttggagcggggattcggaggaagtaaaattacgagttcgaaatttcgcgtggcggagtttttggggagcgttattcgttttatttttatttttatattttttatcggttaaggttttcgtcgttgtatttttcgcggttttcgttgcgtttcgggtcggagtcgagtcgtttgcgttgttatagtagtcgtttttatatattcgtagacgtttatacgttttttttttttgttttttcgttttttttttagttttttgatttttgggtttgttttattatttttggtgcgagtttcgcggatttcgcggttcgttatttgttattagttcgttttttattggcggggagcggagagtagcgaagaagggggtggggaggggaggggaagggaagggggtggaaattgtttggagtcgttttttcgcgtcgttgttggtgttgtcgttgtttttttttttttcgtcgtcgtcgtcgtcgtcgtcgtttttttcggtttttcgttcggttttttttcgtttttatgtgtcggatagcgggagcgttgcggattttgttgtcgttgttggcggttttgttttaggtacgcggcggttttcgcgggtcgggttacgggcggggtggggcgggcggcgtcgggtttttttgtttttcgcgtcgttgcggggtcgggttgcgtattcgggaagggaggtgttacgtcgcgtcgcgtcgcgtcgcgtggtcggtagttgcgtaggtatcgggtttcgttcgggcgtcggggtagggttgtcggggttagtaggtttttcgcgttttttttggcggggttttaggggttggattgcgggttttttttgtttttttttcggggtcgagtaagttcgcggggggtgtttttaggtagtaggagggtgaggtaggataatttttaggttttgtagttttttgtgtttttcgtttttcgtatagtattttgttttaatttttttgtttatttttgtagggatgggtcgcgagtttatagtaggaatttttattttggtgttttagttacgggatttgtttttattttattttattttgtattcgtgcgtttttcggtgtttaagggttttattgttttattgtttttattttagtttggagttgttttttttttttttttttttgtttttataatattttgtgttcgttttatttggaaagaaaatttggtttttttgttcggaggagtttttgtcggttagcgtttgtttgtagaacgagtttggttttttacgtttagtatttttttcgggcgagaagtttcgttacgcggttgtttttttttttgttcggttgtttgtgttttatatgcgtttcgggggcgtttttgtttggagtttttcgtattttttatattttcgggagagagttagcgagtttttttatttaatttttattaagaggttttttcgcggtaggaagtatttgttttagttcgggcgtaggttttttcgttattgtacgttgcgggtttttagttcgggggtagtttaatttttcgtcgtttttaattcgaggatgtttttaggtttttttcgattagttagtttaggtttggaggttattttatatagtttcggtcgggattttttagttgggcgggtgtagtgttttggttttaagtcggttttcgtttgtcgtggggtttttcgaaggttgcgggaaaggggcgtgtttattttcgtcgcggggtaggaaaatttacggagggtttttttgtttgtcgttttcggggtaaggggagaggtgttttattgttagttggtagtttcgaaaagtgcggacgtagttcggaagtgtttgtttcgggggtggagataggtggtgtggattatttcgtttcgtggtttttacgggttagggtttggcgcgtttcggttcgtcggggggtgagtgttgttggggcgggggtaggggttggacggggttggttttcgtagtttttcgcgttttttttcgtaatttttagacggtcgtgggtcgtcgtcgcgcggagttttgtttatggtgcgttatggtgcggtacgtttgtttttgttcggttttacgtttttttttcgggtcgt

SEQ ID NO: 7138 - DNA, 338 bp, synthetic construct
  misc_feature 1..338: note = Description of Artificial Sequence: Synthetic polynucleotide
  source 1..338: mol_type = other DNA
cggagcgggggcggtttggagcgttgatcgggcgtcgaaacgtcgggagtcgggggttaagggttcgagttaggaggtttcggagtagtagtcgttcgttttttacgtcgtcgtcgtcgttttcgcggttgtttggatacgggataatcgatttggggtttcgatcgtagtagagtcggaggggtgggtaggcgcgggttcgggagacgcgcggggaaacgcgcggagtcggtgagtcgggggcgtttgtgtttcggcgcgggcgtttgtgtttcggcgcggggcgttgtcgggcggcgtttattttttttggtcgttcgtttgcgcgattttcgcgg

SEQ ID NO: 7139 - DNA, 1435 bp, synthetic construct
  misc_feature 1..1435: note = Description of Artificial Sequence: Synthetic polynucleotide
  source 1..1435: mol_type = other DNA
cgggattcgtgtgtttttcggggtttaaaggcgttgggcgggcggttgttttcgggagaggcgtagtttttatttttggattacggggttagtggttggggaagtttttggggcgcgcgcggggaggcggcgttgcgttttatttgtttagtttcggacgtagttcgggggcgaggcgtttagggattattttaatttaatattgggatttttaataaattaaggaatgggattttaattattgaaaatttagtttttttgggttagaatggtgttgggatggttttggttataaaatattaaagagatcgatcgttaagggaataggaaaaacgttcgagatagtcgttgtaattacgaatggattagatttggtagtacggggtattgattgttggtgtttaatcggattttttttttttttttttatttttttttttatttaaagtaggttttcgttgcggtcgggatttcgtatttttgtaacgtggtcggggttgtattttttatgagtttagggtgaataggtgcgaagtgcgttgggagtattcggttagcggtcgagcgcggggaatatggagagcgagcgcgatatgtatcgttagttttaggattggtgttttaggatttacggggatttaggtaagattaagacggtgattcgtaaaaaatacgaacggatcgtttagttttttaatggtttcgagtcgagttttacggataacgttaaatttaaattttgggttaaatcgaagggtttttagttgggttagtcggacgaggttcgcgggggaggcggcggcgttaagtaagtgttttacgtgtttgttaagattacggtgagtgattcgtttttttttgttatttgtttgtcggagtagttcggcggggagggaggaaggagagaggcgggagagagggggagtcgtgagtcgtcgttggttcgtgtgttttttattttttttaattttttttttaagtcgtttttattcgtattagttaggcgcgttttttttattgtatagtttttgtggttttttattttaaagcggtagcgtatttttagagttggttttttttttcgtttcgggttttcggatcggttgtaggagttttttttttcgggtcgggcggcggcgtttggcgttttcgggttgggttattgttttatgtttttttttgggcgtttggcgcgtgttttatcgtcgttatcgcgtttaaaggttaggttggaagttcggtcgtacgttttgagagtagacgagtttgatcgatagtttatagtgtttttttattggtataaagttcgaatgtagcgttagcggtggatgtggggttttttttaggatattgttaggttttatcgttagatcgttgttcgggaggtacggggtagttcgaatgtttcgattatttttagagatcgttgtcgcga

SEQ ID NO: 7140 - DNA, 510 bp, synthetic construct
  misc_feature 1..510: note = Description of Artificial Sequence: Synthetic polynucleotide
  source 1..510: mol_type = other DNA
cgagcgtgagttagcgttgaaggtttagagcgcgttgtacgagtagaagattttgttcggggtaagtggcgttcgtcgtggcgtaagcggtcgacgcgtcgatagggggcgatttcgggaggtcgggcggcggcgcggcgcgcggggagaggacggtagggcgttcgtcgtttcgtttgagttcgggagttcgcgcgtttttttaaatttttgggttttcggtcgttcgggtttaacgggattcgggataggggttttatttggtcgtggtcgtgaagtttttgcgcgggtagtttggggcgggggagcggcgcgtttcgggttttcggagcgggagttgttttcgtcgggttcgcgggtcgcgtgcgcgatcgagttcgtttatcgagtcgacgcgggtcgttttagtgggggaggagggggtcggcgtgggagggggcgtcgtaagtgagattatcgcggtttatttaaggagttagttttcgtttttgataaattatcgcgtttcgg

SEQ ID NO: 7141 - DNA, 2722 bp, synthetic construct
  misc_feature 1..2722: note = Description of Artificial Sequence: Synthetic polynucleotide
  source 1..2722: mol_type = other DNA
cgaaagtggttagtcgagggtcggcgggggttaggttagtcgtttagtttcgtcgttttagttttttagtttcgtagttcgcgggggagcgggcgcgttattttaatttgttaggtttttgaagcgaagaggttgttttgaaaaagtaaatatgagagaggacggggtgtaggtaaatattattaacgtgaaaatttgttattttagttaagtttattattagtatttatttttataggcggggtcgttcggattttgttttcggtttcgcgtttgttattttttttttcgcgtagtcgagatgttagttttagtgggtttggcggggagttcggcggggttcggatcgggcggttcgattttcggtttttacggtaggaacgatttagtttcgtatttcgggagttgtaggtgtcgaaaacgaaattcgcgggggtagcgtacgtcgcgcgagtttcggttcggcggtaatttagatagcgatttaggggttttatttttttgatggtgattaaaaaaatatattttatttgaattcgtaaagtagacgagggtaaattaagttatttttcgcgttggtttatcggttatcgcgtttagcgttttttttttttttcggcgggcgagcgggtaggggcgttcgatttttatttttttttcgttagttatcgggggattagtcgcgtttttcggggcgggggaggtcgttcgggacggggatttttatttttcgttttcggaagcgggttggggcgggggtcggatttcgagtttttatttttcgtttttttgtttttcggcgcggttcgatagtttttagttttattttggtaggtggtttgggtggcggtagatgtcgggcgggaggaagatgtggggttgttttggtaggttgggggtgtgaggaggaaaaaaaaatagagaaagatatatatagagagatagggagagagcgcgcgcgagagagtttttgtttatagatttatttatataatatatatttatgtagttttttttttttcgatattgatgaatgcgcgttcggattttcgggcggattttttttaagtcggttcgtttttttagtttaaataaataaataaagttagatggaagaaaaaagcgtttattttattttcgtcgtcgtttcgttcgttatttttgtttttgtttcgttcgtttggcgttttaatagagtatagtttggtggataaagtttttttatatatttatacgaaaataaaaattattatttttaaaatataaaaagttgtatttgttgttattataaaaagaatttttaaaaggtaaagagaggaggtcggttgttcggttttttacggatattcgtttttcgcggtcgtcgggttcggaattttagcgtttttcgaagagttatgcgtttggcgttatttatagtcgggggtcgtttcggattgtattatcgttacggcgcggggtcgtcgacgggggaggcgcggtggtcgtcgttttacgtcgttttgttttcggtcgtcgttcgtcgtggcgcgggtttttatagcgcgtttattttcggtttttcgcgttttttttcgcgcgcgtatattcgttatttttatttttggtttggttgggaatttgaatcggtttagtttgtttaaacggaaaggatagagattttgtttgtttaatgtaaaaaaaaaaaaaaaaaaaaaaaaaagaaaaaaagaaaaaaaaaattagattagattgagagagagaggagagagggagagagagagggagagagagagggagagagagaggagagggagggagggagagagagaggggggagagtagagagagagcgcgagcgcgagcgagcgagagaagaggagaaagagagagagtagagagcgagcggagagcgaggtgtagagaaatcgagggggagagaattcgagtgtgtgtatgcgtgtgcgtgtgtgagcgcgagcgagcgagagagaggagcgagagagtgtgagcgagaaagaataaaaggaaagaagattttttttatgtatataaagatggttacgttagtaaacggataggttgataacgtaagttttagtattaacgggttcggtagtagttcgggtagtgtcgggtatatgaacggattaagttatagttcggggaattcgtcgattatttttatgaaggattacgatgttattaagttgtttattgggtagatttttcgtaatttggatgagaaggattttaagttttttttcgaggagtttggtaaaatttacgagtttacggttttgaaggataggtttataggtatgtataaaggtgagtatattttttttttttaattttgtcggggagtaggagcgggttggcgggtcgatcggtcggtcggcgattgacgagcggcggattaagcgagaggaagtttcgggcgggcgcggtggagggaggcgttcgggtagcggagattagagttggggtgcgtggggagttgttcgttggggtaagattgggttttgggcgaggtgttgataggaacgatgttatggagagagtagcgggcgtcgatgaagagaaagagagaggggatcgaggagacggggtttggatttttgggtatagcgatttgaaagatggggatggggaaggttgtatcggtcgagtttaggacgttgagcggacggattcgcgggtttttggtcggtcgaggatcgagggtgttgtttatcgtcgt

SEQ ID NO: 7142 - DNA, 1133 bp, synthetic construct
  misc_feature 1..1133: note = Description of Artificial Sequence: Synthetic polynucleotide
  source 1..1133: mol_type = other DNA
cgagggcggtcgtttttattttcgggggtttttttaaaatggggtggggggaagttatcgttcgttttgcgttttcgcgggtgtgttttgagttttcggtcgttcgcggcgttcgttttcgtttcggtgtttgcggcgatttacgtttcgaagtagatttcgaaaggaaaaagcgatatttttgtttcgtatagagttaaatattggaagtacgagatagtcgacgtggattaggattattttggtttttcgtgcggcggcggcggcggcggttgcgcgcgggttttttgtggcgcggttttggggcgcgggcgcgggcggcggcggggttgcgggagtcgtcggggcgggaggcggagcgcggggcgcgggcggcggtggggcggcggttggcggggagatagatggtttatggaaaggtttttttttcggtttttttcgatatttaaaggcgttggggtcgtagttgtcgttatataaaggcgcgcgtagttaatgggagcggagcgtagcgcggcgcggtttcgtcggaatcgcgggggatagcggggatcgcgggcgcgcgggtggcggagggagggaggggtgacggttggaagggggtcggcggttaatcgttgcggttcgttgcggggcgcgagggaggggttagttttacgggaagcgtggagtttagcgcgggtttttggtcgttcgcgggtcggagagggcgcgcgtgaagcgtttttgtatagatatgggcggcgtgaatacggaacgtgtatatatggagagggacgtgtatttagatatgtggaggtgcgttttttagtgtagagagacgggtacgagcgtttttagtgtatacgattttgaggtttttgtatatcgcgtacgggttattcggggacgtgcgttcggaggttggcgtacgtgtagagtttgattgcgggtataagggaagttggaatgcgaataagtagtcgtaaataggatttaggtattgttatatagatatgtatatattaaacgttttgttaacgtaggacgcgtgttaagaacgtatttttagagatatatagagggaatatacgatgtagatataggtaagatacgtatattttttaggttttttgtttggcgtatcgcgtcgt

SEQ ID NO: 7143 - DNA, 2401 bp, synthetic construct
  misc_feature 1..2401: note = Description of Artificial Sequence: Synthetic polynucleotide
  source 1..2401: mol_type = other DNA
cggtttgatcggggcgtttcgtcgtttttttagtgtattttatcgttttcggttgggggcgtagtattttggagagaggcgtttggtttcgcgtttgggttgggggcgttttattttgcgttttgggggttaggggcgtttgtcgggtcgttgtcgaggggttttgtttatttttgtttagttcggagtttaggcgagttagcgcggcgagtttttttttttttcgtttgggtcgttttgagttcgcgttcgttttagttgttgtagttgttgttgttggcggttgcggggagcgcggggcgcgcgtcgaagaggtttgggcggcgaggacggggacgaggaggagtcggaggcggtaaggaggaagagcgagcggaggtcgaggggtttagcggcgtggcgataggattagggggtttcgagaatatgggttagtaggcggttacgggtcggcggtcggacgcggtgaatttgtcgcggtcgggcgcgtattggcgcggcgagtcggagtcgagcgtagtcgggggaggagggttggcgtaggggcgttcgggcggagggggtcgattatttattattaacgagttattatttaataagcggagagcggttcgttagtcgcgcgggaggcgttcggggaagggggttatcggtcgagcgtagcgtatattcgtggcgtacggcgggcggcgcggcgtcgaggatattcgggatcgcgcgcggagtcggggcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggttttttttatggtgatttttttcgggggtttttttattattttgttttggcggacgtttaagtatttgtggatcgtgtgttgttattgcgggggtaagacgaaggtaacgcgcgtttcgggcgttcgttttttgcgttagttttatcgtttttcggcgttttttgtagtttattttttcgtttcgcgtcgcgtcgtgtttttttttattttcgtttgtttttttttcgtcgtttttttttttttcggttttttcggtgttttcggatcggggtagcgggcggcgcgtcgggggtgaggagttgtttttagttagtgcgtttcgggacgcggacgtttaattttgtttttttgtttattgtagggttgttggcggttgcggttggggtcggggtcggggatttataggttcgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataattttgtataagggaatttcgggggaggagtatggttcgagataatagggggatttcgaggggcgagagaagttggggagatttattttattattgggggtagtttacggggttgttatttttggaatgtgtcgaggtcgtatatttgatgtaattttttatttcgttttttaggtgttttagtggaatatattttaagtttttcggtttttgtttttttgtttttaggttatttattttgggttttcggaaatgttattagtagcgcggagttggagcgggagttcgtttgaggtcgcggttttacgcggagcgttttttttggcgttcgaggtggttagatgtcgtcggttttagttatttttggtgtagacgtttatcggtattgaggttggcgatattttcga

SEQ ID NO: 7144 - DNA, 769 bp, synthetic construct
  misc_feature 1..769: note = Description of Artificial Sequence: Synthetic polynucleotide
  source 1..769: mol_type = other DNA
cgttgagtcgtagggaagttgcggggttagttgagtagtcggcggtttgttgggtttttagtgtcgcgcgatagtacgattcgagataaggtatttggggttggtgttaggtagaggtttcgcgttgcgtggtcggcggtaatagcgtttggcggtcggtttcgggcggggttgtaggcgtcgggttttcgcggtcgcgaggcggggttggagggcgttgcgggttgcgcggaggttgcgggaagcgcggggagtacgcggagttcgattagtagggagatcgcgtcgcgtcgggtataggtacgggattcgcgttttaggagggcgtagcgagaggcgtattgcgtatttaggggttgcggtttcggtcgtcgtgcggtgataagttgatttttcgtcgtcgtttagttaagttcgcgcggggtgttggcggagatgtcgtatgggaggtttttttaacgaggtgtaaatttaagttatttcgtttgagtgaatgaagggacggcgcggggcgcgggtggggtttatcgtgataaaagtttagtatttggtttaaattttttttttttttttgttcgtaggattagaatattcgatattaaaatgttttagtgtagtagaattttttagcgatttcggtggcgggagagtagtattttttaggtatagttgtgcgtatttttcgggttttatcgatcgtattatttgatcgcgggaaacgaaatttgagtttaggaatttgaattgttttacgtacgttcgttttcgg

SEQ ID NO: 7145 - DNA, 1169 bp, synthetic construct
  misc_feature 1..1169: note = Description of Artificial Sequence: Synthetic polynucleotide
  source 1..1169: mol_type = other DNA
cgggagttaggcgcgcgggcgggggttttatcggttatttcgaaatcgtagaatgttttagggttttcgggatttgtgggtttaggggaacgttcgggacgcggagcgggtttagtttatttgtcggacgtttttttcgtttattcgaattcgggagtttcgtaggagggatttttttcgtttttagtgattatagttcggattcgggttgcgttcggcgggtaaggttgggagtttttcgggtcggaggacggggcgtatgggtttcgggtttgtagaattcgcggttgcgggagttgggtttttttttttttaattcgggtcgcgtttcggttggtcggaggaggtagagtaggggtgcggtcgtgtgttcgagcgggagtggggcgtttattttcggggagaagggggatcgggaaaggcgtagcgcgtcgagtattcgtttatatttcgttcgtttttcgcgcgagtcgggtgcgtttttaatcgaatcggggcgggcgtcgggagagtcgggttttttcgagattcgcgtttttttttcgttttcggtttattcgggttttcgtaggattagcgcgaatagacggggcgattcgcggtcgagatttttatttacgcgcgcggcgcggttagatcggcgagcgttttcggttcgacgtttttttcgattttcggattttgggcgttgagcgggagggggaggtattagtttcgttcggtttcgagtcgttttcgtttttttggttcgaatagggggattttaaggtttttttcgattttttcgcgttcgcgcgtatcgcgtattcggagaagaagttgcgcgcggaattattagataggagttcgcgtttttcgttttatcgtttattgcggtttcggttttttcgtcgcggattttttattttcggttttacggcgcgtttaattttatttgcggtttagatttcgcgagtttcgggtttcgtttattcggtcggcggttttttcggggcggagcgcggcgtttttggagtcggtatttcggatttcggcgtcgtttcgcgtatcgttttcgttttagtttttagtggcgcggcgttttttcgcgatattcgcgggtttttaggagcgagtcgattttcggttgggtttggagtcggggttaagtttattcggagggagtacgg

SEQ ID NO: 7146 - DNA, 6036 bp, synthetic construct
  misc_feature 1..6036: note = Description of Artificial Sequence: Synthetic polynucleotide
  source 1..6036: mol_type = other DNA
cggtgcggttttgggtattgattacgtttatatgtgatggttttcgtaacgtgtaggtttcgttggggagaggttagcgcgggttttaggttttagggtttcgggtttattgtcgggattttttttagttttttttttattggtttcgttcgtcgcggttgcgtcgggtcgatattgattttagcgatttttggggtcgttttagttggtagttagtattttttttgggatggggtttaaatgttagtcggttcggcgtttgtattagggttttatcgtacgtagttcgttgttttttcgtttttcgttaaggggtgcgataggtagggggattcgttggtttttgttttttttatttttatttttttgggtttcgtcggagcgtttgggtttcgggttttttgaatatcgtttgggcggggttttttgtcggggttcggttatatttttattcgtatttttatagttggggttgagaatgaaaataatttttgtaaagtttttattagcgaattatcggcggttgtagtgattataggtttcgtttttgcgcgtcgtaaaggtttttagttggtaggttcgtcgcggcgtcgtttttttttagtttcgttttatttgcggcgggcgtcgttatttttttagcgttgtttttgcgaagtagcggatttagatttagattcggattcggaggttatcgtttttttcgttcggggttaagtaacggttttcgataggggaagggtcgcgcgtttagggttgggttaggacgtttttgttagcgttttacggtcgggatttgaggtttagcggtcgtttcgtttttttttggattttcgcggtatagaggtaaggtttttcggtgaggcgcgaggtcgtcgtgcgttgggcgggggttttgagagtggtggggttcgggtgggtagaggttttggggcgatttatgggggacgtttatagcgtaggtttatggggtagttagatcgcgtcgtagggtcgggagagaacgttttagaaggtcggtttaggttattattttaggagggtggcggaggtagtggtcggggtttttttcgcggtcgagtcggtggtggttgcgattattatggggttgggtatatagttgaaggggggtattcgggtcgagcggttgggggagtcgtgtcggttggcggggaagttttttacggcgatttttaggttttcgtgtacgaagggtgcggagatgggagttttggcgaggttgggatcgtttacgtcgttgtcgaggagggagagttggtcgtcggcgggggtttcggggggttttttggtttttaggttcggggacgtgttggagttggttttgggggcggcgattttttcggtttggattacggcgtcgttggttttgcgcggcgggggttcggtcggggcgttttcgggcgtggagtttcgtagtggtagggtcgtggcgggaagcgtgttgcgtaggatgtggggtacgtttttatttcggatgcgtcgttaggtcgtgttcggcgcggttattttggggagcggtcggggtttttcgtcgttgttgcggcgcgcggcgtcggttgaggtaggggtcgcggggacggcgtcgtcgggtttgcgggttacgttgatgtgcggtagcgacgcgtagcgtttgatagttttcggtcgggcggcgggcgcgcgtataggtaggcgggacgggttttcggaggtggtgtgtcgggtagggcgttcgttagggttgggtcgggtcgcggggggtcgttgtcgggtcggggtcgggttttgtcggggtgtcgttcggagtttttcgtagcgcgaggagtagaggaagacggcgggtagcgcgggtcggtcgcggcggggcgaggcgttttggggggtagaggtcgcggattcggtcgaggatagttcggagcggcggcgtcgtaagttcggcgattttttgatgaaggttagttgtcgtcggaagttcgagcggtcggaggattcgttgtcgttggagagggttgaggttatacgtattaggtttaggcggttttcgcgcgttttcgggttcgtttcggttttcgttcggtttttggggttcggtttcgggattgttcgagttagcggtggcggtttacgtcgggtcggtttttgtatgaacgggattcgtacgggcgatttttgcgttttgtgttgtttcgttagaagggtgcgcgtcggcgttttgggtatcggggaggtttcggggtcgggtagggttttagtagtttgggtgatcggggggcgttttttgggtaggggttgggaggcgggcgaggtttgggaggagttggaggagggggttttggcgaggcgggcgggcggtgtggcgtttttggggggttggtttagcgtcgttagtttcgaggttttggtaggtcggtgtaggtttcgcgatcgttgttgttcggggttcgggattttggttggagtcgcgggttgtgttaggtaagggggcgttatttttcgcggtgtggcgcgggggtcgggggtttttttgggttgggtacggggtgtcgggttggggacgtagattattgttcgttttcggagtatagttggtatttcgggcgtggttttttgtgtgttacgtggtttttcggggtttgtaggggaacgggggttttcgttggttttgattgaggttgcgttttttttttttggtcgtcgggtattgtttattttttttttcgtttgtcgtttttttttgtgtttggggggttgtagggtggattttattgatagttcggatacgaaggataggatggagtcggattcggacgaggtttttcgcgtggtagttgttgtttggtgtagttacgtgataattgaattggcgtttttttggatggcgcgttattttacgttatttaggtcggaggttcggttcgagttcgttgttttttcgtcgcgttttcgggatttttttgcgggtcgtttatttagtcgggtggttcggggtttgcggcgtcgtaggttagatacggggggtcggcgtttgggtagggtcgagttgatgtatcgttgtagaagttttttcgcggttcgcgggttgggcgagttgtcgcgttcgttttttgggttcgggtttttggtgatcgcgggttttcggtttcgtggatggacggtcggcggtttcgagggttcgggttcgttgagggagttggcggaggagtttagggagtagtagggcggggtttcgttagtaatgaggttgggttgggttcgggcgggcggcggggtagttggtgtagttttggacggggtaggggttttttttcggttttgcggacgttttcgcgtaaaagcgcgagggatggtcgatgtgcgtcggtgggttggcgtgggcgcggtcgtcgggggtttttcgttcgagtcgttgtcgtagaagtagtatacggtttttttagtgggcgtcgtgaggtatagcgattggagcgtttcgttttcgcgggttcggtcgggttttgagtcgtttttgtttgcgggggcgttcgggggtcggtttaggggtagttttagttttgttttgtttttgttcgcgtttcgagattgtttcgcgttgcggtcggcgtttttcgttttgtgtcggtgttttatggtttgtttggtagaggtggggcggtcggtgggtttttgtttgttcgttggtttttcgggttggtttttggggggtttttgtagcgtttcgtcgttgagcgaggcggcgttagagaagttgatcggcgtgtttttcgcggagttagtgtaggagtcgtttttttgggtcggggtcggggcgggtattaatatgtagacgggtacggggagtgcgcggcgatttggtattagcgcggaggttattttgcgtagtcgggtaggtacggcggtttttaggtattttcgtagtagttttagtttttggttcgcggcgtcgcgagggcgagaattcgtgggcgtcggttttttttttcgtcgtcggtgttttgtaaagtggaggtcggcgttttcggcgttttcgtcgcgttcggggtaggtcgagggtagtagtcgtagttttacgttttgttgtacgtagtgttcgtgtaaggttagcgcgttgaggttggaggcgtacgagaagttttcgtttggtttttttacggtaaagcgtacgttgtttgcgtttagtttagatggtagtcggtagcgttttcggtagtcggcgatgtttaggaagcgttttacgtagtttttttattgtaggttgaattgggtggtttcggggggattttgtggcgcgggcgttagcggtggcgttttgtttcggttgggaggtatggtttgttcggggttgtcgggtagttcgttagggttgatggtgtcgttgttttgttcgttgtaaggtttattggggatggagttggcgatggacgggttttcgaagttgtttagcgagtttatagagttgtagcggtttagtataagcggtgttttttgtacgtagtttttcgacgagttggacggcgtggcgttttttatttttaggtttcggtttcggttacgtcggggagtcggaatggttacgggtagcgaggtggtttcgggcgttcgttacgtgttgtttagtttagtttcgttggggtcggttttttttagtttttttagggaggagttattgttatttaggttattattttcgttggggtttgggcggtcggtcgaggatagcgaggaaagggagttgtatcgggatagcgagagtggttttttttgcgtcgttagtttttgtagtgttttgttggttatagatagcggggtagtcgttagtttttcgggaattttgtttaggtggtttgtcggtagttaggtttgttttcgggtttttggagagattttaggtttcgcgaggggttttgtattcgtttttgaggtatttttaagtagtggtacgtgttgataggtaggcgatagtttgatggtgcgtacgcgggcgtcggcggaggtggtttcgcgggtcgggggttcggtttggtagtcgggtaggttaaggttaagtcggttgggtcgaggttgtttatatttggggttttcgcggcgcgaagttagtgcggttagcgggtagggtagtatatgttcgcgtgggtagtattcgtcgttggtattgtcgttgttgaggttgtcgttggagaggttggcgtgggtcgttttgagtcgtagtagcgggtgcgttcggttttttgtttttcgtcgttcgtttttcgggtcgcggtatggcgagtaggattgggcgcggttttttcgtggcgttttttgtttcgggtttttagagttgaggttgaagttatcgtcggacgaggtgtgtagggcggagatgttttttattagttggtcgatgcgcgttattgtaagcgttagtttggttttggttttggtcgttacggttgtttttttattggtgtttttttttgtttttttgtcgtttcggcgggtgggcggggtgcgagttagcgtttgtttttgtaggaaggggttgtttaggaagagggatagcgcggtagggttggttggtttttcggtggtcgcggtcgtagttagggatgacggtgtatcgtcgtcgttaaagtagttcgaatcggaagtatagttttgggttaggtcgtttaggtgtcgtaggggcggtagcggttttttagtggcggtttcggttgtcggcgggttttgtttttttaggtgttttagcgtttgcgcgaggtgtcgtgcgtttagttcggtttttagcgttcgttgtttgcgtacgtataggttgggtacgtagttgtttggggatacggcggtggcggtcgtttggtgtttggcgggtcgatgggttagtaggttgcgtagggcggcggcgttgtttatggcgattattttgtgtttggagtgtattagattacgtagtatgtttacggcgtttaggttttatagtagtttttggttacgggcgttgcgggtcgataggttttagagcgtgtcgtacgcgttgtttacgatggttaggttgtgcga

SEQ ID NO: 7147 - DNA, 3400 bp, synthetic construct
  misc_feature 1..3400: note = Description of Artificial Sequence: Synthetic polynucleotide
  source 1..3400: mol_type = other DNA
cgtgtagttgcggggtattcggggttgggtttatttgcgttcggggtcgtataggtaggtagagagagtcgggtttagggtataggtttgttttttgttttttgcgttcggggaagggggcggtatagagttagtgattatagcgtagcgcgtatttgttttcgtaggttttcggagcgttttcgcgcgtaagaaggcgtagatcgcgtcgtttttgtagtcgtcgtcgtcgttttcggttttgagcgaggagttgttttggggagatttgtcgtttaataagtgtttggtgttcgtttcgttggtggcgttgttgggttcggttttttagttgtgtcgcggtgagcgtaggttttttagaggtggggcgaggttggggtttatttgtgcgtttatttttttaaggaaaggcgttgtgtcgttagggtggggtttgggagttttttttttagggttgggttttgtacgtttttaaagttggtttgtgtatttttttttaagtgacgggttttgcgcgttttttttattcggtgtggattttttgcggggtttatttttttcgtcgcgagtaggttttggttttcggatgaattttgtgtaattttttttgtttcgtagcgttttgtcgttttttttttgcgttttttttggggatcgtttagttcgtgagcgtttttcgggggtatttttgcgattttttttttgttaggggttttttatagttcgtggtcggggggaagaatgattaattgaaagagcgaggttcggagaaggggcgtcgcggtagcggagtttcggagtttttttttacggttcgggggtatttttagttttagtcgtatcgggggagttttattttaattgtttagggaggggggttttaggggtgagggagggatggatagtgtggatcgtgtttcggtttagttgattcgggtttcgattttgtcgttgtagacgtcgtttttggggaggtagtattttaagtacgtgtgttcgagttttgggtttcgttaagtttagtttcgagggagttatcgtcgtttttggtaagagtttttttttattgatcgcgggtattgggatttttatttttaaggaaagaaggagttcgggtcggggggaaggtgggcgtttattttaggattttattttgttttgtagtttaagttcgaggtttaggcgtttttattagcgtcgtttgcgtttcgggtcgaggtagaggttagatttaagattttcgggagtcgggaggttgtagagaacgacgaagaggagttcggcgaggttatcggagaggtcgttcgggaggatcgtgtgattttcgtagatcggggatttaaggagaggtttcggagagaggggaagtcgcggaaggagaagtcgcggaaggaggagagatttaagaaagagaggtcgcggaaagaggagaggttacgggtcgttagggagtttcgggaagttttattttagcgttgggagttacgcgaagggggttatcggtcgtgggtacgggattttagggacgtcgagtttaggaagaagtaggtttgggtgttttcgaggcgtttcgacgaggagtagcggtttgggagtcgttagaagtttcgcgtaggtaaggggcgggattgagtcggtttcgcgtcggagtttaggggttttttttggacgtttcgcgattttggcgaaataaagcgagtgttgcggtcgtagagttatttgtttttttacgtttggattcggtattaagttcggggtttgaaagacggtggtggggcgttttaggtaggggagagatagcgagcgttatagggcggattcgggtcgtgcgcgaggagagacggtaagggaggttttacgggttttttaatacgtacggatattttagtcggttgtttgttggtttttattggggcgatgtttggggttcgaataaatatgggaaggggcgcgagttggggcgcgttcggattttcggggtaggagttcgcgcggcgtaggggttatcggtagttatattcggtggttattatgttgggtacgtggtgcgcgttgatgcgttttttcgataggttgatgagtagtttgttcgcgtaggcggtgggtacgtagtagggtgggcgcgttagggcggttttacggatttgtatttttagtagtagtattacgtggttgtcgtagcgcgggttgcggtcggattgaggttagtcgtatacgttttggtaattgttggtttggtaggtttcggggatgagtacggagcgttcggcgcggaggtttacgttgagttcgcgtagcgcgtacggttcgtcggcggcggtggttttcgcgttgcgttgtgttcgattcggttcgcgcggatttcgttcgcgttattttacgcgtaggttttgtagcgtttttaggagtagtagcgttcgtaggggatcgtcgaggtcgtcggggttatttgggtagagcgcgagtaggcgcgttagtagcggggttgtggtcggaggtagattcgggaggtttcgtagttcggtagtcgtcgtttgtagtttagtagttacgcggcgcgttagggtcgtggtttacggcgtcgacgtggggtcgtgtaggggcgtaggattttcggtggtggtcgtagtgggttttagtagtagtagtagcggtttttcgtcgtcgagtaggcgttttagcgtcgcggggttcgataggttgattaggttttgcgggaagtcggttagcgcgttcggatttagggttaggcgcggcgcggaggttcgggtcggggggattcgtagcgttcgtattaggcgcgtgagcgtttttaggaaggggtttgcgttgggtggcgatttttcgagtttcgcggatggtttggaattcgtaattggaggagttgagagcggttacgaggttacgtcgttttcgttcgtttttgtttcgtgtttcggtgtttgcgcgtatttgggcggcgggaagggtacggtgtttagttggtcgtgcgtaggtagcggcgcgggttcggatcgcggtagtaggagtagggtcggggttattcgtgtgaagtagcggtggtcgtcgtcgaatagtagtgtttgtagtcgggcggtatttagtcgggagtttgcggtgggtgggtacgcggttggtttaggggttgggggttcgggggtagtcgattcggtttttcgtttttttttacgcggatttatttttttcgcggggttgtagggttaaggttagttcggagtcgcgttaggttttcgtagggcggtttatcgttaatattaggtagcgggtgtttcgggaggggtagaggttttgcggagattagggtttagttcggttggatggaggtttatttagtttcgttttatcggtttttttttttttatcgttattggttttacgt

SEQ ID NO: 7148 - DNA, 1143 bp, synthetic construct
  misc_feature 1..1143: note = Description of Artificial Sequence: Synthetic polynucleotide
  source 1..1143: mol_type = other DNA
cgggtttggcgttttgtttattttttcggacgggtagtttatttttttttattttcggttttcgtcgcgcgtattggcggcgttcgttttacgttttaagaatttcgttttttagggtgggtggggggtgtacgttcgatagggttaggttagggttaggcgtggagttcgcgtgcgtttcgggatttcgttcggggcgcgcgggaggcgtcgggggtcgcggaggcggggcggggaggggtcggcggcggcggcggcgcgcggaggagatcgtagtgcggtcggcgttaggattcgcgggggttttttaggtcgcggcgtttttcgtttttttttatttttcgattttttttcgtttttaaaatgaggaaacggagtaattcgttttaagttgtgtagtcgggatcgtttcggggtgtgtagtcggttcgcggaggtttttttgggggcgggcgcggggcgcggttcgggggcgttttttgagtaggtgagtacgtcggcggggagacgtggagagatttcgaggtcggggtggggggaaatttcgagggttttaggcgggggtgggttcgggacgtgcgtaggaagggtcggtgtgtgcgcgagtgtgcgcgtttcgggcgcgtagcgggtgcgcggttggggcggagggtgtttagaggcgatcggatttcgcgtggtggtggttggggttttttgggtgcgggtgtgcgcggttacgagtttcgggcgtgtgtattcgcgcgtttacgtggagggttgtgcgcgtgtggtcgaaaagcgtgtgcgcggttttgcgtagcgttttgcgtgttcgagtggttcggcgttggcgtttaggtgttttagtgtggggcggttgtgtgtgtgtcgggggcgggggataggtgcgtacgtttttaggtgtggagcgtttgtgcgcgcggatgcgcggggacgtgtgcgtatatttgtttttacgtggacgtggttttttgtttgtttgcgcgtagttgtgttcgagttttgtgtgtttttgtgcgtgtgtatgtattcgtatgcgtgtgagtatacgtgggattggaggattttatgggaggcgtattttggaggggtcgagatttattttttagtatcgtttattttttagttattagcggtcgg

SEQ ID NO: 7149 - DNA, 220 bp, synthetic construct
  misc_feature 1..220: note = Description of Artificial Sequence: Synthetic polynucleotide
  source 1..220: mol_type = other DNA
cgtggtaaattcgggtttcgacgatagaggtagcgtagaagttcgtttttaaatgagataattttattaaaattataattttttgtatttttatagcgtttttttagtggcggagattttaggtgttttacgttagggtttattagagaatcggggcgatcgtaagtttagtcgcgggataggcgaggttcgttagttttacgaagcgttatcggtacgt

SEQ ID NO: 7150 - DNA, 1860 bp, synthetic construct
  misc_feature 1..1860: note = Description of Artificial Sequence: Synthetic polynucleotide
  source 1..1860: mol_type = other DNA
cgtacggaagtttttgtttagttgttagcgcgcgtcgttaggggttgtattgaagttgtggattcgggatggggaggaggttggcggttttcgaagtagggtttatagcgggggagggttagcgtcgtttggcggtggttgcgcgtggttagtgcggatttaggttcggttcggtcggcgttgtttgcgtgtggttcgggcggagcgagggtttttggagttcggttcgttttgggttttaggaagttcggcgtgtagcgttagaggtcgcgtgtgttgggggagggaggagtatagattgtgtttgggggtatttaggacgaatttatagaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttgtgtaatagaaattcgttcgcgtttagtagcgttcggggtcgtttgcgtcggattcgtagtttagtatttttcgcgttttggatttcgaggaggttaggtagagagcggttcgcgcggttttcgtttgcgtttttagtttcgcgttgggtagcgggatatgtttggtttcggcgtcgttatttcggttttcgtttgtttttgagtgcggagttcggagtttttttcgcggtgcgttgggttttagagggttagaggttattagggggtcggtatcggcgggagtttagtcgggcgcgttttcggtttttttttatttacgtttttcgcggtcgttcgggtttaggggcgtagcggggaggagatttcggttagggtcggggagcgcgagggcggggcggggttcggcggggaggggcgcgggcgggcggggatcggggcgggggtcgggttcgggggcggcggcggcgcgggcgggaggaggaggagtttttcgcgcggggtaggggcggagcgagcggtcgcgtcgcggagttaagtgagttcgtttcggagtcgcgtcgtcgtcggtttagtatttcgggcgttcgtcgttttcgtcgtcgtcgttagcgcggggatgtaggatgtaggcgggcgttaggttttagcggcggcggcggtagttgtagtagtagtagtttcggcggcggtagttttttttttggtcgatggacgtagagtcgtcgtcgtcgtcgttttgggtttggatggtgtcgggttcggtcgggttgtttcggtttagcgcgggggtcgtggttttttcggtgttgttcgtttcggtttcgtcgttcgcggtttcgttgtttttcggttttttcggttggtcggtttcgagcgagtcggtgttttcgttgttgtcgttgttttttgcgttagatttcgtcgtcgtcgtcgtcgcgtatttttttttcgcgttttacgggtaggtaacgtgttttcgtttcgtttcggttcgggtcgtcgttttttttgtttttgggcgcgttttgttcggttcggttttggttttcggttcgcgcgttttttttttcggcggttttcgtcgttttaaatttttaggacggagttcggtagtcgtgtttcggcgagaaagttcgtgtttggacgttcggtcgtttattttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcgg

SEQ ID NO: 7151 - DNA, 441 bp, synthetic construct
  misc_feature 1..441: note = Description of Artificial Sequence: Synthetic polynucleotide
  source 1..441: mol_type = other DNA
cgtcggggtttcggttgttagcgcggtcgttatcgtatggttgaaggggattgaggtcgagttgggtaagaattttgggcgtagattgtgaagttgattgcggggaggtttgggtttcgttatagtcgttttttatcggttttaattagtttcgttttttttttcgggatgtcggatcggtatttttattatttttaggtttttagggggttttggcgttttagttgtggattttttaatattcgtaggtcgtagggttatataggttgggtttttacgtgtagaggatataaagtagatagacgaaaattggagtttcggcggtagcgagaaataaaggtcgcgttaaatttcggaagtcgttttgtttgttttagttgcgggtttgattggacggtttttcgtttagtgttttcgattggataacgtttaaggtttcgt

SEQ ID NO: 7152 - DNA, 5587 bp, synthetic construct
  misc_feature 1..5587: note = Description of Artificial Sequence: Synthetic polynucleotide
  source 1..5587: mol_type = other DNA
cgcgggaagaaggttttggggggggcgttttcgatttaattaggaaggagtatgtatatgtaaatgcgtttagggggcgggttttgggttcggagtttttcggggcgtttcggcgtagttttagttttgcgttattttcgcgcgtgcgtttttttttcgcgattttttattcgagtcgtgtttttggcgtagtaggatcgtttgtttcgatggcggcgacgttgacgaggtagtagtagttgtcgcgattgtggtggtgggcgtgtgggtcgtcgaggttgtcgcggtttcggggattgcgggatcgatggcggcgggagggttttcgggcggcgggtttttgtcgtcgcggtcgggttcggaggtggtacggttcgcggcgttcgcgttgttggcgttggcggcgttggttgggtcgtggcgacgcgggtcgttgttttggatgtgggatacggtttcggcggtttgtatgttgggcggcgcgaagcgcgagagtacgcgtagtatcgtttgggttttgtgtttttgcgtgtcgtcgtcgttgtagttcgatacgcggtattcgtatacgttttcgttttgtagtcgtacggtagatagtcgaagtcggtgtgagatgttattgttttggacgcgtacggtttgtaagagagtagggttagaggtcgggttgggtagtttttaaatttatttttttggttattttggtcgtcgcgtttttttattcgcgtattttaatatttttcggattttggtttgtttattattacgattcggttttttttttattcgcgtttatttagtggtatagggtttttaattttgcgtggacgttaggtagttagttttttggattgtgtttttacgtttttattacgttaattaaacgtttattttgtatttgtttcgtttatataaattaatattgtttgttttttcgtagttggcgttttagaagggtagagtttatttttttttttttttttttgtatttttaggaaattttaggttggattttttgttttttaatttttttacgtttttttcgtttcgacgcgttttaatcgatagtttcgttttagtcggttttttttatttttcggagtacggagggtttgttcgaatcgttttttaaggaaagttattttgttatcggatttcgttttttatagttaatattgtgtttttttaagaaggtaagtaacgttgaggttgttgtttggttttttggttatttgttattaattcgttttttcgcgggatttttagaagttttttagcgaagtgttttttttttgcgtttcggtggggatttcgggaagtattgttttacggtttttaataaatatttagggagtttttatttttgaatcgagtttacgaggaggtttcgttatttttaggtttttttacgttttaggtgggaagtttgggcgtatttttttttagagttagtaattttatgattcgggtttttcgtagtttggtataattattttttatttcgttttttgtaagtttgtaatatttcgtatttagattcgtaatttaggcggaggataaagggttgtagcggagggcgtagagtagatgtttagggcggggtagagggggcgggaagttggcgttacggtcgcggcgagggcgagtagtcgcgcgttttcggtgttaggaggaatgttcgtagagcggaggttggtaggcgcgagaggttttaagcgcgtagttcgattaaggggagttttataggttagcgtcgagtcgaattaggggatttaagttttggatttttgatttatataaaagagaattcgattttgtaatcggcgatagatggcgttcggatacgtcgagtagttatcgatgtaaggttgcgatcgttgttttatttgcgcggttttatatgcgcggtcgtcgcggtttgttaagggagggagttgcgggattcgaggcggttagaaggggtttttcgcggttcgcgttgggttttatatttacgttgattttagttgtatttttatttgttatttaaaatgtaaagagggagagagagacgtgaggttcgcggttttttggttaggggaattcggattcgtttttaggtaagggtattttttttcggtaggttaggatcgaaatcgttcgggggatgggggttgagggtataaaggacgttcggttttttaagagttttttaggaggaagcgggttttggagttagtatggtgtttgattaacgggtggttgttttggtgtatatttgtcggttgaattggggagattggatggatattagggtgggaaggaaagtttttttttttttttttgggtatttttaggttttgtcgcgtggtttaaaatttttttttagtttattgggagtcgtgaagaattggagggagggtcgttgtgtttggatagtatttagcgggaggtttagtgggagtaattttgggtgggattttgggagaatgtaggtgtgtgtaggtgtaggtgtgtgtgtaggtgtgtgtgtacgcgagtatattagagtgtgtaagagagtgtgggttttgaggtagataggtagcgtgggtttgttttcggttatagagaagtggtttttttgtgtttttgagggttggaggttttgtcggtttttcggtattcggttttttggtggtttttggaacgtagtcgtgggagttttggggtttttaaagtggtagagggcggggagagtttgatgggattaagggggttttttttattatttagtatttattagagggtcgtagttagcgagtacgagtaagcgattaggttgaggtgtggttttttaggggttgggcgtgaatggagttttgggaggtggtgggaatagcgatgttgttaaaataattgataggtttgggggtaattattgttgattttgaagatgttttgggatgcgaaggtggaagatgggttgcgttatagggcggcgttttgcgcgagtgaagttcgttgtttttttttttgggttagttttcgtcgtttcgggcgcgagtcgggcgcgcgtcggtatcgcgtgggcggcgggttattttgtttcgggcgttcggtacgttgagcgttagttcgtgtagtagttttcggggtggttttttgaggtattattattgaatttttagcgaatacgaggtggtttcgttggttcggaacgcgtagggtatttcgatgtcgtttttttttcgtattgttatatttttggggatttttgtgaatgtagttgggggtggggagagagagagaggcgtgattagttgtaggtcgggggtttggggtaatttaaagcgaggtagtcggtttttggttggttggttttgtgttttttatttcgtagttgttttttggcgtacggtcggaggggttagtaaagttcggggaagcggttgtagggtcgaggtagggatcggttatcggttgtttattgttttttttcggatggggcggggcggtaggggcgattcgtgtttttttttcgtttttggtcgtatcgttagagtttggttggggcgcgtttattttcgtttttcgtaggtatttttttcgtagtcggggtttcggcgggattgggaacgattcgggcgcggcgttgttgttgcggcgatttttcgtcgttcgtttttttttattttttcgggtttaggttgtatagcgggattgttggagatcgcgaagtttttcggttcgtttttttttttttttttttcggtggcggttttagtaaagattttttcgagtttatagcggtagtaaagttttcgcgtttatcgtcggttacgaagagtagtagggtatgtagtagtagaggcggtaggtattcgagggtatcgagtcggtttcgttgttttatttttcgcggggggcgcggtggcggcgggggttcgggagcggagaggcggcggtcgcgtgggttcggatcggtttcggttcgggttaggacgttttcgagtttgttatggtttcgcgcggcgtttttttttttggtcgtcggcggtcgttaattagtttcgttttttcgtcggtttgttcggtgcggtttcggcggggggcgttgcgcggggtgtgtaggagacgcggttttatcgggaggttgttggcgatcggttagtgtttttttttgttcggtcgtttataggacggtggggattcgcggtttagtttttgttcggcgggtcgggtaggggttgggtcgcgtcgggatttatttttggtcgagggagtgcgtgttacggagtcgcgagtttttgtttttttgtttttttttggttttgttttcgattgttatttttttcggttttcgtagtcgttttcgtcggttttttcgcggtttttttcgtagggcgagtgggcgtttagtcgcggcgcgtagatttggcgttcgatttagcgtagcgcggggagagcgggttcggcgtggcggattcggagtcggagagaggcggggagagggggaggggaggggaagggagggggcggttagtggttgggcgttaagtcgtttttatcgttgtatcgttttcgttttttttttttttgttatagttcgtttcgttttcgttttagagcgtttttttttttttttcgggggtcgttcggagggattatcgtttttttggttggagtatagtttcgtttcgtattcgtttgggttgggagtttttttatttaaattttttttggtttttttttagtttgtacggttcgagacggtcgtttatttttgtttttcgtgtgtttttcggttttttttgtagtttttagtttttaattttttattttagtttgggtaattagttgtttcgttgtttggtttaggtttgggttatgacggatgggtgggcgttcggggtcgcgagaagggcggaacgttgtgtttagtcggagattacgttgggtggcggcggtagcgtcgggagtttgtagtgcgcgagggagaagtgagcgtatagcgtttagcgagtaggtgtttgcggcgcggagagcgtatacgttagttagttcgtagcggtcgtgagtgacggtaggggcggcgggggtggggtggggtggggagcgtcgggtacgatttagggttcgggaggttttcgggagggggcggggtttttgtttttggatcgcgggtttttgtgtttttacgcgtttttcgtcggtcgtggttttttttttgttcggtgtaaagcgagatgtcgaggcggtaggaagtcggaatttatttttcgtttgttttggcgtattcggtatttcggtattttttttagtttttattcggagtttgttttttttttagttatttgagggagcgcggtttggttttcgaaggtaaatgcggggtggatatgtggttcggacgtagcgcgtagttatagttataggggcgagttttaaggttcgttttgggttttttttatttttttttttcgggagtttttagttagtgcgtttcggtatttttgtttttatttcggtttttacgttttagttttgattttaggttggggtggggtagttcggtggatttacgtgtttgttttttcggttattagtttttcggaggtatcgt

SEQ ID NO: 7153 - DNA, 3643 bp, synthetic construct
  misc_feature 1..3643: note = Description of Artificial Sequence: Synthetic polynucleotide
  source 1..3643: mol_type = other DNA
cggcgcggcgcgattagtagtcggtttcgttcgttcgtagttttgtttttagcggcggttattgggatcgattgttcgttttcgatttaggtaagatgtttaattgcgatcgcgcgttttttaagatcgtttttcgagtttcgttataggtatacgcgtggtttaaatattttatttggttcgaaaagttagtagacgggggaaaaaaaaaaagttgtgcgagtagttagtcgggtagtttcggagttcgcggaggtcgttttttcgtcgtttagtcgtttagtcgtttatacgcgaggtcggttcggggcggcgcgtagttcgcggtatttcgttttcggttttgcgcgtttatttcggggcgcgtcgaggttatcgtagggtatttatttggtatttgtttttgagtgtgtagatcgtcgcggtttttatttgggtttttaaataagttttagggagaaagaaggaggtaaaaaaaaaaaatttaattatgtaaatggatttcggattgggaggcgcgggatggatttgacgtcgttattgtacgagttttcggagtagtttcgggtcgggtagatttatgggggcgcgttacggttacgttaggtttcgtcgtcggagtatttcgaagttaattaaagcggtaatgtttatttttttggcgatttttcgtgcgtgggtttattattttattattaaattcgatttcggcgggggcgggggttttgtttttacgttttttttttttttttttggtcgtttttttttttttttttttttcgttttttattttttttttttttttttcgtttttttaagtcgtttgttttttatttagtgaataatgaataaagatgtgagtgatgggaaaagatcgtttttttttttaattttagtagagagtaaagtcggttttaaagtaaaaatttagttgttagtattaaattgggaaagaaaatagcgcgtttttagttttattattttttttatatatatatacgtacgtatatatatacgtacgtacgtatattttattttaagtttatttaagttttggttggagattggggcgttaaggttagggcgcgcggggttgtttaattcgtcggggatattagggttggggaacggcgcgtgttttggttaggcgtgtttttcgcgtttattttcgtcggtttttttcgtcggtttttttcgcgtttttatatcggtcgattaggttcggcggttcgttcgggttgttcggtcgtcggatgcgtttagtaaacgcggtttttgtcggatttttgttaaattgtatagcggcggcggcggcggcggcggttgtcgggagaaggcgtaggaggaatcggagggtcgtatcgcgcgttcgtttatttcgtttttttcgttcgtttttcgtttcggtttcgtcggtcgtcggtttttattcgcgtatacgatttagtttttaggacgtatcgggtgttcgagtttcgtaggtcgggatatttcgtagttgtcgtattttttgttaaagtgaaaacgaaggcggttgataaattacgttttcggcgaggtattcgttagatataataatatttggtaaataaaattcggtcgtcgttgttattcgtacgcggggttgagatttcgttttgttttttttcggtttttagtttttggttattgcgtttttaattttaacgtttttcgttttttaatattttaattttttatttaattcgggaacggtggatatgttttttaataggtatatagtaggaattatttataatatagaagtgaaaagggggggatttaattttttatttgtttttaaagaaagttttgtcggagtttatttcgtagagtgaagagtgagtaatataggtttttttttgtttagttttttttttttttttttttttaattttttcgcgtttcgatttttttttattttatatatattcgtttatatggagatatttatattttaaattatttgtaaaattgtaatagatgggcgcgtcgagatttggatatttttttatttattaaaggaaagtttttttttaattttaatttttttttttttgtttaaaatatatttcgagtttcgtttacgattgttttttttaatttattttcgaaaaataatgttttgaagtaaatagaaaaaggtttattagtaaagattatttttattttagttatgtatttgcgttggggggacgggaggcgtttttttagattgtattttttttagacgtcgcgtaagttttgttttttttttgttttttagagtttttacgttcgtattttttcgttttgattggttttatttttttagtttgggattggtcggtttttttttttttataatttgttatttatttatttatttattttttttttggttttcggttgggtttttaggtcgaggttcggttggggtaggtgttgcgggcgtcgtttgcgtttgtaggcgttacggttttttttggggtcgcgggttcggattttggtattttagttttgaaattaatttttcggttttagtttggttaggttttcggggtataggaggtcgatgtaattataaaatggtagattttagcggttttcggcgttcgtaagtttgatatattgtaagtattagttaattttaattgaaaaaaaaaaaaggttgtaaattattttttttttacgggcggaggggtcggaatttcgtagtgagcgcggattagagaaagagcgtaaggcgaattttcgttttaggtagaggagaaaatggggaaagttatttgagtagaagttttcgcggttttagtttatttttttttttttttattttttttattttttagatttttttgaaagtttttcggggtttgagagtggttcgcgggtcgttcgcgggtggggggcgtcggtcgggttttcggagttggacgcggggtttcgatcgcgcgtcgggcgttaggtttcgggatttttttttaaagtaacggtttcgggatcgcgggcggggaggcggcggtttaggcgtaggtttcgttcgtcgtcgaagttttttagcgttatacgatgttcggtcgtagtcgtcggttcggttttttttttttttttttttattttttattcgttgatagtttttttcgttaacgttatagttacggatatttaattagatcgtattttttaatcgcgatggggcgagaaggaatcgggcggtaggtttcgtcgagatggggagggggaggggacgggggggtcgcgttaagagtttaaatttattttgttatttttcggacgtcgaagttgtttttttattcgtcgtcgttttttcgcgtcgcgtttttcgtatcgcgtcgcgtttcgtgattttttttttatttttgttttttttattttaaatattgaaacgcgggcgttaggagtaaattcgggtacgtaaacggagcgttgtaaaagattgtgtttaatgaataatgaaatatgtttatacgattgatttgattatttttcggggttgaggggggacgggcgttttgttcgcgcgttttattcgtttattcggtagagttttgcgaattgtttttagtttagtcggggtagggcgggttcgatttttattagtttttttttagaatcgtttcgt

SEQ ID NO: 7154 - DNA, 808 bp, synthetic construct
  misc_feature 1..808: note = Description of Artificial Sequence: Synthetic polynucleotide
  source 1..808: mol_type = other DNA
cgggattttttatatttcgggtcgtagcgtattgtgcgagtggagggggtgagttttttagtagaggcgtaaggagggtgtagggtgcgcggtgtggttgtgggttgcggataggggtcgggggcgcgttcgggtcggtgtcgcgtggtgggagtagtaggcgcgtaggtagcggggagttttcgcgtatttagttcgcgggtgattattatgcggcggtagttgttttcggcgcggtgacggcgtttttaattgattttattatttttttttcgtaaggtgaagtgcggtcgttcgcggggttcgggcgcgggtagggtcggttggtagtcgcgggtcggcgggggtagcgttcggtttcggggtggtattatcgtcgggcgtcgcgttaacgaacgtaggcggcgggaggttcggcggcggggttcgcgtttttgtatcgcgatcgcgttagaaaatatttcggggttgggcggcgtttcggagacgtatttttttgttatttttatcgtttttggtaacgattattaatgttattatgttttatttttttttattttttttcgtttttagagtcgcgttcgcgcgttcgatttttaggcgtttcgttttttttggaattaataataatgatttttaattaattttttgttagggttgtttgttcgtgaatggggcgttttttcggttcgcgggcggtaggcgttttagttcgggcggggggttagttttcgttttttcggtcggattcgcgggggttcgtaattcgttcgggcgtcggttgggggtggtttcgtagttttttcgg

SEQ ID NO: 7155 - DNA, 3415 bp, synthetic construct
  misc_feature 1..3415: note = Description of Artificial Sequence: Synthetic polynucleotide
  source 1..3415: mol_type = other DNA
cgggggtttttttgcgtgtttcgatatggtagtatggttgttgcgtgtatttcgtatagttcgtgttgtgcgtggcgggttgtcgttgtaatgtgtagtttattgatattgatggatgcgttaatggttggacggatagatgttagggcggatcgtatagcgttcggcgtttgagcgggggagggttaggtagcgatttagcggcggcggtcggttacgcggagattcgagtttaggtcgcggttcgtagtgggagggggtcgaaggaatagaggtttgtaagaatagcgaggggatggaaaggaggagaaaagcgcgattagggagaattatacgttttcgtgtgcggcgtttcgcgttgtgtatacgtcgtatcgggcgcgtttaagtgggagtttcgaaggtgagttgggagtcggcgggagttgatttcgtgcggcgtaattcgtttttaggcgataggagtttagcgcggttattagaatggtgaggtcgtcggcggtgtcggttaatttatcgttttttcgtttgtaagaagcgttttacgttttacggtcgcgttttttcggtttggaggagtagcggttttggtttttgcggtcgcgggtatttaacgcgtacggcgttttagttttcgagttcgttagttcgagagtttcgtcgtagttcgtttcggattttttgtttcgtttggggttcgtattttataatttcgagcgtttttgcgcgcggaaaggcgttggaggcggttttatagtcggggaggttagcggcggcgtatttgtattttgggagacgtttggatttagtttaagttcgtaggttgggcgagcggagatttttgattttatcgtgtgggtgagattattgtttttcggtttaaaagaaaagaaagtatgttgtgaatttttgaaataaatttgtaaaaatagtcgtagagaaaaaataaaaaggatatagggtagaaaaagagggagaaagagattaaaaaaagaaaaagataaggggagggggaaggaaggaaggagagaaggaggaagaagtttggggtttgttgttttaggagcgtttaggtagtcggtgttggagcgcggggcgttcgttttcgtcgggattgtcggtttcggggtttgcgagagcgttagagttttagtcggcgcgttcgggcgtagggtcgtttcggggatagtgggttcggaggtcgttttcgcgttttagtagtcgtcgttcggtagcgttcggagtcggtttcggcgcggtcgttttattttcggtttgagagttggtttagggagacgtaatcgagttcgtagcgtatcgatgcgtcgtcgttcgcgtcgttcgggtttcggttttcgtttagtcgtcgtcgttcgggggtcgttcgtatgagtttcggtttattcgcgtttttatcgtcgttcgtaagtgagttcgcgtcgtttcgtcgtttacgtcgtttagttagtttttttttgtcgcggttagtcggtcgggtcggttcggagttttagcgatttcgattattaattaataattaatttttttagtttagtagtttcggtaggtcgggcgcgggatacggcgcggcggttttttaggttttcggggggagtttttggcgggggatgggtaggggagttcggtttttttttttcgttttcgtttcgttttaggatcggttcgcgtcgtggatggggggcgcggttcggttttcgggggcgaggggcggggtggagggattttgattattttaaagttaggagaggaaatttgaaggaatttttttttatatcgattttcgggacgggtttaggaaagtttgttcggggaaaaaaaattgggggaagtggttacggcgggttttgggggaggagttgggtggcgcggggtttgagggttgtttttattcgtttcggttcgcgttcgttttttttttggagggggtttgttcgtgggttttggttttttcgggggacgttagtttcggttcggggattacgttgggggtttcggagtcggcgggtggagaggagtgcgagtcgggtggggtagttggggggtggttggggacgaacgttgggtgggaataggggtggggggtaacgagcgtttcgggacgggttcggcggggttggcgtcgcgttttcgcgtgtgcgtacggggcggaggcggaggggcggtatttttttcgttggcggggcgggggttttacgcgggtttggggtcgggggcgggggcgcggcgttttcgcgggcgggcgattgatacgattattttttttttttttaagtttgtttgttgtcgacgtcgtcgttttagtcgcgttacgggtagaagattggatcgtcgagtttcgggtcgcggcggcggttgcgcgttttttcggatgtcgtgattttcggtttaggggcgggggtcggggtagtatcggttcgggtcgttttcgcgtttttttttttatcgttttgttcgtttttttttcgttttttagtttcgaatttcgcgtatttcgtttggggacggggcgggggggggtagggtcgtcgttttttttcgttttttttttttttggtttttggagcgatttgttaaattttttatttcgtcggtagcgcggttttttttttttttttttattttttttttttttgtttttttttttttttcgtgttttttttttttcgagtttttttcgttcgttttttttttttttttcgtacgttcggggttcgcggcggagcgcggcgcgggggggacgcggagagtttgggcgtagtagtattttgcgggcggtcgtttttcgggggggaggttgagagtaggttcgtttcgttttttcgcgggttcgtcgttttttttttttttgtttttagttcggtagcggcggcggcggcggtagtggtagtcgtcggagaagtattatgtcgaggaggaagtagtaggcgtttcggcgcgtagtaggtacgagtcgtttttttttttttttgtttttttttttttttttttttgttcgtttcgcgtttttagcgggcgcgatttcgtttttcgtttcgtttttttgttcgtattgagtaatttcgggcgtcgtttttttgtttgggtgcgtgcgttcgtttcgggtatcgggcgtttttcggacgtttcgtcgcgttttgtttttttttttttcgtatttatttggggagtcgttcgcggagcgcgttgagtcgcgttaggtttttatttttttagtttttcggttgtagagggaatgggaagtaatttcggtttggttttttttgtgggtggcgggcggggttatttgagtttttcgggatatttttcgcgtttttcgagcggtcgatcgtcgggggattgtttggtgttcgtcgagttagggagcgcgaacgagtgagcgagtcggttttttcgg

SEQ ID NO: 7156 - DNA, 3415 bp, synthetic construct; identical to SEQ ID NO: 7155
  misc_feature 1..3415: note = Description of Artificial Sequence: Synthetic polynucleotide
  source 1..3415: mol_type = other DNA

SEQ ID NO: 7157 - DNA, 1592 bp, synthetic construct
  misc_feature 1..1592: note = Description of Artificial Sequence: Synthetic polynucleotide
  source 1..1592: mol_type = other DNA
cgtgttttttttcgttgattcggtcgtttattcgaggtagtttcggaatttcggattttagttatgcgcgtagggaattgtcgggtcgagcgagtttatcgaagtagtttcgcgtcgtgcgcgtttcgagcgttcgttttagttttcgggtgagcgtttttagtcgtcgttcggtcgcgtttgggtcgttttttcggttagggggtagcgggagtgtaggtagcgggaagggagtcggtttcgtaggtttcggggagcgagcgggcgcggggtaggcgtcgggcgggaggaagttagcgtaggcgtcggtcgagtttcgggagtcgaggttggaaacgttggagcgggcgttgtttatcgaaggcggttcgggatcgggacgcgggttcgagcgatcggagcgcgggttgtcgtggcgttggtcgtagtttaggttgatgtcgttggatcgggcgttgtcgttatcgtcgtcgtcgtcggatttcgttaggttggttcgtgggttgttcgtaggttgcgcgttgagtttcggaatcgtcgcgcgtcggggatttcgtttttcgcggtttagttcgttcgtttcggtttcggggtcgtcgttgtttttttttttgcggtttagcgcgggcgtcgtttcgtttttaggtttaggtcgcggttttcgtcgttttcgatcgggagagtcgtattcgggttttagttttcgtagggttagttcggttaggagtagggtcgtttcgttcgcgttcgttttggagcgttgtatggttcggttcgtcggttttggcgcgttattttcgttttcgtttttcgtcgtcgtttcggtcgggtcgtcgtatcgttcgttcgaagttcggagttcgtttcgggatttttgggcgcggggcggggcggggtcggcgtcgggtcggggtcgtttcggcggttacgcgcgggtcgggggacgcggcgttttgttcggcggcgcgcgcggcggaggaatgtaagtttttaggcgtcgggtcgcgtttttttttcgtcgcggtttcgcgcggggcggagggatttttttgcgggggtaggaatgcgaggaaggagacggcgttgcggtttttggaatgtggggggagtggcggcggtcgcgttgcgtcgggatttcggaggggcgtggaggtcgggttaggacgtaggggcgggcggcggaggtatcgcggggagagtttagggtttgcggggcgttcgggtcgtcgggtcgttgggaagagttcggattttcgtaggttgagttggaggtagttggcgttattcgggtcggagagatttaagtagtcgatagttttttttatatttcgttttattttttttttttgcgtcgttttgtttttcggcgttgtagggtcgatttagtttagtttggaatttacggcgtttcgttcgtttcgcgtttaggaatattgtgcgtttagcgtagatgcgtttttacgattttttgtttggttcggggttatgtggtcgcgtatcggtttttgaagtttttatttgattgttggggaaggcgtttagaattaggagcgggttggttggggattggttttcgcgttgggtcgtttcgt

SEQ ID NO: 7158 - DNA, 903 bp, synthetic construct
  misc_feature 1..903: note = Description of Artificial Sequence: Synthetic polynucleotide
  source 1..903: mol_type = other DNA
cgggttcggttggtttttagtaggtttgtcggggtttttgtattttgtgttcgggatttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttcggggtttggggagggggttgggtaggggcggaagcgagttggagtcgtgtttgtcgcggcgttgcggagtggaatagatggttggggaggggagagggtgcgtggcggggaggaggaggggtgcgggggtcggaggatagggaacgaggaatttcgaagtttggagttttttaggagaagttttttttttcgtttttttttagaaaggggggtatatatgcgtttgtttttttttcggagagttttggtttttgttttgtggtagattttgtcgcgtaattttttgttttagggcgcgttttttatttttaaattttcgtcgcgggacggggtggcggggttaggatcgttaggagcggttcgggtcgcgagggttaatggggtcgtttttttaggggcgaggaggcggcgggaaacgggttcggggtggggaacgagttttgggatcgt

SEQ ID NO: 7159 - DNA, 1592 bp, synthetic construct; identical to SEQ ID NO: 7157
  misc_feature 1..1592: note = Description of Artificial Sequence: Synthetic polynucleotide
  source 1..1592: mol_type = other DNA

SEQ ID NO: 7160 - DNA, 382 bp, synthetic construct
  misc_feature 1..382: note = Description of Artificial Sequence: Synthetic polynucleotide
  source 1..382: mol_type = other DNA
cgttttttatttttaatcgcgagataatacgggttagaggttaggaaattatgttagtattaatgcgggcgtttacgagtgcggtggatcgatgtggaagggtcgggacgtagttcgagttttagttttcgtcgtagcgatggtcgattttttagtcgcggacgttgaaagcgaggattttacgtcgatgatttttcggcgtattatgttcggcgggcgtttggttaaatagtttaagattgcggaattatattcgttattgtgtatttggacgttatttgtagatttagcgtttgcggggatttcggaaacgggagagcgggttttcggaaacggtgattaatgggaaacgtgattagatgttattaggcgaatagttcgt

SEQ ID NO: 7161 - DNA, 665 bp, synthetic construct
  misc_feature 1..665: note = Description of Artificial Sequence: Synthetic polynucleotide
  source 1..665: mol_type = other DNA
cggggaagtagggtcgcgaaggtttttgggaaatgtagttcggcgtaggaagtagcggaacgattcgattttttttagtattaagttgcgtttttaattttttagagttgggttcgcgggaggtcgttcgtgtaaaatttaggttgagtttttttgcgcggagttgtgagttttggaatatcgtggtttgttttttaggacgcgtaaatagtgaagttagtttcgttcgggtgagtcgcgggggtttttgggaagcgtcgtttttggtgtaacggatcgagatttgtggcgtttttagttatcgatagcgtcggttttagtgtcgtttttgttttagttcgcgtcggttttgttattttggtagcgttaagtgtggaatcggggtttgtgttcgcgggtttggtggtgagttttcgggaaatcgttagttttgagcgtcggattttttgtgttgggtgggagtgggggttcgcggttttggtgttttaatttttggaggaggacgtcgggcggggcgatgtttgtgtttgtggttttttgaggtagtgggagtggcgtgtgaaggattgtgagagtttggcgtgaagtgattgttatttgttagatattcgtttggttgagtgtggtttcgggatcgtgttcgtaagcggatttcgtggaggcgt

SEQ ID NO: 7162 - DNA, 764 bp, synthetic construct
  misc_feature 1..764: note = Description of Artificial Sequence: Synthetic polynucleotide
  source 1..764: mol_type = other DNA
cgcgggtatcggtttaataaggtgtagcgaatagtcgttcgttttcgttttaatttatagttttatattttacggtgttattgattttttcgtatttagttatataggacgtggataggtatacggggtgatagtttcgtattgaacggtattaatttttattcgtatcggagttatatagatggtttgcgacgagttttcggagatttatacgttattttttagtttattttcgatttgtagaatagaattggtggaagattttttttttgtttcgaaggttcggggaatttgtattcgggttttatcgttatttttagttggatggaatttagtttttacgggttcggaaagaagcgttttagttgttttcgttttcggaggatataaaggggtcgtcggtttaattttcgcggggttcgttgggaaacgtagttcggagtagaaaaggtcgcggcgtcgtagtgtttggtagtagcggtgtagtttcgcgtagggtttgtaatacggttttttttttattaggtttttttatattggttttttttcggttttttagagagttcgaaagttcggattttttgtagtttcgagtttggttcggttatagggacggggtttagcgttatattatacgggttggtgtggaagtgcgtaggtataagcgttttgcgcgttttttttagtaattagggcggggagttgagaatcgtaggttggtcgtagggaaaaggtttgtgcgtgggaacgcgttagtggcgcgt

SEQ ID NO: 7163 - DNA, 1394 bp, synthetic construct
  misc_feature 1..1394: note = Description of Artificial Sequence: Synthetic polynucleotide
  source 1..1394: mol_type = other DNA
cgatgttaggtacgttataaacgtagatataaatcgtaaagattttagagattcgttatagttagcgttagagttaggtattatcgcgtagttttttttgcggtattattttaatttttcgttagagaacggtatacgcgtacgtagtagtttcgtgtacggaaatattatttcgttagcggttaggtattcggtttaggtacgcgggggcgcggcggtcgttatttagtaaatattataggtagtacgcgtcgcgttttggtttaggttcgcgatattggggttttttttatttaatttacgttagggttacggttataggtttagatttgaatattttatttttatcgggattttgtagttaatttttatttttttttaaatttttcgatttttcggtaggtgcggttttatattttttttttgttttttgaagggttttagcgttcgtttttcgcgcgtttgcgtattcgaggtagaagtcgatttttaaaggtttcggtgaggcgtcgttgggggcggggcggggttcgtagttttcgtttgttttcgagtcgagaattaaatgaaaaataaaaaggcggaatattgtttttttaaattttggatcgtagtgtttataggggagtaggtttggattatttttaatggtattggttagttacggggcggttattataggtagaggtttgaggcgagggatattgcggtttttttggtttcgttttttcggttcgattattttcgtcgagattcggttttacgcgtttttttcggttcggagtagttgcgggatttgttttcgttttttcgcgcgttagcgtattcgcgacggagataggcgttttttcgtattttggcgtcgttgatttttagggttgggttattttttgagtcgggtgaggttggggttgggagtcgggcgttattgtggtcgttgtttttttgagggaaaagagcgcggagtgggttaggttttgtaggtcgggttaaggtggagaaaaggtttttgtggagttttaggtcggtgtgttttttttttcgggattgagtttttgtagttttgaggtttggaggttcgggcggtagtaattgtgtcggattaggttcgtgggtgcggtttgtggtgtagttggagatcgaggtttcgcgtattttcgttcgcgttttagttatttaggttcggtcgtagcgaaaaggtttaagagggaagttagaggtgaacgttttaggatgaaggttttttgtaaaacgttgggatttagatttggggtgggtgtttggggtttaggaggatacgttggatagtttcgaaaagatatagtgggtggtttcgggcgtgggtaatcgggtgcggaattatagcgtattcggagttgcgaatttagacgcgg

SEQ ID NO: 7164 - DNA, 949 bp, synthetic construct
  misc_feature 1..949: note = Description of Artificial Sequence: Synthetic polynucleotide
  source 1..949: mol_type = other DNA
cgttttagcgttttcgagttatatttgtgcggtttatttaacgcgatgtttggacgtagtttttagagaggaggtcgggattggaatacgtagtcggggaatggttgtaggtggtttagttttcgttttcgtttcgttttcgtttgggtttcgtgcggtttcgggtgcgtaggtgaaagttcggttttagcggtttcggttttgttatggatttcgcgttcggcgttttagattttcgcgtcgcgtcgttcgcgtttttgggtatttcgtaagtcgaggtgttggaggacgtgttgcgggagtagttcgggtcgttgttttagttggtcgttgtttgtcggtttaagcggttgttttcgggcggttattcgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcgaggttttttacgtttttagtttgttaggagaatggtagtggttttttttttttgtattttcgtgtagttgttcgttggcggtcgttgcggtggtcgtttcgttcgttaattttttaggatttgtgtaggattcgggtttgggaggggatagaggaggggttttgataattttaaaaatgtttttttgggtaggtgttttaaaagtttcgcgtttagggggtgcgtttttattttatatcgtaggcgttggtgggtgtttgggacgcgtagggatttttttcgttttttttttttgttttttgtatttcggtttcgaagtatatacgagggtgaggagaaaggggggtttgacggaagtgattttttttttttaaagtaacgaaatacgacgt

SEQ ID NO: 7165 - DNA, 1365 bp, synthetic construct
  misc_feature 1..1365: note = Description of Artificial Sequence: Synthetic polynucleotide
  source 1..1365: mol_type = other DNA
cgtttaatagtatcgttcggagcgtttatttttttttatttcgtaaaaaaaaaaaatagggttattggttcgggtcgagagtcgttttgggaagcgtttttgttattaagcgttatttcggggtgtgcgagggagttaagggacgcggagatcgggagtagggttgggtttttttgtagttttagcgttggttttttgtttatcgtatttaggcgttgcgtcgtttttatatttatttttttttattttagtagcgtgcgggggaagtttcgcgtcggggttttttttagtaagattgtcgcggttttcggttttaattgtaaggtaaacggtggtagagtttttttttattttagtcgtgtgtgatttttatatttagtgtttttttttgtattggggcgtcggtagtggcgatttaggttttttagttttcgtttagtttttcgcgtgcgggcgtcgggatcgtagtatttgtgacgtcgaagtttagtaggtcgtagacgggagttacgcgcggttttggtatagggtaaaaatttacgtttaggtaggcgggtagttacgatgtcgggtaagtttagggtagattttcggtggcgtatagggaagtagcggtttagaaggtcgggtggacgtaggcggagttcgacggttgggaggtcgtcggcgcgtaggggtcgggtttcgttaggatggtttcgatcgagaaaggggattcgaagcgttcgggagcgcggggcgtgttcgggttagtaggggatttgggcgtcggagagcggttagagcgcggaggtcggattcgagagttcgagggagcgggtggcgggttgtttcgcggtttggggttaggtatgacgcggtcgttgttcggacggacgtaaggaagggagttcgggagaagtgagaagattttgtaaaaggtagcgagtaagatcggttgtttgggaattttttggcgttcggcgaaggtttttaaatttggcggggcggggtatggggcggtttttttttattgcggttcgggcggggtttttaaagtttgtgagcgttcgttttgtgcgaggtaaggtgggtatagtattaaagagtgtgtttttttttttttttcgtttttaaaaatgtttattttggggcggtcgtggggaggattttgagttcgttggtgattttgggcgaaatatttagttatcgggtttcgttttttttttttgtttattgaagaagggatgttcgttttttcggggttttgtagaggcggagttgtgatttggagagcggtagggtagtgtttgcggttttggttttagttgattcgcgtcgtttttgacgtagaagtttcggttagatttatttaggatcgcgcgg

SEQ ID NO: 7166 - DNA, 2638 bp, synthetic construct
  misc_feature 1..2638: note = Description of Artificial Sequence: Synthetic polynucleotide
  source 1..2638: mol_type = other DNA
cgtcgatagcgaagtggtaggtaatgggaatttgggcgggaagtaaagaattattacgatttatatcgcgtttaagtagtagtacgcgggaatttggtatatagtaggtaggcgtttatttaatatttgttatcggatttagtatttgggtagggagtttaggggtggagtggcggtttgggggatataaaggtttcgttagtttttagttgcgtttttcgtaacgcggggggcgggagtttagagttagagagagggggcgaaggaattcgtttttatttgtacgtcgtttggggttcggttaatttgtttaattatcgttttaaatgttagcgggtagtatataatacgcgtttattaataggtttaaagtgtcgtagcgttcgttttaaatgagaaaagtaggcgataaaagggggaaaaagttaagttttttaatttgaagaatgttttgggtcgtttcgaaattatttacgcgagtttaaaattcggagttagtttcgtagaaaagttgaggtttcggtgcgagggttgggggtgggaacgggggttgtgaataattcgttacgaaaattgggttttttaggaattagtttgtagtcgtttagtgaattcggagtcggaggataacgtcgttaatttagttttttaggttttttgttttattgttagagaaagttgatcgatttttaagaaggaaagcgagatttttttaaagcgggtataaatttaagtttttttcggtgtaggcgaagaattttggaggttaaggaagattttagaggtggattttaaaattttaattcgtaagaggggaaaagttaaagtaattttatttttatttaggtattggttagcgtagtttcgcgttcggtcgttagagagtagtttaatttcgtaaataagttttgtttgggatcggcgtagaaggttttattttttattttatggttaagttcgggggcgtattttgcgggtcgcggttttttatttttttcggcgcgttcgacgggtatttacggtgcgcgttttttcgggagataggggttcgttggagaggtacgggttgtttaggttcgggattattaggaaggggtatttagggtacgggggttttttaaagaacgcgttgttttgaggtttttttattgcgaataagattaaggcgaggtgaggtttaggttttcgggattgatagcgtcgcggtagggggttcgaggcgggagttggggattttagcgttttttacgcgcgttttacgggggttgtcgttaataaaggcggagggtaagggtgcgtttatttaagtaagggggacggtgggtcgttcgggttgagtagcggagcgtagcgggaatcgagagtggggggttgttttagcgggtatatattttcggcgaaatagtttcgcggtttttggaaagtgtttcggacgggttgcgggcgttttttcgtttgcggaggagatataaaggtaagagcgggtgagcggacgtagggtcgggatttttcgggggtggtcgcggtgtttttttattttcgagttcgagttgttgttttggtttttcgattcgttgattagggacgatttgatttcgtttaggtttcgttgcgtcgaggcgttatcgttgttcggtttttgtttttcgtttttttcgttttggaaggggattagttcgtcgttcgtttcgaggtcgtttttttcgtcggtcgtttcggcgttggagtcgtcgtttttttcgttgtcgtcgtcgtcgtcgtcgttttcgtcgtcgagttggggtatggtggggtcgcgggtcggggtcgtcgttttcggagtttttagtcgttcgcgttttgttcggttcggttcggcgtttttttcgttcgtttgcgggttcgttgcgttagtcgtcgtaataaagtttgatagggcgtggtttcgcgggaagcgggttcggcgttgttcggtcggggcgtaggcggttcggttcgggttttttcggtagcgtcgagtttagggttttttaattcgttatcgtcgtcgtttgtttcgtcggggcgttttagtttttggttcgtcggggaggggcgagcggggagggagggaggagggatcgtcgggttgggtaggggggtcggagggaggagtttcggttgtaagttgatattcgcgcgtttcgcggaattcggagagttgcggtgcgcgcgtatatatatatatatatacgtatttatatttatatgtttatattcgtattttttaggggttgcgtttttttgtaacgtgtatcgtttttaatttttttttgcgttttatattgtattttcggcggttttttttacggtttttttggagttttggaagttttgcgtttattttttcgtattttttaatttttttttaaagaatttttagaatttcgcgtaggtttttatttttttttatcgtatcggcgcgcgggcgggcggtattgttttttgcgggaaagtttcggacgtatatattggtcgcggggttttttttttgtttagagttttttcgagtgcgcgagttgatgtacggattaggatattggggatatttatggaatttcggaaaatgttcggcggtttttcgcgttttttttttgtggggttttaacgcgattttcgg

SEQ ID NO: 7167 - DNA, 1531 bp, synthetic construct
  misc_feature 1..1531: note = Description of Artificial Sequence: Synthetic polynucleotide
  source 1..1531: mol_type = other DNA
cgaaagttcgtataaatcgtatagaaaacgaataaatgtttttcgaatgtgagcgaatttatagtttggttagaaaaatttaatattgattttcgtttttttaattatagaattttcgaggagaaggggatacgttaagcgggtttgttaataatttttatcgtatattttaaagcgttgtaaattatatcgattattttcgattggaagtcgatcggttgagattggacgtgaatttcgcgattcgattataaaaggttaggaggaaagaggtagaaaagttaaaaggatgattaggtaggtggttcgagcggttattttaagttaattttttagaaattattcgtattgttcgggttattttttttttaatattcgtggttttatttattatgatgttaagaaacgtgggttaggaatggggtgttgttttttgttcgaaatttggaggcgtcggttttttagacgttttcgggttcgggtagaggggcggtaggggcggggcgggcgggtttcgggtttgggcgcgcgggtaggtggggcgtggcgggggcgtggagagtttaggttcgcggttatcgtttcgtttcgggtcggtttaggaggagtcgcgtcgggttcggttataagaggtcggttagtaggcgtttcgttagtattcgttcgatttcggttcggagtatcgggcgtttagcgcgggtgaaggcggagtcgtagggttggtttttaaagggatgttttcgttcgagcggcgagattagtttcgttcgtttttcgtcgcggtcgcgtcgtagtcgtttacggtcgtcgatatggttttttattgcggcgataatttcggagtgtattcgtagttcggtttgttttcgttcgtcgttatcgtcgtcgtttcgggcgttttttcggtagttagggcgttttacgggttggtcgattacgtcgcgtcgtcggtcgtcgtcgttaatttttatttgtggtttaacgggttcggcgtgggaggttcgtttttcgtcgtcgtcgtagtcgtcgtcgcgtatttgggcgtttcgtcgtcgtcgtcgtttttcggggtcgcggtcgggttttttttgtagttatcgtttgtcgtcggtatttcggttgtttttagcggtttttcgcgtagttcgcgttcgtcgcgttcgtttcgttcgtcgcgttcgcggggttcggggagttgggttggttgtttatggttagtcgcgaggatttgatgaagatggtgcggtcgttttattcgtattcggcgtttatcgttatggttatttagagcgcgttcgagcgtaaatttatttttagttatatttattagttcgtcgtcgatagtttttttttttattagcgtagtaaggtcggttggtagaattttattcgttataatttgtcgtttaacgattgttttaagaaggtgtttcgcgacgaggacgatttaggtgagggtcgttggtaggtgttttttagtcggggagggcggacgcgggtcgtaagggtcggcgtaggggtcggtgtgcgg

SEQ ID NO: 7168 - DNA, 2045 bp, synthetic construct
  misc_feature 1..2045: note = Description of Artificial Sequence: Synthetic polynucleotide
  source 1..2045: mol_type = other DNA
cggcgttttcgttttgtttgtatttttttttattgtttttttacgtttggaatgttttcgtttttgtagtttgtagatagcggaaatcgcgggtgtaaatgtgtaggggtcgttgatatgatcggttgtagaagtttatttagggttattcgaataggttagcgttcgggattgtataagaggttaggcgatgttgtgggtttttaaatttgtatagttgcgatattttgcgacgtgttattttatttttagtggggtggggtgggggatttttttcgtagttcgttgaaagcgaggtaggaattattgtaatttttttgtttaggttgaggtcgttatcgtttcgcggatgtacgcgttgtaggggcgtttttcgtcgcgggtacggcgcgggaagggatggggtttggtgggagtgggtaggtggcgggagaggcgcgtgttcgtgtattagaggttttcgtgcgtgatataggtcgatgagtttttgcgggttgtatttacgcggagttatagatcgaaaaggttagtcggtggtcggtgtgttaatatatatagagagacgttcgttaggcgcgttgtaggttgggacgaggttaggagggtttaggttggaggagggttgaggagggttgcgggggcgggtttcggcgtagggcgttcggagcggagggggcgggttcgaggcggggcgggtcgcggcgttgacgggttgtcgtcgttgtattcgtttttagttcgcggtgtcgagcgtaggcggaggtatatggtttcgacgggaggcgcgcggcgagtattcggagttcggttttttgtttgagtacggtagtcgcgttttcgttcgcgcgttttcgttttttcggtcggtagttcgcggatatgatcgtgtagtttttttttgggttgggatttgtttgaagattttttttatggaagcgatgtttttttagtaggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagttagggtcggcgatgtttgttcgggagcggtagtcggcgttgaagaaggtaggtagcggggttgcggcgttggtgggttcggtttttttatttgttcgtcgaggcgcggttgttttatagtagttttcggggggtagatatggggagtattgttttttatattagggttttggatgatttcgggttttttaggtgggggttatagtttgaggggcgattgtggatgataacgttcgatattacggggatatgtaggttcggttgggtttagaatcgagtagggtgggggcgggtgggttgtggttgggggttttgagggttgaggtgggggattttttttttgtattggtttttggtttttgggattttggtcgggttggatagggattcgggtgtcggtgtgggcgtgggggtagcgcgtgttttttgttaaagttgggagagggatgtaggtgataatttgtagcgttttatttcgataaatacggtcgttgtgttgcgggaggatttcgattcgggttaggtttcgttggaacggttttttgagtaagtgtacgtgggtcgcgggttgtcggtttttgtcgtttcgt

SEQ ID NO: 7169 - DNA, 476 bp, synthetic construct
  misc_feature 1..476: note = Description of Artificial Sequence: Synthetic polynucleotide
  source 1..476: mol_type = other DNA
cgggcgatacgttttgggagggcgggttggcggtttttttagttcggagcgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcgaggttgagaggttacgtcgtgttgttggggtttttcgtcgattatatttttgggcgttagttcgggtagagatcgcggggattggttaggtcgggttaggtcgggtcgggggagggtcgcgttttcgggtttttgattttcggcggcgagaggaagcggtatttgggttatatttttttcgcgcgggtcga

SEQ ID NO: 7170 - DNA, 455 bp, synthetic construct
  misc_feature 1..455: note = Description of Artificial Sequence: Synthetic polynucleotide
  source 1..455: mol_type = other DNA
cgtttttgtttagcgaggatcgtgtagaagcgggaatcgggtattggagggcgcgcgcggtacgcgtatttcggttggtattttttggtttcgcggggtcggaaagaatttcgaatattcggttttaaaaggtttttagttatttcgttttttttattttttatagtatagatggggaaattgaggtttggagaataagcgtggtatatttagggttatcggaagagtaatgagttgaattagagaggaggaacgggaagcgagatttttaagtaatgcggggtggttttcgggttatcggaggaggtatggtcgggtacgtttttaagtttcggtattcgtggtggttgtgttagtcgatatgagtttttttttttttaggaaggcgtaggattcggggaagttttcgcggttaggtcgtttgtttattcgtagatttcgggcgtcgttcgcgt

SEQ ID NO: 7171 - DNA, 749 bp, synthetic construct
  misc_feature 1..749: note = Description of Artificial Sequence: Synthetic polynucleotide
  source 1..749: mol_type = other DNA
cggggattcgagttttcgggttgaggatcgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggtttttggttaggttaggggggcgggcgtgcggcggggtcgggtcgggtcgggtgcgtttagcgggtttcgggtatacgttttttatttgggcgaggttcggtgcgtaggcgtttagcgcgggggtagcggtcgggcgtttaagttcggcgcgggtaagagttggatagtttaggggtcgcgtcgggtcgagttgtcgttcgcgttatttttatcgtcgtcgttgttatcgttatcgttatcgtttgggttgtagtagatcgcgggagaacgtttgcgcgaagtttcggtgtagttttggcgggatcgtagtaattatcggagcgtgagtaatagtttttcggttggaggagttattgttttacgcgttcgcggttcgcgcgtcgaggtaagttttgggcgtttagtttagatcggcgttttcggattgggcgttttttgtttgttcggttttcgttttttttcgtagagcgagtttgtatttgggcgcgtcgttcga

SEQ ID NO: 7172 - DNA, 1134 bp, synthetic construct
  misc_feature 1..1134: note = Description of Artificial Sequence: Synthetic polynucleotide
  source 1..1134: mol_type = other DNA
cgaggagggcggggcgttcggtttttagtcgcgcggttatcgtttgtttagtttggttggatttgagttcggttcgtcgatcgttggtcgaggcgtagttgaagtagttttttagtcgcggcgtttttattttttaattttacggtttttgcggcgcgggcgcgatgtagttggttcggggtgaaggtaaggcgcggggcgcggggcgcggggtattgggagcgaggtattggcgcgggatgttcggcgtaaggtgtagggcgcgggtcgtttttttttcgcgtttttttatttcgttaaagtttttttacgatggtttttatttcggttgggttagtttcgtaattttcgtttgttttttgttttttttttttttttcgagtcgcggggttttcggggcgcgcggattttcgttaggggtcgtgtaggcgcggagttttagtcggtttgttttgggttcgaagaaagttgtggtttggagttagttttttttttacgatttttgggggcgtttttttttttttttgagttcgcgatgggaaggcgtttttattttattttcggggtttttgagattttttggcgaggtggggcggcgcggtaggtgtagggttggggagggtttgatagttttggagagtgttcgattttagttcgtcgtcgttttttaggcggattttttagaggtaggttttagttttcggcgcggggaggcggcgcgttttagaggggcgtagggtgcgcgggggtcgttggtttttcgggtattttttttttgcggttttttcgttttttttcggagttggtgtttgaggtcgttgggattttagtttggcgttttttttcgtttcgagcgaggtaggtgtcgtgggcggtttcggttatttttgtatttcgagcgtttattttgtatttagttttaagtcggagagttttggggatagtcgagagtgttagtggttttatagggagattgagggttttgttttatttcgggcgtcgtgtgggtttgggttgtttatagtatttttgcgttttagtgataggagaagttaagcgcgaggttttttaatagttgcgtgtattttattttttaggtatttggaatttcggcgtttagaacgtgtttttcgg

SEQ ID NO: 7173 - DNA, 1645 bp, synthetic construct
  misc_feature 1..1645: note = Description of Artificial Sequence: Synthetic polynucleotide
  source 1..1645: mol_type = other DNA
cggcgtttttttttcggaaaggacgttggatttagggcgcgttagtacgcgtagtagcggttcgcgagtcggtaggtgggtagtttcggcgcgggaggaaggggaagttatttttttttcggaagagggcgttggtttttttattttgtttttataataaggttatcggaggagaggaagtagttagttgtcgtttgcgttttgtaaagtatgtagttaggggagtagtttttggtgagtttagtgaatttgtttggcgcgtatttttattcgttggagagtgcgcgaggcggtagcggcgggagcgttggttatttttttagcgcggttttttttttttagaagttggatttagataaagcgtttaagaagtttttcggtagttttttttgcgaggcggtgagcggggagttcgtagtcgttagcgtaggggttttcgcggttatgtttagtgatatcgacgtcggggacgtatttgttagcgttgcggtagtggttaagtcggggttttcggacggtcgtaagggttttttttgcggggaggaggagttgtttttcgtcgttgtagtcgtcgtcgtcgtcgtcgtcgcggttgcggttattgtgcgttattttatggatagtttgagtttcgagcggtattatttttagtttttcggtttttaggggtcggagttggttgcgttttgtttatttttttcgtattaggcggcggttggggcgttttacggatttgtgtattcggtttttaacggggcgcgttatttttacggttttatgttgtttttcggcggttttttcgcggttgtgtgtttattcgggagggcgtagttcggtttaggagtcggtgcgggtagtggcgcgggcggtagtagcggcgggggcggcggttcgggtatttattagtatagttagggggtttcgttttacgggtcgtattttggagtcgtagcggcgggattttgcggaggattggggggtttgggggttttaggttttggttttcgtgtttacgtttatttgtgtaatcggtttttgtggtttaaattttatcgttattaaattgagatgattattacgaaatagggtaggtgagcgtagcgtggaggggtttttgggttcggggataaagggtgacgtgtggttttggggaaggttcgggatgagggagttgaatttagttgtttcgcgcggtgtttagagtgttttatcgcgcgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcggcggtatgtttgtgtatgtttgtatgtcggtaaggagttacggatagggaaggtttaagagttggttatttgagcgtagtagatgggttttcgtagttttaggcgttagggtttttacggggcgttttcgggaggtgggtatgaaggttagagcgtcggtttcggaagttcggtcggagtaggtggttagatttgttttggagttagatttggttcgggttcggtgcgcga

SEQ ID NO: 7174 - DNA, 4698 bp, synthetic construct
  misc_feature 1..4698: note = Description of Artificial Sequence: Synthetic polynucleotide
  source 1..4698: mol_type = other DNA
cgtacggattcgcgttcgtattcgaagattttatacgtttttcgtattgtttttatagtattttacgttcgcggtgtacgtttatttgtcggtagacgagttatacgtttcggcggtttagattttcgtgtcgattttcgtgggcgagtttacgcgttgggtgttcggcgcgtttttaggagtggttgggatcgcgggttggcgtcgggtagggcggtgggacgtttggagtcggcgggaggagtacgtttaggcgggttcgcgtcgagttcgagcgagcgggcgagtcgggcgggaggggttatttgtaatcgagtagacgttattatcgttttttattcgcggggggcgggggcgggcggttaggtgacggcggtttatttttcgtcgtcgagtcgggtggtttttgttcgggaggagttttttggcgcgttttgattggaattttcgtcgtagtggcgggggaggggggatacgtgatcgttcggttaggcggttcggcgcgttttattcgcgatgggtattttattttttttttggaaaagtcgggggatatagagaaggcggaggagtacgcggggtgtaggagagtttattagtttttttagtcgtagtgttggtgatttcggtcgttgaattcggagaggaaaggtttttacgcggttagtcggttttgattgttttttcgttttgtttttggtcgtagtatttttttttcggttgtagtaatcgttttttatatttttaggtaagggtacgtttagtgtagattattgttattttatagatgttagtgttatttaagagtggtgttgggtttttttttttttttttttttttttttgtatattagtatattgtattcgagagaaatttacggcggtgtattgtagatatcgtttagttttagggttcgaagatttttcgattaggtttcgggatgtttgaggttttttaggttattacgtggaggaatttaggtttgttttttgcgtaggaggaggaggcgtcgcgggagttgtagttttcgattttttttaggaagtcggtcgggtggaaggggagagggtcgttatcgtggtgcgaatttaattcgtagtttttgggagtacgttgttaataaaggttaaattaaaataattaagtggtgtcggtagggacgcgtcgtatggttaggagaagttcggttattaattatttataaggagtattgtttttttggtgtgggagaatggggttgtgcgatagtttttcggagttgcgttttgttttgaattttaagtttttttagagtaagtggattgcgtagtttattattttatttttttacggtttttttttggggcggtattattttagatggtaggaattcggagaaaatgcggtgttacgttcgtcgttatgttcgtatacgcgtttgcgttaattttagtaatacgtggggatcgtgaatttgggcgtttgttttttatttaggtggttatgtgggtatatttatatgattattgattaaaattaaattggacggagaagtttgtttttatattggatttttttaaatttttgtttaagggagttttgcgttcgatttgggcggggacgtagtttttagttaagatcgtcgtagcgtttagtagagttcggggatcggtggtggtggtggcgggatggggaggaatagaggtttttgattttttggtattttattttttttttttatttagattagtcgggtaatacgtttttcgtttaagatggtttttttaattggaacgtgatttagataatgtggaagttaggggtttttgatttatcgtatttgggtttcgttgggtataggataagggttgggtaggtttatttggaaagggagtttattcgtaaagtttcgggtataaacgttagatagcgaaattttgaggaagtttaaagtttatttattgtaaattggtggggggtgggggagtattttatgtaaaaaggaacggttttattaaattagtaagtattttattttcgtagtggacgttttgttgtttttggttttttttttttttattttatttttttaaattattaaggttggagaaattttataaataaagtataagttcgtggggggggggggggggggttatttggtgttttaaaaaaataataataataaacgatttttgtaataagaaaggtgggtacgtttttatttttaggttttaattttaacgttacggttacgttaaaattgaagttgattgagataagagaattttagagtatagtacgtagatagataattttataattaaaaaatatgtattttttttttttcgttttcgttattttttttttttttcgttattatttattttcgtttggattaggggttgggagaggaggaggatgtagttttttcgagtgtataagggaggcggcggggttatttgttgttgtatcgttagaagagttaatttcgagcggatttggtagggagttaaaattttttttttggatgcgacgttttagagatcgaggtagacggcgagaatagatttagcgtttcgagatgtgttttttaatttgaattttggattatttttgtttgaaatgttttgttttgtacgtttgggaattattttgtgcgattaaacgcgtgatatatatacgtatacgcggggtcgtttcgtaggggggagggtgcgtggtataggagtttcggatttttaggggttttgtatttggggagtggtgcgagggggatcgtttcggtgtggttgttgacgtgagataggtaattcggaaaggttttttttcggttgttttggtaatgggaagttgtgggtaaaggtgtaggggcggtttcggagcgtatacggcgtagttcgtagtgaagggtagtggtgtggtggggtagagagattagataagggtaggcgggttttgtcgatttcgagtttattcgtttacggggttacgttttgttgagaaaatgcgcgatattcggtagggagagagtgatattgattaagtgtttttggagggtcgagtcgtttgttttcgggagggggtcgcgaggttcgttagtattcggttttcgcggaagttgtgttagcgcggtagtttcgtcggcgtttggttttattagtttttgtttttagcgtttttcggtggtatcgttcgagatttgcggagtagaagtcgaggatacgagtaattcgttgtgggtttgaagtgattacgttttagggttgtgaaaagttgtttcgtggtgatttgggtacgaggaggttaataaagtgtagaattagttttgatttttatttaaaatgaagttggtagtattgagcgtttaaatgatttcgttaggattttggaggttgtgggagcggggtgggagagggtaaatgttaggtttaggataatataggatatgtttaatttaaggaagttttttttttcgggttacgttttttgtagttttatttaattggaatcgtttttgtattcggggttattttcggtattatgatatttagcgttgttttttaaattttaagttttcgcggttatattttttcgtgtttgttggtattagtaagagtttttgtttgtttttttttttttatatggatttttttttttttatttttagatcgtagtgcgattggtaggtattttttcgtttttttcgcgtttcgcgtcgacggtgggaatagtagcgatagcgcgatcgtagttttttagtgttttcgttttttttttcgcggttatattttatttattttattcgttaaatttcgtatttcgtcgtcgttttttttttgcgcgttttcggcgttaatttagttagaagcgggtggaagttcgggtttatgtgtaggtgtttttgtgcgggagtaggggagtttataggttagcgattcgcgattttattttgtttttagttcggggtttatttacgtggaattcgtcggttttcgcgggtatttaatattagtttttcgggttcggttgtcgttttttcgaagttttagggcgtttttacgggttaatgattattttagtttttttttaagttagggtttggttagttgggaaattttttcgttttttgtttatattttttggtattttcggataaagttattcggtttttcgtttcggtatcgggaaagatgcgcgtggagagcgtttttaggcgttgggttacggtttcggtttttggtcgtgtttgttgtgtgcggagttggggcggcgggtatcgtttgcgcggggtaggtattttattcgtcgtttttttagtacgggtattcgatcgtcgcggcgttgtaggaaggaggtttcgtcgcgtcggtttttttatatttacgtgtttttcgtgtgcgcgttttcggtttgtagatgttataaggttggcgtcgtttggattttcgggcggttttatttttcgcggtcgttacgtttcgttttttgtatttagtttttttggcgttttcgttgtagtatttaagattaggcgtcgtttttgttagtcgtgttgtttagtacgtttgagggtcgttgtcggtaggttttatttttcgttcgggttttttatttatttttttttttggacggtggggtttaagttttgtattggggttgttaagttatcgtttacgattttttgtagggtgtagcgggagggcgttttcgaggcgt

SEQ ID NO: 7175 - DNA, 462 bp, synthetic construct
  misc_feature 1..462: note = Description of Artificial Sequence: Synthetic polynucleotide
  source 1..462: mol_type = other DNA
cggttcgtaaattgattatgaaatatacgatgttaattcggagttgtattttttagttgggtattttcgcgcgttggttttcggggtttcgttttttattttttgtttttttttttcgcgttttgtttttattttttatttttcgcgttggttatttcgtttttttggtagtttttggcggtagcgcgttttattcgttttcgtgtttttttcgtttatggaattaattttggttttatttgttgttcggtttaggttggggagaggacggagggtggtcgtagcgggtttttgagtgaattatttaggagggattgagtatagtattaattagaggggggttagggggtgcgggattcgagcgagtaggaaggaggtagcgtttggtattagggttttgatttaatagaattgagatacgtttgtaatcgttggcgtgtttcgcgtataggattttagcga

SEQ ID NO: 7176 - DNA, 300 bp, synthetic construct
  misc_feature 1..300: note = Description of Artificial Sequence: Synthetic polynucleotide
  source 1..300: mol_type = other DNA
cgttgtaaaatagtcgtcgggtgtagtgggtcgggcgttcggttattttggttgcgattatcgtagttttttaaaggatgcgggtagatgtagacggttttggtttatttgtttttaaaggtttgggattgtgtttgcgtgtttcgggagggtattcgaaatttgggagtttttcggcgtttttagtttcgggtatttggggttttttgttttttaatagtattaattttgagaataacgcgtatcgaaggcggaggtttttgtgttttggataagttcgttacgggtaagttagttcga

SEQ ID NO: 7177 - DNA, 554 bp, synthetic construct
  misc_feature 1..554: note = Description of Artificial Sequence: Synthetic polynucleotide
  source 1..554: mol_type = other DNA
cgtcggggcggggattattttgtagtaggagttcgtagatattgtagaagcggagaacggcgttgcgtttttaaattatggttttttttttaaagggttggggaaggaacgagggggtaagtagatgttggtgagcggggtacgagagtgtagggtttcgttggtgtttttttttcggcgttcgtcggatttatcgtttttatcgttgcggtgttcgaattcgcggattcggatcggcggtagtagaagcggtagcggtaaagtattcgtagaatggggtatcgcgaaatagttttttttttttttttttttgttggtggtgtagtcgcgatagttcgttttttaggtaggggtttggagtttgtttttttttcggcgcgtatagtaagttttagagttcgtcggggttgttcgagtaggtggtgtagggatgtcggggtgttggagaaggtgcgggcgagggttgtaaggagtgggtaggttacggaggggaagggttgggggagaggaggagtaagtaagtagtattgtcgttcgcgttcggggtgtttcgg

SEQ ID NO: 7178 - DNA, 1153 bp, synthetic construct
  misc_feature 1..1153: note = Description of Artificial Sequence: Synthetic polynucleotide
  source 1..1153: mol_type = other DNA
cggcgtatataagttgaggattgtcgaggcgttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtttcgcggttttcgttcgtcgagacgtggttttaagaagtggtgtcgtagtcggggtagaggcggaggaagtcgagtcgggtaagtcgggaaggttgcggagacgttttgtcggggtaggtgttgtagttttagttagcggtttttacggagggggcgg

SEQ ID NO: 7179 - DNA, 1603 bp, synthetic construct
  misc_feature 1..1603: note = Description of Artificial Sequence: Synthetic polynucleotide
  source 1..1603: mol_type = other DNA
cggttcgtagggggtgtttcggggcgttttttgcgcgaggtttcgggaatagggtacgagggtttaggttgtttagttgtaggtgtagttgtttcggaggaggacgttgtttgcggcgtcggggagtttttcgcggttggaggcgaggggaattgtatttattatagtgtttcgtttgcgcgaggattatttatttgggtcggagagagcgcgcgcgcgtaagagcgagttcgggttgtggtttgggggaggggagcgagggggcggggagcgttttatcgcgaggacgggggcggggacggattgttaggtggggcgggtagttggggcggttcgaggatttttttcgatttaagtgggtatttgcggagttaaaagtaggggaggcgttgtagttgtgaagaggcgtgggggtcgcgggaatttttttttggtcggtgcgatgaaagtcgggcggacgaggtggtttaacggggttgagagtggttcggtcgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcgcgggtcgtttaaatttgattagtagagcgagcggtttagcgtagtagtcgttttcgcggtttttagttgtagaaaagtaaagcgtcgggaggaagtagtagagggggggttatatgaggttggaaagtggcgggtgtacggcgttcgggatcgtcgaggtttttgcgtcgttttgcggaggtgatttcgcggtggaggttacgagtatcgtcgtagttttgacgttgggatttaggggttttcgagcgtttacggcgtggtggcgtcgggtcgcgtttttttagtagtttaagggtcgagtggcgcgtggttatatttatagtagcgtaggggcgtcgtgggttgacggtttttttcgcgcgagtcgttttttcgcggtatttatttttttttcgcgttcgggtttttcggaagtcgaggcgcgggttatttggtgggatttcgcggttttcgttttagggtcggggtaacgcggcgtgttgattgggaggattttcggcgttcgcggtttttattatttcgtttcgcggcggaggcgggcgtttagggtagggacggagttcggagcgttgtagagttcggttaagtttagttttttttcggtttggtagtcgcggttcggatgtcgttagttcggcgttagagggggttagtcgataataaaaatgtttgtatcgttcgtaggtggaggcggtttattaggttaggaatcgaaaggagggagggatgttgttaggttaaatttaacgttttggttaagggcgcgttaaggaaatcgtatcgt

SEQ ID NO: 7180 - DNA, 1411 bp, synthetic construct
  misc_feature 1..1411: note = Description of Artificial Sequence: Synthetic polynucleotide
  source 1..1411: mol_type = other DNA
cggttttcgttattcgggtggattttgtttatcgcgagcggggaggcggttgtttttcgtgtaggattttcgttgagggtttataataagcggttttaagcgggggtatatttttcgttattttcgcggttttttaaataaataaagaagttaaagtcggttgttttaagattaatgtaagcgtttaggaagttttgaggcgtttgagggcgaggtaggttgtcgtgggtaggtgtgaatattttagttttcgcggcgggtttggagtcgtttagcgtaggaagagggtagaagtgggttcgcgtttatgcgggtattcgaaatgaaaaagagttgtaaacggtataaaagttcgggggttaggcgtaggaaaatagagtaagggagttgttttagtttttaaatattgtatatggatgggtgtttcgcggaagattattttagattttgtgaaagaagtttttattgggcgtcggttacggtattggggtgcgcgtttgttttgcgagaagggttttttaggtcgcgcgggggaacgtaggagacgtttgttttcgggggaattagcggaggattgttttattttaaagtgaaaatttgtaggttttgggaaacgatatttaaaaaagtatataatttttatatgtcgtttaatggaggatttttataatttatagcggtagataaggttagagggtgtaataaaaaatttgaagttttttttttttttttcgtcgttttttcggaattgtattttgggtagcggagtagaattcggaatgtgaatttttttcgatatatgtttttcgtagataagtaaataatttggacgtgaaatggaaatggtaattaatgtagtaatgttgttatatttcgagtgtgtaaattttattgattcgtcgcgttacggggggtgtcgggcgtacggggatcggtggcgtgcgtttaggttgtttattttttttttttttttttttttttttttaggttttcgggcggggcgtttagaaatttcgtagggatgtggacgggttgcgggaagtaaggagttgtttaagcggcgttcgggattttcggttttcggtttttggaggattgggcgggtgttttgcgtttgtttcgatagtcgtattttttatttatttttttcggttattatcgtcgcgttagcgttagtagggttttttcggggttcgagtgtagttcggttttgaagtatttaggagagtttgagttcgggcgatagaggtttggaggtagagggaatttttaaatttagtgcggcgggtggttttgagtgcggcggttaggttttttttttttttttgtttcggggttaagtgttgtcgggttgtttggcgagagtttttttgaagtttttttttattttcgtatcgaaagcgttgatcgt

SEQ ID NO: 7181 - DNA, 2629 bp, synthetic construct
  misc_feature 1..2629: note = Description of Artificial Sequence: Synthetic polynucleotide
  source 1..2629: mol_type = other DNA
cggtagtaaacggtagagtaaaggagtcgtttttttttatttgaaagtcgcgaggaggtttggagcgttttttttcgttggggttcgagttttttgggttttggtcgggtgcgggtagattttatcggggttttcgttattttttagtttagttcgtagagcgagtatcggtagattttaagggcgcgtgagtttggttgtcggttgggtttttgaggttcgttgggcgggggtaggtcggtttaggttgtgcggggcgtttataaaaagtgatttggagatgaattcgttcgtgcgcggttggtcgtttcgttataggggcgaaggcgtttgacgtaagcggaattcggtggagtttatacgaattagaatagagcgaggtttttggcgtattagggattttaggaggtagtttcgttagagacgcgggtcgtgtttcgggaaatcggggggcggggggaggggaagagcgtagaaaagaaaatttattaaggcggggattggtttgagcggggaggggcggcgaggtcggagtttttttttgttgggcggattttttatggttagaggttgagttttattttcgtcggtcgttttttaggggaaggggaaggagaggggagagtagcgataggtttttagtaagtaagcgcgggcggtattcgtagtttttagaagtttgagatttggtcgtaagcggattcgtgcgttttaattttttgtcgcgttagcgtttggagcggagagtagaggcggttcggtcgcggcgcgtcggttttgttatgatggttagttatttcgagttcgaggacgcggcgggggttttgttggttttagagatcggtcgtatagttaaggagttagaagggtcgtcgtcgagtttaggtaagggcggtgggggtggcggcgggatagtttcggagaagtcggattcggcgtagaagttttcgtattcgtacgtggcgtttatcgttatggcgattcgcgagagcgcggagaagaggtttacgttgttcggtatttattagtatattatcgcgaagttttcgttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagtatggcgttgtttttcggcgtagtgaattcgtataatggtttgggaggttcgtcggtcgtattttcgttttcgtcgtatttttattcgtattcgtacgtatattatttgtacgcggtcgtcgtatcgtcgtttgttttatcgtattacggggtcgtcgcgtcgtcgtcgggttagtttagttttgttagtttagttatcgtcgcgttttcggcgttcgcgtttattagtgcgtcgggtttgtagttcgtttgtgttcggtagttcgagttcgttatgatgtattgtttttattgggattacgatagtaagatcggcgcgttgtattcgcgtttcgatttttgagagtttatcgtatgtcggtgtagacggatgcgaggatgtagggacgcgcgacgtcggtttcggtcgtagtcgacgacgtcgtcgttagtttgattttatattttttgggttcgtttttggagttagcgtttagggtttttttgtgttttttcgtttttttaagtttttgtcgtttttttttgtttttttagtttatgtttttttgtgtttatttttttgatttttgtgattttgtatttttttggtttgaagttgtttttttgcgcgttttttattgggttcgttttttttcggagttttagcgttttttgtttaaatttatcgcggaaagggttcggggcggaggtgcgatcgggcgtcggtagcgtagattttttggtttttttttataggtcggtgcgttcgtttttcgcgtttttcgttcgattgtcgtgtagtttatggttagacgcgtcggataggattgatggcgggatcgcgttgttcgagaaagggacggattaatacgtgtgtttgtttcgcgaatttttttgaagttgtttagaagtcgtttgtcgcggggtttattaggcggggcgggggttgggatttagcgggagtcggggtagtttggttttacggtttgtattcggtttatatcgcgggcgggcgcggagggaggttgcgtttttttcgttattagtttcgtcgtttcgggtattttcgggtttcggcgg

SEQ ID NO: 7182 - DNA, 1686 bp, synthetic construct
  misc_feature 1..1686: note = Description of Artificial Sequence: Synthetic polynucleotide
  source 1..1686: mol_type = other DNA
cgacgtttttaggtagttgttaaagttcggggttcgtcggtttttaggttcgtttgatagagttaggcgttcgtttggatttagttttttttcgggcgggaggcgcggggaggttaagttttttaaaggaatagggtgggtaggggagtggtgttaggttaggtttttcggttttcggtagttagagcggagtaggaaaggtagcggggagttttatatttcgcgtttttttcggatttcgtcgtttattcggagggtatacgtttttcggggagttagagacgttttgggggagtttgaggagtgttagcggggttttttttggagtttataagtttttattttattttcgagttgggagataagttatagttcggttttttttttgaaagtatcgtcgttgattttttttttaggtaggagtagatatttgtttgtttttacggcgcgttagcgttttgttttagtcgtttttgggttagagttcgaaatttatttattgcgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcgtatagaggttaaagaagttgcggtaagggagggtgggtaaatttagtttgagtttaggtttttgtcgtttttatttttaagtttgttttgttttttttttgggagaagagtaaatttttttagtatttatttttagtcgcgaggaggcggcgttgtcggttgttttcgttatcgtcgttgtcgttttttacgtttagcgttagtaggagcggtatttagtatagtcgtttaggtagtattttcgtagtagtcgttaacgagttgtagtcgtcgtttattgttcgcgtcggttttcgtttttcggtgtttgtcgtatcgtgggtcgtttcgtcgtgttcgatgggtgcgtttttagcgttgtcgtcgcggcgttcggtttcgggttttcgtcgttgcgtcgttagttcgtcggtagtagtcgcgtttattggcgcggattcggagcggtttaggcgtttatttcgggacggttcgtgacgttacggagggagggaggtggttcgtgtatatttatgaacgcgggtatcggcgtcgggtttcgcgtttttcgttttaaggtttcgatttttaattttttttagtcgtttttacgtttcggggttttgtttaggtttttttgtttagtcgggatcgggtttttagaggattttggtgggcggtttcggagagttttttagtttcgcgtttttatttcgattttcggaaaagttgtcgtaagggatggagggtttttttagaaagtggttattcgaggtttgagggttatttggggtggcgcgagggattttgatttgttatgttttttgaattgatatttgggcggagaggattgacgggcgtcgttaagggttttgtttttggttgggtttttgggcgttttgcgtcgattggtttggggagggcgttaggcgtatattagagtagcgtttagtggtgttaggggttgtcgggtagagtagatagttttggatttggatggtaatggtagggtttcgcgttattttcgagaagtaggggtagtcgcgg

SEQ ID NO: 7183 - DNA, 1686 bp, synthetic construct; identical to SEQ ID NO: 7182
  misc_feature 1..1686: note = Description of Artificial Sequence: Synthetic polynucleotide
  source 1..1686: mol_type = other DNA

SEQ ID NO: 7184 - DNA, 2132 bp, synthetic construct
  misc_feature 1..2132: note = Description of Artificial Sequence: Synthetic polynucleotide
  source 1..2132: mol_type = other DNA
cggttcgaagagttggtgagcgcgattatagggtagtttgcggacggttttttcggataggataagggcgagggaaacggtagaatggtgacgtatttgagtgcgtttattagacgaaagaagattaattaagttttcgtgtagtgcgtagataggtcgatatatatatatatatatatatatatatattaatatatacgtaaagatagtgagggagcgagaggcgtatttttaggtagttgataatgatacggtttcgattcggacgcgggtttaaagtttttcgattttcggagtgttttttttttcggcgattttcggagattatcgttggcgtattttttcgttttgttcggtttcggcgttttttttttttttcgtagtcgtagtttttcgtttttcgcgaacgcggttttttagtgttttttagaacgttcgcgtggttgtcgggtttcgaattttagggtcgattttagtattcggcgcgcgcgtcgtcgcgtcgtcgattagtttgcggttttcgtattaattattaacggggcggttcgggttgcggcggttcgaggagggggatggtacggaattcgagataggggataattttatttttcgaagcggtcgcgaaattttagtttgggaggttttcgttttttttcggtgcgttcgttttttttttcgcgtttcggttcgtatatttttatttttcgtttcgggggcggcggcggcggaggtattcgtatcgcgcgatgtttagttatcgttgtcgcgttgtcgtcgtagttagtcgcgtcgtcgtcgttgtcgtagcgcgggcggtcgcgcgtcggtagtaggggtttggcgaggaagtcgttgagtttcgcgcgtttcgcgtttttggcggtcgtagcgttgtttattaattgatttttttattgatttatttaatttttaggagcggttgttcggaggtacgggtttttttttaaatttgtagcgacgttttcggcgtgggtataaaggtttcgacggcggtcggcgggggttgtttagcgttcgggagtcggcgttagaggtcgtttgcgcgcgttttagtcgagtttcgggtattatgtcgcggcgtttgtagtttcggggcgcgggtataaaaggtttttcggtttcggtttcggtagtttcgggggtcgttcggaatttttattttgtcgtttttcgggattttttagcgtttgttaagtcgttgttgcgttgggacgaggtgttcgacgatttcgtggagtgttttattttgtcgggttatcggcgtttgtcgtgtacggtttaggagtgtttagtttcggtgttgaagtttattaacgagacgtttaatttttggacgtattttatttcgttgttgttgtttttgagtaagttttgtcgtttgttttttttgagcggcggcgacgtgtttttttattattcgtggttgttatcgttgtggtgttacgcgtcgggagtgttgttgattttcgttatgagttgtacggcgtacgtgtttagttgtttgtcgttgcgtttgcgcgtcgtttttttttatttggattacgcgtttattagttattacggtttcggtagtacggtggtttattattattatttgttgttaggttttagtttgttggatgttagagttatgattttatatttgtagtagcgtttgggttggtacgtggattgtacgcgttttatcgtcgtttatcgcgttttggtgttgtttgtggttttcgtgttggcggtggtttgtattgtggtttgttgtaagagtcgtatcgattggtgtatttattcgttcgcgttgcgtattttcgttttcgttatgtcgtttagtatggtttgttttattatgttcgagagttggtttttcgatttgcgtggggagaattttatatttttcgtgtatttttatcgtcgttatttttggttggtggtggtcgttttttttaacgtgagtaagattttcgagcgtatttagtcgggttttttcgatattatcggttatagttattagtttttttatatttttattttttttagtatttacgattaggtgtattacgtagaagagggtttgcgttagtttttttaggcgtcgtttgtcgtatttattttttcgg

SEQ ID NO: 7185 - DNA, 2954 bp, synthetic construct
  misc_feature 1..2954: note = Description of Artificial Sequence: Synthetic polynucleotide
  source 1..2954: mol_type = other DNA
cgtttagagcgtggtagtttgcggggtcgtttacgtttttttttttggcgttaagtttgtggttcgcggtttttaagaagggtatgcggtgagttcgcgggtttcggttgcgtattatttgtaggtttttacggatgaggtcgtggcgcgagcggattcgtgaattcgttatcgcgcggggattacgtattaagtggatgattttgaggtttagggtcgggtttcgtagtagtggcgttaagatcgttacgtcgaagacgcgtatattttttatgattagtgtgcggtatttgcggtattttttttcgaaacgcgttaggcgttgtggcgggtattttttgtatacgcggtcgtttattaattttacgatttttttgcggtaggcggggtagagtggtgacgagtatattattttgttggtggttgcgtcgaagatgtttagcgtggtgaggttgcgtttttcgttgttcgcggggttatataattggaagatagagaggtcgtagcggtaaagagcgtttagtatgtttcgcgttgttttttgtagggaaacggcgtttttcggatatagtttttgttatatatgttatattggttcgtagagaaagaatatttcgggattttggttgaatagttcgtcgaagaacgacgagttagagcgttacgtggtgaatacgtatattagttgtcgtttgttttcgacgttttcggtgtttcgagtgttattgtttggaggggtcgtaattttcgttatttttgtcgcggttgtaggagtcgtttcgacggcggtagcgggagggcggtaaggagtgcggaggtttaaacgggtatgagtacggggcggttcggtcggaggcggttttgggcgtttttagttgttttcggttgttttcgttgcggtatttagcggtttatcggggttgtattgttgtagcggttttttgtgttatttgtagtttaggaggttgagtatagtgagtattagtagtagtgtatagttcgcgtataatattagcgtttttttacggaatatttttatttcgagaggggacgcgggttagcggcgttttgggcgtcggggttattgcgggagtagggtacgcggcgcggttgtaggcgtagtttggagtagtcgagggagcgcgttcgggggtagagttcgttgcgggttgcggtttattataggtataattcgggtcggcggcgcggcggaggtagttttgtagttcgggaaggggacgtagcgggttggttgttggcgtcgggattcgggtcgcgatttcgaggcgggcgcggcggttggtttttagcgtttaaggttggtttttttatggtagcggtttcgggtaggatttgcgaggggaagcggagtgagcggatgcgttttaattttttttttagttttttttttttaagtaacgtttattttcggttttgttcggttttttcgtttatttggagtcgagggcgcgttcgggagcggtttcggattatcgttcggcggattgttcggttgttattcgtttttcgatttcgttttttttcgttttcgttgggggttttcgtattttcgaggggtttggggagtcggtcgatttatttttgggtagttttcgggtagcgggcgttttgcggttcgggaagaaaaatttttacgcggtttagagtttcgtttcgcgtttcgtcgaattcggcgtttttcggttttagcgacgtttttttcgttttttcgggatcgtagttttttgtttcgtttaggggaacgaagtcggttgggggcgatggttgggggcggtttatatgggatttagttttcggtatagcggcgtagtttttttcgttttcggttttcgtgcggcgaatttttttatttttttggtagcggtggatggggtatagcgcgatttcgtagcggcggcggcggttgtttttattatcgggaggatgttcgggcggatagcgtaggtaattttcgtcgtttcgtagttttcgattggattaaaggatttcgaatatatagttttaggtaaggaaatttaggtgtgtagtattgttcgattcgatttaattcgttttcggtattagcgtttttggttaacgaggtatttaagtaaagaaagatttcgtcgtagtcgtcgtcgtcgcgcgaaagcggcgtttaggaggatgttgttattcgattttttttacgtcgggcgttcgtaacgcgttcggattagtttttgcgcggtttttgttagtcggcgttcggttggtgcgcgtcgtcgtttgtcgtcgcggtttttttttttcgtcgcgtagtttttttttttcgtcggtttcgttttcgtttttaacgtcgagtcggtttttatcgtcgttgcgtttcgggggttggagacgcgattcgttttatcgcgacgcgcgggggttgtagtttacgggttcgaaggtttagttttgcgcgtaaagcgtcgggatgcgaacgcgggatttggagttcgtcggtgtcgagagttgttagagagttggattttgcgtgtagttgtcggattcggttttatgtttttgtttttagaaagagttggtgatgaagtttgggtagaaattttttgtcggtcgttcgttttacgtttttttcggggtcgatattgttaattttttcgggtattgaggatatttttgcgttttggagcggtgggaggacgcggagcgtcgttttttggttttcgatattttgttcgttttttttagtgggtttgtggttgcgttttttcgaaggaagtaataaatttttttgattttgggggttagaggagacgttttagtttttcggaggggtgtgcgggcgggatcgttttttcgttttattggatttttggtcggggttgtttttgttttattgtgttttatatgcggagtttcgatgtttttcgtattttcgttcgcggtgttgcgtttattgtgattgacgt

SEQ ID NO: 7186 - DNA, 2954 bp, synthetic construct; identical to SEQ ID NO: 7185
  misc_feature 1..2954: note = Description of Artificial Sequence: Synthetic polynucleotide
  source 1..2954: mol_type = other DNA

SEQ ID NO: 7187 - DNA, 885 bp, synthetic construct
  misc_feature 1..885: note = Description of Artificial Sequence: Synthetic polynucleotide
  source 1..885: mol_type = other DNA
cgttcgtcgtttttttgaggttacggcgtaggagagaaggagggcgcggaaacgtcggtatcggttgggaagtttcggtgtttcgggttttttttggcgagggcggagaagtcggcggtttttgtttagaattttgtgattgtagggatcgagatattaagggcgggggtgtagaggattataagttttttagcgcgttttatttgtatataaatgtgttttgttttttaattttgtttttgttatttgtgtatttgttttttattaaattaattaattattcgtggtttaggaagaaattagaattggggggattgtttttttaagggggatatagttgaacgtggtcggtagtttttggtttttcgggtttgggtttagacggatttcggcgttgtttttaagatcgatatcgggtatttggtcgtcggcgtatttaggagtacgattttatgcgtgtgtacgttttttgttcgggttaggagttttgttttagttttatttcgggttataaatttttggtttcgtttagcgtagtttcggttcggagggtagtttgttagttaggttttgggttagggatggtttacggtgcgcgcggggatcgttatattttttagcgttacgttggggtcgcgcgggtcggagtagggggagggggttcgatgacgttatggaatagttggaggatttagttcgggaattcgtcggggagcgggtttcggggtcggcgttttatttaggtcgatagcgtttcgggttcggttttatttttttagacggtacggttgttttttacgtttagagcgggtttggggttttgaaggaaattagtgtacgatcgcgaggttaggaattttggagaatgggtacgtaggcgtgcgt

SEQ ID NO: 7188 - DNA, 2174 bp, synthetic construct
  misc_feature 1..2174: note = Description of Artificial Sequence: Synthetic polynucleotide
  source 1..2174: mol_type = other DNA
cgcgttgtgttttttagcgttttaggggttcggtttttagttcggttttatttgggcgttttttcgttttttcgtgggtcggcgggtcgtgcgggaggaattttggttgtcgcgggttttgcgttttatttgttatttcggtggttttcgttcgggtttcgagttttttgcggagttagtattttagttgagttagtcggaggggcggcggcggtttcgcgcgtttagagttttagtttatgaatgggattttattttgagcgttttttttcgggtttggggaggcggcggcgcggcggcggggggcgtttcgtaagttcgcggttttgagcggttattcgcgtagtaagttgggcgagttggtagtcgtttgtatttgttttttggtttcggtttttgatttcgttttcggttttaagcgttcgggttgcgttttcggttgtttcgcgaggtagttttaggaggtttaggggtttcgtttgcgtttttggcgttagattatggtgggtagtttcggttaggagttttagtcgtcgcgagttaatatcgtttgtagttagttttcgttttattcgagcggacgcgcgggtattcgtagcgcgcgggttattttttttttcggtcgggatgggcggcgcgggattgagtgatcggttttgcgttcggcgggtaatttttatttgatttgttgtttgtgagttgttgattgtcggggcgcgcgagtttagggggtacgggtagtagcgcggcgatgatttgatttcgagttcgttagggcgtttttttttttttttttttttttcgttttttttgagtttgtgcggagattagttcggtgcggcggtttcgggtggattatggcggggagttttagttaaaggcgtgtgggcgtcgagttggagaggatattttcggtatcgttgttttttgagggggtttatttaaattattgagttattttagatttaggattttttaaataattattaattgtgttcgtttcgtgtcggaaagtaagcggaaagagaaagagcgtttatttttgggatttcgtagatcgtttttcgttggttttttttcgaggggtgtttggttttcgaggatttttttttttttttcgcgtttttttttttttttcgttttttgttttttttgtagtgttgttggtcgggagttgtttttatcgtagttggaaatagttgttttcgtttcgcgtttttatttagatttcgggtaatcgtttttatttcgcgtttttcggaattttagaattcgggtggtcggtttttggaaagtcgtagtcggcgcgatgtattttgtagattttattttgttgggacggattttttaatttttagaatcgcgggtcgtagggagttaaattgttgtttttttttttttttttcgtgcggttggtggtttgttttttaaaggaacgttttatttattttttagtattttttatcgggggcgcgttattcgtttgggtttagattttgttttgtaaacgggttttttatgtatgtatgtgtaggtatattttggatattttataacgtttgcgtttttttaatagaggtacgttttgttattttgggtatcgtttttttttttttatttggtatttcgaacgtagtgtgattaaattttttattgttttttggacgtcgatcgttttggggtgtaagtttggggtgtaaacgtttatttcgtaagagggtttgggatcgtttcgtttcgtttttcggtcgttagaggttggggaagtttatatttggatttttatatattttgtcgttattgtttagattttgattaattttgtgagcgtcgggttttcgatattgtagtttttttaaattttagtattgttttttcgcgattgttttttttttggtcgtttaggttttgttttcgtttcggcggagcgtaagtcggagggcgtagtagaggttggggtttgaggttttcgttgagtagttatggttgcggcgatagttagttttttgattcggtagaagcggtaggcgagggagtttaatagcgatcgagtgtcggtttttaagcgtcgttttagttttagtaaagacgggcgttttttgtgcgagaggtacgttttcggggtgtttagtaaagtgcgtttttgtagcggtcgtaagaggtcggtgaggcgg

SEQ ID NO: 7189 - DNA, 873 bp, synthetic construct
  misc_feature 1..873: note = Description of Artificial Sequence: Synthetic polynucleotide
  source 1..873: mol_type = other DNA
cggtcgggtttagcgatgcggttgagttgtttattcgcgtttgttgaatcggttaattagcggcgttttcggatttagcgggagcgtttttatgtcgatcgcggtaggcgtgcgtttttcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcgttcggttttcggtgtatgtggtttgcgaggcggtagaggagatgtggggatttagggtcgtacgtcgtgttcgaggtttttacgagaggttttttttcgcgggtttttgcgtaattgcgtgaagtcggttcgggaaagttaagattgtggtttaggaagaggaaggaacgcgggcgatagagttggggtttgggacgttgagggggtcggtggtagtttttcgg

SEQ ID NO: 7190 - DNA, 2174 bp, synthetic construct; identical to SEQ ID NO: 7188
  misc_feature 1..2174: note = Description of Artificial Sequence: Synthetic polynucleotide
  source 1..2174: mol_type = other DNA

SEQ ID NO: 7191 - DNA, 510 bp, synthetic construct
  misc_feature 1..510: note = Description of Artificial Sequence: Synthetic polynucleotide
  source 1..510: mol_type = other DNA
cgcgtagtcggagaggagggggcggtattcgggatttggcgcggtttttgttttttgcgttagcgtgagttcggttagggtttttacggtcgtgtttttattttttagggaggcgtcggtgattcggttatagttttagttttcgtcgttttgtgatttgcgggtattggatgattcgtagttgagatttcgttatatttttgaagtggggaaatggtgagtgtgggggtagggcgttttaaggttggggaggttttattcgaatcggcgggaaatggcggcggcgggacggagtttgcgaacggagttttcgttgtcgtcgtttagtttttagtttttggtttttttcggtgagggattcgggtttatgtcggttttcgtaaggcggttttggtttagtttgtagttttatttgtgtagttttgcgttcgtagtttcgtattttttttgggttgtggggtgaggaggagtttatcgggaaaacgtttgcgtggcgtgcgaggtgttcgt

SEQ ID NO: 7192 - DNA, 511 bp, synthetic construct
  misc_feature 1..511: note = Description of Artificial Sequence: Synthetic polynucleotide
  source 1..511: mol_type = other DNA
cgttttgattcggtttgggcgtaagtaaatttaggtttggtcgtcgggcgtttgggtcgcgttaattcgtttttttttttttacgttcgttcggtattttttggttcgttaagttttagatgcgggtgtttgttttagaaaattttcggcggcggttcgtattgagtatgttcggcggcggggcgggtttggggttcggaagttttagcgattcggcggtattcgtcgttttgaggtagcgggtttcgataggcgatggatttttcgggttttcgggggcgttttacgtgggtgttggtcgggggttttttggtagtggttttggcgttggggggtcgaggttgtttcggcgttagtttacgttttcgttggcgttttttcggcgcgtagttatttcgggatttttaggtggtttttaggtttgggttcggtttgaggattttttcggggcggagcggggcggggttcgagagtagtacgtaggtaaggagggttcgattttaggtttcgg

SEQ ID NO: 7193 - DNA, 417 bp, synthetic construct
  misc_feature 1..417: note = Description of Artificial Sequence: Synthetic polynucleotide
  source 1..417: mol_type = other DNA
cgtcgttattttttttttggagtagaaggggaattcgacgtttaagcggttgcgtgcgaagtttttaattaggtttaaggagtcgtagagtcggggtttcgggttcgtaggatttagaagttacgcgtttcgcgtttttcgtttcgtcgttgtttgttcggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcgtttcgtcgtatttcgtcgtttgttgtatcgttttcgttagggcggcgacgcgg

SEQ ID NO: 7194 - DNA, 1748 bp, synthetic construct
  misc_feature 1..1748: note = Description of Artificial Sequence: Synthetic polynucleotide
  source 1..1748: mol_type = other DNA
cgcgggtcggggagttgtattttttgtaggttcggttttcggtttcgttttttagcgtcggagttcgggagtcgcggttgtagtttatttttttaaatgatagttgaggttcgggttttagttcggggtttgacgttagtgttttttttcgtgttgttaggagtagttagcgttatcgtcggcgtttcggtttcgcggtacgtttgtaagttgtcggggcggcgagttttttttgtttcggttttttttttcgttttttttacggagagtcgagtagtagttttagagtttttcgtaagttttttttatattttttcgttttcgttttaaaggagtagtagtttttttttgtttttttattgtcgtcgtcgtatcggcggagtttttttttcgcgcgtttttttttcgatggagttcgggcgtcgtcgacgtcgtcgttgtttcgaattttgagcggggtcgtttcggtcggaggaacgcgtcgtttagttcgagggcgtagagcgttaggagtacgcggagggttggggcgcgggtttcgggaacgagaaagtgtagttttttcgggttattgggtcggcggcggggggattatggttttgaaggatacgggtagcggcggtagtattattttgtttattagcgagatggttttttcgtttagttcgttcggcgcgtcggtcgtcgtcgtttcggggttttgcgtattttcgtttttttttgaagtagtggagttgaacgtaggcggttaggtttatgtgattaagtattcgacgttgtttagcgtttcggatagtattttggttagtatgttttcgttttttagttttcgtggcggcgttcggcgtcggggcgagttgtttagggatagtcgggcgcgtttttttatcgatcgggacggttttttttttaggtacgtgttggattatttgcgggataagtaattcgcgttgtcggagtattttttcgagaaggagcggttgttgcgcgaggtcgagtatttttagtttatcgatttggttaagttgttgtcgtttaaggttattaagtagaatttttttaacgacgagggttgttagagcgatttggaggataacgtttcgtagggtagtagcgacgcgttgttgttgcgcggggcggcggtcgtcgtgttttcgggttcgggagcgtacggtggtggcggcggcggcggcgcgtaggataagcgttcgggtttttttacgttgggttatcggggtttttatattatcgtgcgcgataattaggtcgacgttaaatttcggcgtgtggcgcgtattatggtgtgcgggcgtatcgcgttggttaaggaggttttcggggatacgtttaacgagagtcgcgatttcgatcggtagtcggagaagtatacgtttcgtttttattttaagtttatttatttggagtaggtttttgatcgtttgttcgaggtcggtttttatatggtggcgtgtaatttttcgggtatcgtcgttttcgttaattagtatcgcgacgataagatttggagtagttatatcgagtatattttttttcgtaagttcgtagtttcggcgttttttagtatttttcgttttttgttgagtcgtcgttagtttgagtttcgttggaggtttcgcgggggtgttcggggtaggcgttggttaattttttatagagagcggttttttttgtacgatttttttatgtagtagatacgatttatattttatcgattcggatattttcgt

SEQ ID NO: 7195 - DNA, 1748 bp, synthetic construct; identical to SEQ ID NO: 7194
  misc_feature 1..1748: note = Description of Artificial Sequence: Synthetic polynucleotide
  source 1..1748: mol_type = other DNA

SEQ ID NO: 7196 - DNA, 648 bp, synthetic construct
  misc_feature 1..648: note = Description of Artificial Sequence: Synthetic polynucleotide
  source 1..648: mol_type = other DNA
cggttgtgtcgggagtaaaggttcgggttagtgtgcgtgcgggcgcgggtgattttatttttagggaagtcggcgtttaattatttaggtagtagtttcggttgatttttttttttttttttttttttttttttttttttttttttgcgtgttttttttgtatcggttttcgtcgcggagttaggcggtagtatcgacgtcgtcgtagtttttgttcgtatcgcgttaattcgcgttttcggtttatacgtagtcggagcgattgagtcggtagtttcgggtttacgttgcgtatcgtgtgtacggcggggttggttgagttgatttgcgttgggtttcggcgtcgtaggcggttggggagggcggcgtgggagaggacgttgagacgtaggggcggtcgcgtcgaggtgataagttgcgtatttggaaagttattcggttgtttggtgaggttcgtgggtcgggggttttgggcgtcggggtgtgagggcgcgcggggagggacggggtcggggtgcgcgcgtgtgtatgttgtgaatgcgttgcgcgatgtgcgtttttattttatatttagtcggttttttgtttgtgttgttcgagtgtggacgtgtgtacgcgttgtattcgttcggtgtggtagcgtttcgt

SEQ ID NO: 7197 - DNA, 863 bp, synthetic construct
  misc_feature 1..863: note = Description of Artificial Sequence: Synthetic polynucleotide
  source 1..863: mol_type = other DNA
cgatttttaacgttgtaatttgtgatcgtgattaaattttagcgatgcgagggtaaagcgttttcggcggtgcggtgtgagttatttttcggcgttgtttgttttttttagtagttttttaagggataggttttgtttttggtggtcgatttttaggttttcggtttttttagggcgattttgacgaggggtagggggtggttttcgggaggatttagaggaaaggcggggataagaagggaggggaaggggaaagaggaagaggtattatttttagtttaatcgttttcgatttttataagagtgttcgtgattttaaatttaacgtgaggcgtaaaagcgtttttattttttcgttttgcgcggttaggtaggcggttggagttgatggtttatttcgcgttttttgttttatttttattcgagatagggacgaggagtacgttgtagggaaagtagcgagcgtcgggagaggggcgggtagaagcgttgataaattagcggtgggggcggagagttgaggagaaggagaaggaggaggattaggaggaggaggacggcgacgattagaaggggtttaagagagggggcgagcgatcgagcgtcgcgacgcggaagtgaggtgcgtgcgggttgtagcgtagatttcggttcggttttttcgagagcgttttgggcgtttttttacgttttgtttttaagttttttgtttttttattttcgtgagcggagaattgggagtggttattcgacgataggttagcgggtttgttttttatttttttagtttcgcgtcgtcggtttatagcggttttttttggggatagtttttttcgggtgtcgttttcgttttttttgtgcgt

SEQ ID NO: 7198 - DNA, 1288 bp, synthetic construct
  misc_feature 1..1288: note = Description of Artificial Sequence: Synthetic polynucleotide
  source 1..1288: mol_type = other DNA
cgttttttgcgtagtcgatttcgtttcggtttcggtttaggttagagaggtggttttcggagatgttgaagttatttcgcgtagggggaggggtcgttaggtttttttttaattacggtggtcgttttagttatttgtatatattatgttaataatagattttttgtttcgtttttatttaagtttttcgttttttttgggggtttttcgggtcggttcgcgggttgggttaaggtgaatatattatgataataaggcgggtttttgttttgttttcggaaggggggcgcgtagtagcgggagcggtaggtcggacgtcgggcgtcgggagggggtcgggggagggacgtcgtgttcggagcgcgcgcgtatttatatatttatatatatatttacgcgagtatcgcgaagggtatttaaggatcgcgtacgcggggttgcggagatttttcgggtagtcgcgatttcggtttcgcgagtagtattggttttttgggtttatttcgttttttttttttttttttattttagtcgtttttttcgcgttgcgttgtagcgtgtttttatagtttttttgttttgaattgaatgtaggtgggaaataggtcggcgtgtcgaaagatatcgagtaggtagaaataaggtaaatttatagaggcgtaataggttcggtttttcgtggttagggcgagtcgcggtttcgcgtggcgtttcggtcgttgttttcggattttgagcggttattgttggggttttcgaaagaggtgtcggttttttgggagtcggaagagttgtttgggtgggtttcgttttgttttttattttatcgttatttagttttcggacggagggtgttttttatttttagttgggaggagagaagaaagcggggatggtgtacgtttgcgggtttggacgttgagtaaggtaggggttcgtattcgttcgtgggtttgattttattaattagttgtgtagttatagggattgaattttggaggaatcgatttttttttttttttttaggattatttgaggtgtagagggtgggaagcgaagtcgagacggtcgatttcgttacgatgttgttgaagaagtacgtagggaaaggagggggtcgggagtttagattcgaggattcgatttttgtcgaatagtattgtgttcggattatgttttcgtgtgtcgttttggcggtttttttgttagtggtggtcgtggtgttttgtttgtatttgggtgtgaaaattaacgatttttaggcgaggatcgtcgttttcgaattcgt

SEQ ID NO: 7199 - DNA, 1275 bp, synthetic construct
  misc_feature 1..1275: note = Description of Artificial Sequence: Synthetic polynucleotide
  source 1..1275: mol_type = other DNA
cgtttatttcgttttgtttgttcgtttttattgtttttaagttcgtttcgttcgcggtaagtgcgtgtttaggcgtagttatcggcgagattaggagcgtagcgttcgtagtttgagggaatcggcgtagggtagtagcggttgtagttggattcgcgcgttttagcgtttagtggcggcggtcgggatattttgggtagtatttcgtatcgtagtattttagattacgagtaatcgtgttcgttttcgtcggggttggagggcgtagggtcgttattttgtaagttcgtgggttttcggttatttttatgagagaaggcgaagtcgggcgaaggagtaggacgttcggtagtaggattttttcgtaagtttcgcgggttttttgttttcgcgtttttcgggcgtttaagaagtaaaatgtaattatcgcgttatagttgagaggggaaggggttagcgttattcgttcgttcggaattcggttttcgcggcggttgcgcgtttcggtcgcggttttttcggttcgggagtgagtagtagtaggaggagaggtagcggttcggggttggtcggggttggggaggagggacgggacggagggagggcgcgggggcggggagggggtttcggcggataaagatggtaatgttttttatttaagcgtgttgtagtttggtttttttaatatggttgttttttttttgtttcgtgtatttgttttgtttggattttatcgtggtcgagaaggaggaatggtatatcgttttcgtgaatattatttacgtcgagttcgcgtcggatttcggggtcggggcggcgggcggcggcggcgcggagttgtatacggagaagacggagtgcgggcgttacggagagtattcgtttaagtaggacgttcgcggggaggtggttatggttagttcggtttacgatcgtttggtttgcgattttaatattaagttcgtcgtttcgattcgcggtaagaattggatagtttttatttttaagggtaattgtacgtatagggataagattcggaacgcgtttttgtagaacgttttagtcgtggttatttttaacgtgggttttaatattaacgagattattattatgttttacgcgggtgagtggtttagcgggcgcgggggaggggagtcggcggggacggaggtgtttagagggatttagcgtttgtttttaggttttttttgggaagttcgtgcggcgcggaagacgtgtttgggttttttggatcgattaagttttgtttcgcgt

SEQ ID NO: 7200 - DNA, 1071 bp, synthetic construct
  misc_feature 1..1071: note = Description of Artificial Sequence: Synthetic polynucleotide
  source 1..1071: mol_type = other DNA
cggcgttgagttttgtttagcgcgattcggatcgacggacgcgtagagattttgtcgggattcgttttttagtcggcgttcggggagtcgtcggtcggttttatttttcgttcgggagtcgggtagggcgagaaggtagcgcgagtggcggtggcgattttcgtcggggtttttgcgacgagcggtgattagtagcgttcgtagtcgcggtttcgttttttattcggacgtggttaagcggcggcggttacgacgttcggtttttcgggatcgttcggttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgcggttatcgttagcggtttgattcgttagaagcggtaggcgcgggagtagtattgggatcggtcgtttgttagtaggaggcggagtagttttagtaagaatcgcgggttttgtaacggtaatttggtggatattttttttaaagtgcgtattttcggttttaagaagcgtaggttgcggcgttaaggtttgtgggggttatggtcgggagatgcgtttcgggtcgtttttttttcgtttaaacggagtttttttaggttttttttttttttcggttttttcggtttatttcggtttcggttttttttttgagtattttgggtgtcgtcgcggggattttggagttcgttgtcgggtaatttgtagtcgtcgagaagtgtagtcgttagagatggtaagttggttgtttttcgtcggcggtttttgtttttcgcgtttttgtaggttgggttttgggaaatttgttttttttgagtttcggtttttcgggaggatagggattggtattggttttggaacgcggggtatttttttttgttatattcggggtcgagttatcgttcgt

SEQ ID NO: 7201 - DNA, 694 bp, synthetic construct
  misc_feature 1..694: note = Description of Artificial Sequence: Synthetic polynucleotide
  source 1..694: mol_type = other DNA
cgttagggttgtcggatagttcgatgattaggagttttcggttttcgaagttgcgttttatcgtgtaaattttgttgatggcggtgtattgtagttatacggatacgagcgtttcgcgtagttcggggtagcggtggtattcgaaggagatgtcgtttttttgttgtagtcgtcggcgtcgttttatgttcgtcgcgggcgtttcgggtttttgggtttcggcgtttaggagttattcgtaggtagttagtgtttcgtatagagttagtagcgcgttgttttttcgttcggttatcgttgcgtttcgtcgtcgtcggtcgtgtttttttacgcgggcggttttttttgtttgttcggttttgggtttagttcgtcggcgttgttgggggcggtaagtttcgtattagtttttattcgttttatttttttcggttgaatgagtgttagttcgcgtattggggttatttagaggagacgggtaaagtcgcggttttacgggttgtattattggtcgcggagtttaggggagttgtaggagaaattattgcgaggagggggtcggcggagagacgggtcggcgtggatttgggagggttgttggcgttatttgttggttcggaattacgttaatagttaaatggcgttcgggacgacgtaggtgaaatgatagttaaggttcggggttcgggaacgt

SEQ ID NO: 7202 - DNA, 694 bp, synthetic construct; identical to SEQ ID NO: 7201
  misc_feature 1..694: note = Description of Artificial Sequence: Synthetic polynucleotide
  source 1..694: mol_type = other DNA

SEQ ID NO: 7203 - DNA, 1424 bp, synthetic construct
  misc_feature 1..1424: note = Description of Artificial Sequence: Synthetic polynucleotide
  source 1..1424: mol_type = other DNA
cgagagttcgaggcgtcgtttttgtcgtttcgggattggcgtgaggagtttttgacgatatatattaattcgagcggttttaaagatgtagttgtatatggagattttgttgggaaaattcgtttgttttttttacgtcgtttagtttaggagaattatcgtcgttatttcggagttttttcggttatcgcgtagagtttttcgagagttcgagtcgcggttttcgagttttaaggtttatttagggttttagatttttgtttcgaaaggagaggatttgagaaaatggatgtattgagatttttttgaaaatttttcgagagagcgcgagaggagcgaggatacgttattcgtagttaaaattatatttaaggattaaaataataataattaaaaattttattaaaataataagcgtttaagaatttagatcgggttggtggggggaggggaagaggcgggaaggggagggtcgtacggaggtagttttgtagtgagtagtcgatttcgtcgtttttcggtatagttggatcggtttttttagtcgcggtttagattcgtttttggatttcgggttagtttcggtgttaggatcgcggttcgggtttggattttcgagatttcgcgtattagtttcgcgggagtttcggtatttttgtatgagtacgagaggattttgttttcgcgtagtagttcgggaagtaggagtcgaagcgcgggtcgtggagtaaggcgggaatcggaggcggcggcggcggcggttaggggcgtacggtgttaggattagttcgtcgcgttttatggggagtcggcggtcgtagcgttgttgaggcgggttcggttggttaggcggggggacggggttcgggttgtagtagttttttttgcggttgtcgggcgggttcgggcgttcgggggttggggggtggggggtgggggaggacgtcgagcgttgaggtaggggttcgggtcgagggcgcggcggggttgcgcgtacgttggggcgcgtggaggggcgcggagggcgaaatgagtttggtaggtggttttttttattattcggtggtgtattacgagggttattcgtttgtcgtcgtcgtcgtcgtagttgtcgtcgtcgtcgttagtcgttgtagttatgaggagaatttttatttttatggttggtttatcggttatttcgagatgtcgtttttcgattatagtatggttttgttttatagtttcgagtatgttagcggcgtcgtcggtttggattatttttattacgggggggtgtcgtcgggcgtcgggttttcgggtttgggggggtcgcgttcggtgaagcgtcgaggtatcgttaatcgtaaggagcggcgtaggatttagagtattaatagcgttttcgtcgaattgcgcgagtgtatttttaacgtattcgtcga

SEQ ID NO: 7204 - DNA, 1215 bp, synthetic construct
  misc_feature 1..1215: note = Description of Artificial Sequence: Synthetic polynucleotide
  source 1..1215: mol_type = other DNA
cgtgcgggagggaggataagaattcgggagtggtcgaggataaagcgggggttttttttattttacggtgtttagttttttttcgttgtacgtggtttagggtggtcgtattatttttaaagtcggtttcgttaatcgttagtttcgggattgaatttgttttttcggtcgttcgtttttcgtaggggataggggcggggagggagagatttagaggggggtcgggggaggtggggtcgtcggggaggaggcgagggaaacggggagttttagggagacggttttcgagggagagtgagaggggagggtagttcgggttcggtacgttttttttttcggtcgtttttttttatataagcgtaggtagagggcgcgttagttatgttttgtttttgcgttcgtcgtcgtcgtcgtcgtcgtttagttcggcgcgttttggaggattttgcgtcgcggcgttttcgggtttcgtcgtcgttagtcgtttcgtcgtttttttttcgttttcggtatcgtcgttagcgttttcgtcgtagcgttcgcggttcggttttttttatttcggggaaggggagggaggagggggacgagggttttggcgggtttggaggggttgaatatcgcggggtgttttggtgtttttcgtttcgtttttttaaaaagttatatcgacgcggatcgcggcggcgttttttttcgttttcgttttatttcgcgggtttcgaatgcggggagttcggatgttcggttttttgtgaggtttttatttgatattcgtcgttttttttcggtattggttgggagggcgttttgtaaagttgggaacgcggagtttcggattcgttttcgtcgttttcggttcgtttagggggggtcgtcgggaggagttcgggggagagggattaggaggggttcgcggtttcgtaggggcgttcgcgtttttatttttgttttcgttagcggatcggttttttattttcggtttttttattatgtatttgttgggttttttttttgtggcgtgttttttgttcgtcgttgcgttgttttcgggttttcgcgaggcgttcgtcgtcgtcgtcgttttcgagttcggattcgatttttcggacgcggagttcgacgcgggcgaggttacggtaggtttgcgttagggtttgcggagaattcgagagtttgcgttagggtttgcggcggattcgagaatttgcgcgg

SEQ ID NO: 7205 - DNA, 1184 bp, synthetic construct
  misc_feature 1..1184: note = Description of Artificial Sequence: Synthetic polynucleotide
  source 1..1184: mol_type = other DNA
cgaatgttgttttcgtatcgatttaaattcgcgtcgagtttttttttatttcgatattataagggagaagagcggagtcgtcgtcgtcgtcgtcgttattatcgttatcgttatcgtcgtggttttcggagcgagcgagcgattttgtcgcgcggggagttttatcgggagtcgcgtttcgttagttcgttttaggtcgtcgtcgtcgtcgtcgtttatttattttgtcgcggcgcgttttcgttgtggtcgtgaggaatcgagtttagcgttgttaagttgtttgggtttggagcgtatcgtgttatagcgtttggtttcgggttcgggttgcgcgcggcggttagatatgataggttgaggtttttttgtttatattcggtcgtcgagggggcggtgcgtcgtttaattttttcgcgtcgggtcgttatcgtcgtttttcgttagtttcgcgtttagcgtttcggttcggtcgtcgttttattttttcgttttattttttcgtttcgttttatatacgcgggtcggggtttgtgagtagtcgtgtttttagcgaagacgggggaattgtattgagaattcgttttcggtatttttcgaagatttcgcggggcggtatttttttttttatatacgtacgttcgcgagtcgtttcgggtagcggtcgtgtttttcggcggggtttcgtcggcggtttttgatttcgttttagagttgtttttcggtagcgttattttttcgtgtttataaaagtattttttttttaatttatgaacggatttcgatttttgttttgttattatttatgcgtttcgtattcgaggtgtcgtttttatttatacgttttacggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagttagtgtcgcgattcggggagagaagacgg

SEQ ID NO: 7206 - DNA, 5820 bp, synthetic construct
  misc_feature 1..5820: note = Description of Artificial Sequence: Synthetic polynucleotide
  source 1..5820: mol_type = other DNA
cggagggaaatcgggtcgacgataagggtggttattttcgggtttttcgcgttcggtttaagcgtttttgggtggggtagtttaaacggggagaggggtttcgtgggtcgagggttcgaggtcgtagcgagtttagcgtttggttaaatttggttcgcgcgtttttttattgttttgttagggttgtgtgatttttcggagttttacgttttcgtttaaatagtttttagcgtttttgttggtattcggggcgtttttattttagtttttgtattcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgtcgggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggggcgtagcgggagagaggagggagagggtcgcgggtttttatggagggcggttgggaatttagagatttatcgtttgtttttgtggtttttttttttattattggtttcgagggggtttcggggttgtgaggaaatgatttgttaatttcgaggttcgttagtgcggcgttagcgatcgtgaggttttttaaatttatattttagtcgggtgtttcgagcggtgggcgggtataggcgtttttaaggtttttggttttaggttttagaaagaaaggtttttgtttggtgtttcgggttttcggtttcgtttttggttggagttaatttttttgggttggaaggagtttttttcggacgagtttttggtgcggggaattggtggtttttagggtaatttttgaagtattagggttaggttggtcgaagaagggttagggttcggtttgttttttcggaggttttttatggtttcgacggttaacggtaatttcgttaaaataggcgattcgtttgcgtttcgcgttaggggttgattattttttgttttttttgcggtttgtttcggttttggtttttcgtttttcggagcgttttaggttagcgggagtattttattttttcgaagttgagtcggtgttgtgtatttcgggagtcggttgatttttggtttatttgtttacgggtgtatttagtatcgggggtttttagagggaggaaggtttagtatttcgagtttatgtagacgcgtttagttgatatttgagatgttgagcgttttatcgttggtgaaagggatattgggtgttttcgttttaggtttggttttttggtgaaggtatttggaaaatattttagtattatttatgggagaagggtggtttagtgagaattttcggtttgggtaggcgggtttaggttaggttatagggttttagtgagatgtttcggtggtcgttaatttataggttggattgattttgtgttttggaatgagtagtggggtttgggtgaggtcgggcgggttaggaggttttttgggtagttgcgagtttttcgaggtagggtgattgtgattgggttcggattttaggcgttggggtttgttggcgggtaggaagtggagcgtgtgtgtgcggcggtttgggaaagtcgatttagaggttaggtttttgggttacggagaaagggtcgttcgttggtggggattggagcgtcgatttatgtatataggttggaaaggtaaaagagaataggagaaggtggcggtggtggttaaaggaagttttcgaaagggtttttacgtattggttgttttgggaagtggaggttgttttttttagattttgtttagaagatgaatggtcgtttgttttggggtttcggttttagttaagtttcgtcgggtttggaaggaaggaaatgtattagttttaggtttgggtgggttgagttgttgtattagagtttagaggtgtagggtataggtggttgggtttttgggttttggtttttttttttagtcggcggagtgtttatagtcgtcgaggttaggttttcgagtataggtgaggaaaggataagttatagttgaatgttttttttttgggggtttttattttttattttagtttttggttcggttgggtttatattttttttttagtcgggttttattatttggagagagcgagtagtttgtaaataataaataatgggaagtagaaggatgttcgggaaaaattagaaaattgtaaggagtggggaggagggagggtgggagaggggaggaaggagggtgggggaggggaggagtaggaggagagggaaaggggttgagagatttatttttagcgagaaatttcggtggttagttttttattatttataggaaggtgatattagcgatttaggtgagaaagaaagaaacgcggtttgtcgcgaaattaatatagaatttagaaataattattaatgttatttgattcgtgttttttatatatttttcgcggttatcgacgttaaattgtttgaataatttgtatggagcggttatttattattttcgatggtttttttttgtaagtagttcggacgtggttcgtttcggtttaacgcgatcggagaattcgtatttttatttgtaaattaaagtaattacgtagtagatattatatgatgtgtattgtggtttttagatagttattaattatttttaatcgagttgttaaaagagtaggtagatttcgtttttgggaggtaggtttgtagttggggagagggcgaggacgttattattaattagagggtgattttggggcgatttataggtttgaatttaggaatttttttgagtaagtttgtataacgttgttttgtacggttttttttttaatttattacgggaggtcggtttagggggcgagggtaatcggggcgagtttcggtttcggagggcgatggcgtagaaggcggggaacgggttcgggatggttcgggcgtttttttgtcgtttttttgtcgtttgtttattggttttcgttttgaatttgggtaaggttttagggagggtattggtcgagggagttttggggtgggcgttcggttttttttttcgattgtttcgtgcgttttagatagaaagttgggtaaaatggataggggagggcgttttcgttaggtatttaacgttttttttttcgtagttagttttgcggggcgtcgggagggacgagtttagcgggaggggtcggggtttgggttgaggaatttgttttttcgagcgcgtagggtcgttcggtagttttcggtttagtcgcgaggggtagggggaagtcggcggagtacggtcggcggaaaggggatcggggaggaaagtcggggaggcgaggtgggggcggtgggttgagcgggaatttaaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaaggtcgaggcgttaagaaaattcgacgggtcgggttcgggttttttgatgtttgaattataaggtttaggttgtgttttaggggagttttaggattttaaggaatttttggggaaggaggtttggcgcgtaaatggcgttagaggttttggaaatttttcggggaagggtgtaggtgttcggttgggttttacgtggcggaggaggttagacgcgtataagttagtggaaaggggcgagtattttggtgtggacggcgggaggttcgggggtattcggggtacgttttcgtgggcggcgcgcgggattggtaaggtttagggttttagtttttagttcggtttttcgttagttttcgcggtttttttttgtagtttttgatggttattaattttttgagtacgtgttgcgagttcggaggtcgtacgttggcggatttcgggttcgtcgtttcggtttaggcgtcggtttattgttcggtttacgagagtcggttgttggttatcgcgcgttacgagtttaattcggtcgcggcgttgggcgtttatgggggtttttatggcggatcgtagggttatggtaattacgtgatttacggttcggaggcgttcgttttttattcgt

SEQ ID NO: 7207 - DNA, 1233 bp, synthetic construct
  misc_feature 1..1233: note = Description of Artificial Sequence: Synthetic polynucleotide
  source 1..1233: mol_type = other DNA
cgtcggttgcgtagtttagtataggttataggtcggggggtgggttcgggttttgcggagtgggcgggtttgagcgggttggaacgtttcgtcggttttatcgtaggtcggtattttagttttaggttttatagcgggtttttcgtttttattttcgcgggttttgtagggttggggttgtttttgagtttttggtaaggttttcgggagttttagttttgcggagattaaagtttttatattttcggtagagttcgggcgagtgtttcgcgggtggcggcggttgtggggtcgtttgggatttttcgtagtattgattttgtaattttttgtgtttgcgtttcgtggtgaggggcggcgggatgcgcgcgatttttttttgatttagttaaacggaaaagttcgcgcgtttcggttggaaggtggaggttaggtaggattcggtaaaggtatattttaaacgaagtagattttattttttatttgtagagggaaggcggtgtggacggatagaaacggtttttatagttatagaattatcgcggttatagtagcgcggcgttcggtagggagcggatcgtggtggaggtttttgagtcgagtaggttacgtagattcgggaggcgttgaagcgggcgtagttgcgttttggagtaggtagattaggttacggcggagggagaggttcggggacgcggcgtagtttttgcggagaggtacgggggcggcggggacgtttttttattggttgaaatgttagggatcggtttgggcgtggagtagtcggggcgagttcgtttttaggtatcgtcggttgttttaggtagggtttgtaggagtggttcggagtcgggtatcgaggtatcgaggcggggatttggaggggtaggggtcggggtagggtttgttaattaagtttacgggggtcgtcgggtggtggaggtgggatgggggaaggaggttgagtattagtttcgggcgatttaagattttttcggtttaattttaggagggaggtagcgttggcgggtgaagtcgttattttttttcgggaggtcgtttagtagttgtttttttacgtttcggggttattgcgtcgggttttggttattatttgggttttggtttacgtttagacgaggggtagcgcgattttttcgtagttttattttagcggttgtcgtcgtagagtatgaagaggtttggtttttgtagaaacgtagtttagcgcga

SEQ ID NO: 7208 - DNA, 2865 bp, synthetic construct
  misc_feature 1..2865: note = Description of Artificial Sequence: Synthetic polynucleotide
  source 1..2865: mol_type = other DNA
cgttttttgttttattcgggtggatgttcgcggttttggggttttttttatgttttgattttggggagtttcggttggtattggttcgcgaaggtgatttgcggatagattagttagagattacgttggttggtcgcggcgcgggttataaagtttagcggaggtggggtaggggattaagttgtttcggcgagggaagaaattgttgtttttaaattattgcggttggaggagtcgatttgcgttttagcgtgttaggataagggcggcgcgaggggtttaggggttaaatggggcgttgggtaggaggggttgttttttgtaggggaggaggaatggttttttgttagggatttggggaaaggtaatagttaggaggggatcgggtcgtaagaagtttattttggattgtagtacgggtagttagcgcgaatttagttaggaggtttacggggatcggtaaacgagaaggggatgcggtgaggacgtcggattggcgtttttgtcgcgttgatatttcgattgtttttttttcgtatcgcgttttttagtttgagacggggaagttatttagggtatcgcgtttttaaatagcggggaaaaggcgttttgggcggcggttgagtgatcgagggatcggttcggagttaggagttgggaggcgcggggatgtggtggggaggaggggagtgggggtagtgagggggtttaaattttgcggggacgttcgtttattttgtcgttgcggttagttttttgcgttttttcgacgtttatttcgcgtcgtattagcgttcgtagtagttttacgttgttggcgtaggcggcgcgtaggagggtcgtcgttttcgggacgtttttcgggacgtttttcgggacgtttttcgcgttttcgacgtcgtgttttttttcgttttcgaaagggtagaaagagtcgttcgaggcgatgttgcgggtgtttggtagattcgagaagtttttaaatttttcgtagttagcggggtttttttcgatttgcgcgtttcggggtggggacggcggtggtggggttatgtagcgcgtttcgtcgtttttcggttcggtttcggttagtagtattatgtcggcggtcggggcgcgggtcgggggtcggggcgcgggtaggaagagcgggacgcggggcgcgcgtcgaggttttcgtttttcgtttttgcgtttttagagaagtcgtggttcgcgcgttttagttcggcggaaatcggtattaggcggttgcgtttaaagaaaaaagttttcggaggttgagcgagtttttggggtgggcgggatcgcgggggtttttcgaggcggggcggggcggggcgcggggatacgttttttttcggggtttttttttcgcgtttttttttggttagagtttagagttaggtaggcgttttttcgagcgcggggattgggtatttggtagcgttgttttagagttggggatagttggcgcgggagaagtagaagtaattattaaagaagtcgaattcgagtcgcgggcggtaagcggtttcgttttttttttcgtcggttcgcgggatgggggcggaggtggcggcggggggacgtcggggcggagtcggtttttagtttcgggaatttcggatttttggagtcggttttcgtcgagggcgtcgggttttcggatttgggtggggtcggtttttttcgtcgttttagaggagtagagcgggtttttttttttcgggggatttcgggtttcggggttgattttattcggtcgcggtcgtttggaggtcggggaattttcggggcgtttggcgggtagaggagtcgggcgcgggagcggagtcgtttatttgggatttgtgttcggggagcgttgcgggtcgggttattttgaattgggggcggtcggttgttgtgggggagttttagttcggaagggaggataatttttagagtttttcgtttcgcggaatcggggtcggtcgtggtttgagggttggttagattttgggatggggggcggggtgtttcggaattttagggagtatttgagtgggaacggacgacgaggaatttttcgtttttatgtttggtttgtgttacgtgcggggatttgcggatttattttcggaggttgcgattgggcgttgattttacgtttggttgtttaaaagagtagggtcgcgggcgatagtcgtagtttaggtttatagtttttttggttcggttttgtttttttttcgttagttttggcgtcggggatgggcggggaggaggagggcgtgtgaggatttgttatagggagtttttgatttcggggtaggaggcgtcgtgagttaattttgggggaaggtttttgcgtaaaggcgcggaggtgcgttcgcgttcgtcgtaggttaaagattgcggaggttattagttttgtgtttttttagttttttttttttttttttttttttcgattttgatagcgtgtttattagttgttagtcggtgggaggttttcgcggttttaaggtgaatatagttaggttggcgtagtcgttggggattaggtttgaggtttacgtgtcgttgggtaagttgaggggtacgagggtatcgaattcgaaatagtcgtgggaggtgtaggatgaggatacgtttaaattgcgaagtcgttcgagttttcgtgttatatcgtattggttcgattcgttgttttggtcgtttggttttttagtgtttttagtaggagttaaagggtttgttggcggttttcgattcggtatttgtagggtttcggagggtggggcgcgcgggagtatcgatttttggtgaagacgttttcgtatttgggcggttttgagcgagtagcgaattgagattcgt

SEQ ID NO: 7209 - DNA, 1154 bp, synthetic construct
  misc_feature 1..1154: note = Description of Artificial Sequence: Synthetic polynucleotide
  source 1..1154: mol_type = other DNA
cgtgcgtttttaaggatgttcggtttttttttaattcgcggtttttttttttttttttcgcggttgtcgttgttgtcgcgaaaattaggagaagtggaacgcgcgcggcgaagcgtcgttttcgcggcggtattgggtatgtttcgtattcggggtcggtttcggcggcggggcggacgtttttttattagtcgggcgttcgggtcggtcgtcgaggtttaggtggaggttgaggttgtcgcgcgtcgcgggaggagtttcgttttcggcggttgaggcggcggcggtataggtggcgcgggtcgcgcgcggggcgtagttcgggagcgttcggcgtcgggcgtcgcggcggttttaggttcgcgttcgcggcgatagtcggttgagcggagttgcgggcgcggcggttgtttttttagttcggtcggttggcggcggcgttcggagtttcgaggagttcgtaggagttcgtggagttcgcggagttgggtagggggcgttgcgttcgtcgagttcggaggggtcgtcgggtcgggcgttgcgtattcgcgtcgggagtcgtttttcgttcgcggcgttcgtttttgtcgttcgttagtattttttgtttcgcggtcgcgtttagataataaaagcggaagatgttgtagttgggtaaggttaggattttgttttgaagtcgggcggcgtcgcgtacgttttttttcggattgaggagttgtcgtcggcggagggtgtatgtttgcgaggaagtcgtcgggcgtcgcgtttttgggtgagttgcggggttgggcggtcggggtcgggcgtagttttttttcggcgtcgtttttttttttttgtcgttggtgggggtggttttgggttttcggtcggtaggcggcggcggcggttgttgcggggtttttgtttgtttcggggaggatcgcgatcgcgttaggtttttttcggaagtcgttgtgtttggaagggggttcggggttagtgttttttttggagcggttattaagtggttgttttgcgtgttttttttttttgttatttattttttcgggaggaagcgtatttagggtaatatcgataatgttgtttttcgttattttgagaatatattcggtgtatttatgacgtttttaatatacgggaggagacgg

SEQ ID NO: 7210 - DNA, 1154 bp, synthetic construct; identical to SEQ ID NO: 7209
  misc_feature 1..1154: note = Description of Artificial Sequence: Synthetic polynucleotide
  source 1..1154: mol_type = other DNA

SEQ ID NO: 7211 - DNA, 396 bp, synthetic construct
  misc_feature 1..396: note = Description of Artificial Sequence: Synthetic polynucleotide
  source 1..396: mol_type = other DNA
cggcggtttttcgttttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcgatgtgggtcgtttttttttttttagcgg

SEQ ID NO: 7212 - DNA, 438 bp, synthetic construct
  misc_feature 1..438: note = Description of Artificial Sequence: Synthetic polynucleotide
  source 1..438: mol_type = other DNA
cgaggagtaggggttgcgggtcgggtttttgttgttcgcggttttcgggggtcgcgtcgcgtcgggttacgtgggggttttcgtttttcgagcgggcgtcggtgggaaatttgcgcggcgagagatagggggatggggcgtttttgacgcgattgtggggtgcgggtagttttggaggaggatgttcggttaagtttattttgtttaggtgtcggatttttagtttaggttgcggtttgttttgggttcgtgaggcgaggtcgtagcgtttcgacgtcgggtgggcgtgtgggtggagtggagatttgggtttttcggcgtatgggagtttcgtcgtttgcggtagggaatcgttttttatttttggttcggttcgggtcgggagtcgtgtttcgcgttgattcggtgtaattttttagtttatttttttttacgcga

SEQ ID NO: 7213 - DNA, 438 bp, synthetic construct; identical to SEQ ID NO: 7212
  misc_feature 1..438: note = Description of Artificial Sequence: Synthetic polynucleotide
  source 1..438: mol_type = other DNA

SEQ ID NO: 7214 - DNA, 411 bp, synthetic construct
  misc_feature 1..411: note = Description of Artificial Sequence: Synthetic polynucleotide
  source 1..411: mol_type = other DNA
cgcgtttcggttttcggggagtcgttttttagatttgtttattcgggagtttttttttcgcgtattttttagattttttttgagattcgagagcgttggtttttttttattcgcgatagttttgggatgatagtgcgggtttttttattcgtagtttttattatttggcggttaggggttcgcggttcgggcgggcggcgttagtgttttttggagttgggcggggagggcggggcgggcggagcgggtatggtggggtgtcgggggtcgtaggcgtagcgttttcgttttggttatggagcggtcggcgttcggcgaggtggttatgagttaagttatttagtcggcgtacgttattgcgcgcggcgagttgagcgcggggtagttgtttaagtggatcgatattatcgt

SEQ ID NO: 7215 - DNA, 1137 bp, synthetic construct
  misc_feature 1..1137: note = Description of Artificial Sequence: Synthetic polynucleotide
  source 1..1137: mol_type = other DNA
cgcgtttgttaggtttagatttatacgtacgtcgtttttgtttgtatatagtgcgttttcggcggttcgttcgtttttttttagtttacgttttattgttttttaagttagaagtttcgtagtcgtcgcgcggagaatagcgatagtcgagcgttcggttcgtttgtttgtcggtgggtttgtttgttcgcgtagtagattcggggcggtcgcgggagttcgcgtttcgttcgtcgcgtttttgtcgggatttattcgtagcggagggttgagttcgtcggcggtttttcggagtttatttattttcgcgcgtcggagcgtaggtaaaaggggaggaaaggtttttttttttagttattattttcgttttttttaagaatttgtttaataaagcgttgaggaaagagaacgtttttttgaattttttagtaggggcggagtttgttgttgttttgcgttgttatttcggttatattgtttttcgcgacgatttttgattagtcggggttacgttcgggagacgggattatgaagcgttcggtagtcgtttggtttttggtcgggtttagtttcggtgttttttagttcggtaaaggtaaggcgtcgggattcggatagttgggtgagggatgggttgggagttttttgagaaacgtcgcgtagggggtcggaggcggttttttcggcgtgttaagggtggcgagcgtcgttggcggcgcggaggaggcgtcgagttttgggtgtttcgagaaagtgtttgtaaagtttgagtagagtgcgcggggtcgagcggggagaagggtgcggggtatcggggtgagatataggaaagaggaggacggtggggagcggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcgttcgggcgttagttagttgatgcgggaagaggttggggagttgtagggtcgttcgttttcgggtgcggtgttttggcgtagggtttgggttgagtcgttcgtaaatttagattcggcgttgggcgttttggtcgcgg

SEQ ID NO: 7216 - DNA, 2383 bp, synthetic construct
  misc_feature 1..2383: note = Description of Artificial Sequence: Synthetic polynucleotide
  source 1..2383: mol_type = other DNA
cggattttttaggatcgcggcgtcggttggttgtttcggtttttcgcggtcgcgtgagtttttttttggtggtggagggcgtattttaatttggaaatttttagtttttaatttggtttcgtagattgacgtcgttttcggtggggcggtgggggtaggagggtaaaggggaggtttttttttttttggattgaggttgtaattaatagtttcgtgagtttttatttttggttgattgcgaatttttttattttaggttaggggtcgggattttatagaaagattcgtttttatttttaattttgcggtttttgttcggcggggaagtttagttgcgggttagtttagttgcgggttcggttaagtttggcgcgtttaggtattttagtttttggttcgcggtcgggcgaggacggagggggaggggaaggggttgttgtttttttttttaaattcggtttttaatcgttttatttttcgtcgtttattcgttttgtataggtagttaaaatagagttagcggttaattgacggggacgggaagtaaagtcgtttagcgtttcgttttttttagtcggtttttcgggttttttttttcggcgttcggattttggttttttttttttttttttatttttttttttgttttaatttcgtttttatttttcgtttattttttttcgtattcgggttcgttaatttttttttttaagttttttttttagttcggtttttttttcgggttcgttttttttttttttaattttcgttttttttttttttttcgtttttttttttttttttttttttttttttatttaattttggtttttttcgttttttagtttcgattttttttttattttgttttcgtttattttgcgtcggttttttagttcgggttgagttttacgtgtggacggtcgcgtttttattgatagtcgtcgttcgtcggttcgtttcgcgtttcgtcgggtttttaaaattttcgcgtcgcgttttttatcgtcgtattttttttagcgtttagtttttcgtttttttttttgttggtcgtacgtttcggtttcgcgtattttcgttcggtttcgtagtcgttattcgcgtttcgttgttttgtgggatttcgagcgagttcggagggaatttttttttttttttgggggcgatttttgtttgtttgtttgtttttttttggtgatttttgtagttttttaatattcgttttcggagcgtacgggaattcgtcgagttttgcgtgtaggttttttttttttttgaggtttatattttttgaaattttacgttagggtttttgtaattttttttttcgttcgttgacggttttggagtcgttcggggttttaggtcggttatgtaacgtgtatcgttcggggttgtcggttgtattttcgtcgcgtttcgtcgtttattgcgttagattcggcgtttcgcgtttcgtttcgtgggtagttagggggtcggcgttttgtcgaggtttttagttagagtagggagttcgagttcgagggagttttcggagtcgacgaagggtttattagattttgatttttttttgaggcgcgtagattttgtttttgattatttttttttcgcgggtttacggtcgcgcgttttcggcgtcggcgatggggagaagacggaggttgtgtttttagttttattttttgtggttgggttgtgtggtgttttgggcgtagggtacggtcggttagttttagtttttttcgtttaagtcgtttcggttttagtcgtcgtcgtaataggttcggttcgttatagtaggttttgaaggcgggtttttagcgttcgagtatcgcgaggagggtgtcgtagtggttagtcgcgttcgtcggcgaggatagtaggacgtgtttcgagggtaagtgggtaagcggtttcgtatttagggtttcggtttgggggaggggggaatttttagtttggcggttttttggtttatttcgttttagattttttagttggagtttagagttgtagttttttttgttagaatatttaaagatttttaggagcgcgtttttttttttttttttaatttcgtagtttagcgggcggaaagtttttttttcgggggttgggcggcgggtggttagggggtttaggggtgtcgatcgtagagcgtgtgtagagttcgcgttgcgggaataggttttgaatgttcggcggtaggcgggtttgggttcgtttgttgtaggggttagagaagtttgtttgttttttacgtcggggtcgtcgttcgtgagttttttgtttgaggacgtgtgtagggtttatagtttatttttttatcgttaattcgagcgttttattttgcgacgcgttttttttgatacgtcgg

SEQ ID NO: 7217 - DNA, 2367 bp, synthetic construct
  misc_feature 1..2367: note = Description of Artificial Sequence: Synthetic polynucleotide
  source 1..2367: mol_type = other DNA
cgggtcggtttttcgtttcggaggttggggagggggtcgtgggtttttgcgtttttaggttaagcggttttggaggtacggattagtaggacgtcgaggtggcgcgggtcgcggtttttttcgtagtagttgtcggcgagaattaggtagggaggcgtcgttgttgattgtattttatgaaagatttaggttcggttgtcgcgttgttatttttcggtattttgcgtcggaaacggtcgttttggagttcgtggtcgtcggcgggtaggtttagtcgttttagtttttgagaaaggtaggttatagttcgatttgttttgtggttttattttataattttaatagtaagtaggtttaggttgggtatttcggggtattaggagtaggttcggttaattggtttttattatgaggtttcgcgtatagggttatttggttacgaggtaacgttggggagttttgtggtttgagggtgggtaaaggataggtttttagtttttttgcgtttagttcgttttttagcggtagttagttaggaacggtttgcggggttataggggtggaggcgttatcgttcgtaggttcgtagtaggatggtcgttgggggatgtgtaggtataggggttggataaggggttttagaagtgtttgttttgaggggttggtgtgttttttttttattagtttagtttttgaggagagggaagaaggtaatttttttaattagggtaggtcgggcggttgttttattttaatattttttatttttaaatatagaaaatttggggtttgtttttaaatttttttggttgttacgttttgggtagcggattttttttgttaatacgtaagattagttttttttcgtaggttgagtagaaagaagaaaggtttaattttaaaattttaaattcgattattagttttcgtttaaacggaagtagggttagttttttacgagttaggtgggaaattgggtttagggagagaaagtgttttagggttaggttgggattcgttttggtttcgttcgtatgcggtagggtttttttacggaggttttagggcgcgtttttcggtttcgaggttcggtcgttagtcgcgcggattttagtttacgtttcgagggaggttaggatttttagtcggcgggattgcgcgtcgttttttttttcgtaggtttcggcgaatatttagttttttttttttttatttttttcgtttttcggttagtgttttcgtttttttcgcgggcgacgggcggcggcggcgggaggagcgggtcgagtcgaggaagtttcggtttcgcgcgttgggatgtagcgaattagtaggggtcgaagaatcgtgtagtgttagagttagagttggattcggggttttagtcggagtcgaaatttgagttagagttcgcggcgggcgagttcggagtttacgagtcgtagacgtagcgttgtttaggtggggtaagagacgttgggttaggggcgtagggttttcgcggtggaggggcgtagggaggtggcggtcgagttttgcgtagtttgtttttggcgtgtgtgggtttattcggcggcgcgggatagcgtaaggcgcggaaggttaggagttttcgaggtagcgcgaggagttcgtttttgcgtttagggtatagttatagtcgtcgttatcgggtgttattttatttaatcggcgggattaattttttgttttggtttcgggtattttaagagggtagtagtttcgggggtacgggttacggtttcgcgaagggtataatttgagaagttcgtggtagtttttcgtagcgtcgggtgatatagggtttttttatttttaggagaagtgggtaggagagagggtcgttcgttgtttttcgttgcgtttagggatggagggttttattatttatggaattgttggtttttttgcgtggttcgggattttagtcgtggtttcgcgttaagagggtattttttttaaacgaaatcgtttcgttcgttcgttcgttcgttcgttcgggtagtaatgtcgtagaaaagtagtagacgtcggttcgcgttttggtttttttcgtttcggatttcgacgtttcgtcgtagcgttcggaggtgtttttagtttaaggtagtttgttttcgtcggtataggtcgggttttttttttttaggagagaaattttaatttttttcgtaacgtttaataaagatattttcgcggttttttttaggtttggttgttgacgtagggtttcggagtacgtagtcgttttttaagaatcgggtttcggatttttgaaattgattagtttcgtaaattggagtttattttttcgcggtaaaggtagggttttaaagtcgggatcgt

SEQ ID NO: 7218 - DNA, 1235 bp, synthetic construct
  misc_feature 1..1235: note = Description of Artificial Sequence: Synthetic polynucleotide
  source 1..1235: mol_type = other DNA
cgaagtttagtcgatttttgattgttagtatttcggttataaggtttaaggcgaatagttgtcgtacgtcggcgcggttgtggttgtcgaaggagtaaataattttatcgttggggtttttatttagattcgttgtaaggatttgtattacgcgcgtgtcggagggtgtattttttaggacgcgcgttcggtataaggattggttgaagataggcgtattgttattcgcgtttagtattttgatgtgaataggtaggttggcggagagagttggggttttttcgtttaacgtcgttagtattaattggagattaggttttcgttttcggtttagggcgcgttttaatattagtttcgcgtatttggtgttgttttttcgcgtttgtacgcgaagcgtaaagtatttatttcggtttagtttataggtttgtaaagagttgttttttatatcgggatcgtgcgcgttttcgagcggaaagcgcgttttcggagttacggtttcgttaatttttaattttattttttgggtagggaaagtaggattgttgtcgttgatgttttggattattatttttacgttgaatagttttagcgggttttttattattaattttagagttatagtgtaagagggtagtgttttatatagtttttttcgatttagacggtcgtttataaatattttttcggtttttcggtttattttaaagaattttcggttagttttagatattattcggaatttgcgggttgagaggttatcgagatttaaattaaggttcgcgattacgttgtttatagcgaaatttttttttttttttttcgggattttatagtgaatgatcgtggaagttttgtttaaggtattaagtagaagtaaaatttttattattttttcggtgtttattagttcgtttttttaggtttttgggattattttatttaaaagtagttttttttagcggggtttagatcgtttttgagatttcgttgagaaatttttagcgggttagcgtttgggcgttgggcgtcgagttcgatatggttttttggatgtcgttgatttgttcgtcggttgtttagtttttgttttatttcggggcgtagaaaggggacgggtaggggttcgatttttagcgtttttattggtcgatagcggtatatagagttttagttaataattgtacgaagaatgagttagcgtcgggttttttgagtaggatacgcgttagcgt

SEQ ID NO: 7219 - DNA, 3043 bp, synthetic construct
  misc_feature 1..3043: note = Description of Artificial Sequence: Synthetic polynucleotide
  source 1..3043: mol_type = other DNA
cgatttaggagagttcgatacgtcggatagttgcggttagtcgtggttattttggtttttcgttttcgttttttttattttcgcgtgtagtcgggatacgggaaaggaaagttttggaagttaagcgtcggttaaaagatgatttgttcgcgtgttttttcgtttttttttttagtcgtgttatatggcggttttaattaggcgggtagtgcgtttcgtcgcggagatttagggtcgcgtcgtttgggtagtgggtgatgaaattttttaggcgtattatcgtagagggcgcgggcggggcgcggggcgggggtgggggatcgagagttggtatcggggtttatttgttttttaggaggagggtggggacggggggaggggcgagtgcgcgttaacgtcgggtgcgtgttttggggcgtttgggcgcggcgttcgtgttttcgtttttttttagttttgcgagtttttcgagttgcgtcgtggggtgacgggatcgagagtagtttttgttttcggtttcggcgcgggggagacgtgagcgtgtatacgtatatatatagtaggggaagaggcgttttaagcggcgtttaattttttttttttttttacgggtcgggtgagaaagtagtcgggggttatttcgattcggcggtttttggggagggggtcgaataagaaaagggaggagatggagataattttttcggatttagtttttttgtttttgtttttgtttttattatttttatcggatgattggagagtaaaagggaattcggagcggggtggcgagtagcgttttgagaaaatgtaggagtgtgtttggagacgcgtaaagttgttttttaagttttggttttcgggtacgcgatgtttcgcggcgggttgatttagggttgttttgggtttttttgttatttttttggaaatgatgtaagttttgattgttatttggatttttgtagtttagtttggaatgcgtttggattaggggaaagacgagaaacgatattttaggtgttgtacggtttattaaagcgggaagatagggtagttgtttagattaaatattgtatttagtgtttttgtttttatttttaatcgtggggttttttttaatgtaaagtgttataaggttaggaatttttatgtgtgtttagttggtttatagtattattgtgtttaggaaattgttttaatttattaagttttttgggttgggaattttattgaattttaaacggcggaaagaggaaatttttttaattcgatgtgggtgtgacgcgagttaggggttttagggatattgttttagagtatatcgtttttttttaatagtaattggagtttggattcgtttttatattgtatagttttttcgattattgttttggagtattcgtatacgcgtacgtattttcggtcgcgtttatatatatttatatatacgtacgtaaacgcgtggtcgtcgttaggtcggtaattttgttcggcgtttttagcggcgttcggtttttttttgtagtagttgagcgtaggtttcgtttttcggtcgtgttgttaaaagggtcggggtttcggattggtttagtcgtcgggataatatttgttcgatttttttatttaagtgatattagagtttttagggatatttgaggtattatttttgttattgtcgggtattcgcggcgttgttaacggtttggttatatgtttttcggagagttacgggagggcgttgggtaatttttattcgagtcgcggtcgcgaggaggagggaaaaggcgagtaaaaaggaagagtgggaggaggaggggaagcggcgaaggaggaagaggaggaggaggaagaggggagtataaaggatttaggtttttcgacgggaggttaatattaagaattatgtgtgtcgagcggttgggttagtttatgattttggttttggtgttggttatttttgattcggcgcgggggatcgacgttattaatttattcgagggtttttaagataggagtttttagtagaaaggtcgtttgtttttgtagaatataggtaagtgtatgtgttttcgtagtcgggagttattgggagaggatatcgtgtatttacgcggcgcgttttaggcgtttcgtcgggagttaggcgtttatttagggttacgtaaatttttgggatggtacgggacgtgtaaagggaagcgcgaggtaaggcgaggttcgcgtcgggtttcgagggttcggaatttgtacgtgttagtagggtgatgaaatggttggggtaggatttgttgttgttttttttagggtcgaggggaaatgaagtagcgtttgacgttgttagcgttagttttcgttttcgaatttcgggttcggtgtaaagcgcgttttatttcggtcggtacgcgggaggtttagagggttttcggagttgggttgcgttttgcgttcggagaatttttttttttggtttgtcggttttagtaagggtgtcgcgttttttttttttttaaaagatgttcgatattttagaattttgtcggcgagataaatggtattgcgaattttttttttgggggtattgttttcggaagggagcgtgagggtagcgtaaagcgtattttcgcggtgttgtcgttatttttagtttttggttaggttagtaagttaagaaatggtgatacgattcgaatcgtgcgttttttttgttttatcggtttttggtttatcggtaagttgtaaagtagagttaggcgtgtagggtacggggttggttttttttttagttcggaaagagaaagaaaatttgtttatagttttttcgttttacgatttttttttcgattttggggggtcgtgtgaacgcggtagcggcggcgtgcgtgcgtttatcgtacgagttggaatgtacgagtgtttattagggacgttttaagtgagtgaatggcggttttgtgcggttttgtttcggcggcgcgtggggttttacggattttgtcgtttttatatgttggggtcggtatttttattatttcgagattttcgt

SEQ ID NO: 7220 - DNA, 864 bp, synthetic construct
  misc_feature 1..864: note = Description of Artificial Sequence: Synthetic polynucleotide
  source 1..864: mol_type = other DNA
cgcgatttaatttttaattcgcgatttaatttttaattcgtgatttaatttaaaattttcgatttaaattttaattcgcgatattaagtttgcgatttagtttagaattcgcgatttcgtttggtttattttttagtagcgatattggcggttttcgattttttagatttagtgagtttcgtaaagtcgttcggttttcggaagtcgtaggtgtaggcgtcgttgggttcgcgggtttttttggttggttcgggttgttttaggattacggacggaaaatcgtaggcgcgcggtttatttcgttttaaggggagggttcgtttggtcgtgtagttcgtttcgttttttttttcgaagagagatttggtgttggtatgggtatttcgcggttatcggagtggtttttcggatgagtttggtttcggcgttgacgttttggttttgggggttgtttggttggtgttaggtagcggaagacgtttggagagttattcgtttttttttttattcgtttttatcgttgttcgtgttaggacgcgtagtttgtagttgtagtttaggtattggcgcgggatggcggagttttttttggatggcgttagggttatcgagtgtatagtttatttggtttgagggtttgttttttttggatattttttcggattttgatttttggcgttgggtaatttataggatgagatttatcggttgttggcgaagtcgatcgtttgattttgttgtttgggcggttggtttcgggattcgcgttgttggggacgcgggtttggtttgcggtgtttagttatttgttgcgggcgcgttacgtttaggttggtggttgtagtcgtagtttcgcgtttgcgg

SEQ ID NO: 7221 - DNA, 2071 bp, synthetic construct
  misc_feature 1..2071: note = Description of Artificial Sequence: Synthetic polynucleotide
  source 1..2071: mol_type = other DNA
cgttcggtcggcgtcgtttttcggaggttgtgtttttggggtggttggcggcggggttttttcggttcggttcgcggcgtttttttgtcgtcgtttcggggtgtttttgtttcgttgcgagttcggtatcgcggcgacggcggcgcgaagagggaagcgggcggcggcggcggtcgcgttaagatgcgtcgggttatcgtaggttgaggcgttcgtcgttttcgttttttttttcgttcgtttttttttttttcgtttgtttttttcgttcgttcgtttttttttttttttcgttttttttttgcgttttttcgttcgttttttcgcgtttcgtttttttcgtttcgcgttttgcggtgttgtagttgcgggcggttttagttgtttttagatgtgggttgggcggttcgcggggaattttcgcgtcggttgcgagtgcggggtttcggttgtagttcggttgttatggattcgtcggcgggagtcgttcgtcgtttgttttgtttcgtgttgttgttgttgttgttgttgttgtcgtcgtcgtttttgtcgtcgtcgtcgtcgttcgcgaacgttaggttcgtcgtcgtcgtcgattttttaggtaggtgcggttcggtttttatttttcgggattttcgtcggtttggttttgtttcgcgtgtttcgtcgttttttttttaggcgtcgtttagtttgatttgggtaaatttcgcgcgtttcgttcggggttaagttggttaatttcggggtcgggttggtcgcgtagggggcgtttcgtatcgttttcgagcgttttgggtcgggggagtttcggagtattggcggtttttgagtcgcggagggtggggacggagggtcgggaaaagtttcgcggttaagagcgtagagttagttttagcgggttcgaggggggagttagggcgaggcggcgtcggggttcgcgttcggggacgtttcggaggagtcggttgtcgagcgcgtagttttgggttttaaggattggttggggcgtttcgtagggaattttcggagatcggagggattttgttttattttttttagttttcgggcgttcggggagacggggtcggtagcgggttgagcgggagttggataggtaggataggtcgttcgtgttcggggaagtcgagatttcgtcgtttcggaggttggcggtgagggtattcgggcggtaggggttcgtcgaggggtcgtggtatacgggtaagggggttaattcggaatggttttcgagtagttttacgttttgttaaggacggtaggtgtaagggtcgggggattttttgacggggtcgttttttcgggtacggggaggtttttatcgagttttaattttgaacggggtagggggtagagtttttggtaggtaaggttttcggaggagggaacggttggggagtggcggagtttcggagtggtggttttgttaacgttttttttcggttgtaggaaagtcggggaggtgtaggttggtttttggggtcgtttggcggaatgtttttttttttcgtagtggggcggggtttgggggggcgtggtttgtcggcgggtttttgaggtattggggtttcgtggttttcgtcgatttaacgttttttttcgttgtaggcgggtttttggggtacggagcggagcgtattttggcggtgttcgtgcgtattgacgtttagggtcgtttggtgttttacgtggtgtcggtagttacgtttagagtaggggtacgagttcgtagggtcgtttcggttcggatttcgagttttttcggaggtaacgaggaggagtttggtagttattttttttataatgttacggtttttggtcgagatttgtatttgcggttgcggtttaacgttcgtttcgtggcgttcggggttattatggagtggtagggcgagaagggtattattcgcgtggagtttttgttcgggagttgtttttacgtcggagacgtggtcggtttagtcgaagttttttttgtggcgtttagtaattgcgatgggttggtgagtacgtatttttttagttttttttttttcgttgttttcgt

SEQ ID NO: 7222 - DNA, 1170 bp, synthetic construct
  misc_feature 1..1170: note = Description of Artificial Sequence: Synthetic polynucleotide
  source 1..1170: mol_type = other DNA
cgagttcgcgttaagagttacgtcgagacgcgtcgtcggtggggttacgcgagatgtaatcggagagtttaaaattagtttaggattaattttttagggattcgtttaatttttttcgtagaagagtttaagtggggtagtggtcgttataggttgaggatgattttcggacgcgttttaggcgcgatcgtattattcgtttttagtttaaagtttgagtgatttggtattatttttttaattgttttttatttttttcgtatttttgttgtgtttatcgtttttacgtatttgagagtttaaattatgttaagacgatttggagaaacgttcgatttgttttttaagttacgtaaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttattttttttttttatggttttattttcgttgttagtatttcgattttagtttgtaattttgattttgggtttgattataaatgacgaaagatcgcggtagtttttaaagtgcgggagcgagtttcgtattggttagcgcggcggagggatttttttaggaggttttaagtttttaagtttgtggagagatttggtaatagttggtaaggtttgttttagttattttcgttggttttttgtttttgtatttagcgtttgagggcgttattcgttttttttttgcgttttacgtaagcggtttaaggaatttattcgattcggatttcgtttcgtatgttttttaagttttcgttattttcgtaggcgttttagaaaggcgtgatggttttagtttagtgttcgttagttcga

SEQ ID NO: 7223 - DNA, 2168 bp, synthetic construct
  misc_feature 1..2168: note = Description of Artificial Sequence: Synthetic polynucleotide
  source 1..2168: mol_type = other DNA
cgcgttataaacggggatttaatttattgttcgatttttgttagaggcgatttatttgcgtttttgttatcgtattttcgttcgcgtttttgcgttttaggtttttcgttgttttttcgttttttgtagcgcgggagcgttgtttcgtttggtttgttggttttttttagattttggttatttttttcgtggtaggaagggttatatgtattgatagatttttcgttggtggtggttgggtggtggcgaggcgtgttttcgggcgcgtttaaaatttagtagttttttttaagtagtagttttttttatttcgtttttaggattgaggatttagttttcgatgtttttttattttttttcgttttatttcgttattattttttaatttttttagtatatttttaagttttatacgggcgtttgttttttttttgtattttttagttttcgggcgtttcgttcggttgaagtttacgtattttgggatttaattgtttttaattattcgcgtagtttaagtttcgcgtttgtttggttttcgtttcgggagtttgaagttatcgggtagtttattgggtgttttcggggaaaaggtttaagttgtagagatgagagaagtggggttgggggaggggagaggttttagaaggaagattacgaatacgtgcgaagaaataaaagttattacgtgtgtacgcgcgcgggggtttaagggcgcgagcgcggagtacgttttagggggttagggatagtggttttttgtagcgggtatagtagggggcgcgggtatttatacgaaagcgtggtagatgaacgtttagtcgcggggtttttttagtacgttgtataggtagttttgtattcgtcggtatttgacgttgcgtcggtagttttggttattcgtgtaagagagcggtttttttagtaggtttattcgggttttttgtttgtttcggcggtttttttttaggttatcgtcgtcgttatcgagcgtggtcgcgcgggtgtttagtagtagtaggtcgtcgtttttggcggttgtcgagtttagtagtattttgtttcggtcggattttatattttttatgtcgttgtttaagcgtttttcgttcgtcgtcgtcgtcgttgcgtcgttttttatttagagttcggcggcgtcgttttttttttttttcgcgtggtggcggggtatggtattattacgggtatcgcgagggggtcgttagcgtttgcggcgggggtagcggttttatgtgcgtcggcgggttttaaggaggaagtcggcggtcgacggggcgttcgttagttagagatttttgagtcgggggcggggaagtaggtagttagtaaatcgttcgggtttcggggcgggaaaggaggggttgtagaggaggtcgaggagttttaatttttaatagtttttagtttcgaattttaaattcggatttgtttggggcgttattttgagagggttttttttgtttttttattttcgcgattattatttttttttttttaaattgttttcggggatagagtgggggagtgcggggcgtttcgaggcgcgtttttacgcgcgtatatttagttttaggtttttttttttttttttttattttttacgttttgtagcgaaacggttttagaagttttttttcgaggcgcgagttcggtttggttttggtaggggttttgtagttgttcggaaggtgaagttagttttgtgttttgaggagaaattggagatgtaggtcgttgtgttttttcgttgttacgtcgttgcgtcggattttgttattttttcgtaaggggtgagagcgggaatagttttgttttgttttttaggtattatttagtttggaggttggagcgtaaggtaacgtttcgggaagtggtattcgggttttcgtatacgggcgagtttttagtagtttagtggatagattcgtaggacgcggttgttaagttcgcgaggtaaggattaggtattttttcgcgttttattttagtttgcggattgtgattttttattttagtattagataagttcgcgagtaattgaatattttttttagtttatgggtggggtgtggaaagggcgtaaaattttaaagtggttttttcgcggtgagcgagttgtttcggggttttgtttgattgtagcgcga

SEQ ID NO: 7224 - DNA, 2053 bp, synthetic construct
  misc_feature 1..2053: note = Description of Artificial Sequence: Synthetic polynucleotide
  source 1..2053: mol_type = other DNA
cgggaagatttggaggtcggtaaaacggagcggtgcgggatgatgtttgggaatatcggtaaggtgttataaaatgaacgttaaggcggttataagaggacggtcgggaatcgaatttagcgtttagtacggggtttttgtggtcgacgtgacgtggtttcgttaggtggaaatcgtgcgattttttttcgatttaatttacgagagataaagatgtttaaataattacgatcgtcgtcgtatattttgtagggtttcgggggcggaggggaggggagcgttttttcggtagaagcggcggtttaggtttgtttggaggttcgtaatttattatgataaatgtaaagattaattaaggtttgattcgtgtatataggaggtagacggcggttgatagtggaaataattaacgagtatgttttttaatttttgtcgcggttgttgagtatatcgcggttttttaggcgttcgtcgttgtcgttttcgagttttagagtttttagttcggttttggagtggggcgtttttttttagcgaaaaggtgcgaggagcggggtttcgggtggtcggggagggggcgcgtcgggtcgggaggcgcggagttagtcgtttacggagtttaattgtttgtatcggggatcggcgggcggggcgcgttcgagtggtttcgtcgggaaagggcggcgggcgttggagaaggcgtttggcgcgaagttgggcggcgtttcgagggcggaggataggtggtcgcgcgatcgtagttaggtagcgaacggttcgggggttgcgtagcgcggttttaaagtttagttcggtttcgggtttagttcgttgtcgtttgttacgggagcggttttgcgcggagggagggggcgcgagatcgtattttcgggttcggcgcgtttcggtttttgggttttcgtttttttttttttttcggtttagttcgttgttttagacgtgattttcgcggaaggtgttggcgatgcgcgttgttcgggagcgtgtgattaatggtttcgaggtcgtgggcggcgtatgtattagtttttttttggtttggttagggtgtgagggtattcgggagtatagcgaggttatggtagcgggggttttcgggagcgcggcggtggaggaggaggaggaagaggagaagtaggtgacgcgggtcgaagaggtttgttttttttggttttagggttggcgtcgcggcgggtttttcgttttaagtaaagtttggggttacgggcgttgcgtttaggttttttttcgcgtagttttttcggcggggtttgtgtcgtcgtcgttgttagggtaggataaaggtttattaatacgtgatgggatcgcgttttataaatgggattggagcgagagggagttagagatagcgcgagcggagggagcggtagggattgcgcgagcgggacgaggcgacgggcgttcgggttggcggagacgggcggttttacgtcgggttaggcggggttcgcgggaggatttagtgaagagtttgggaaggggcgaggttcgtcggcggtcggagtagcggggcgttagtttcggtcgttgtcgcgggcgggcgttggagatcgggacgtcggcgttcggacggattgatttgttgatcgttcgtcggaggtatattttattttattttatttcgtttcgttagtagttcggcgtcggcgtcgtttttcgtacgttattttttttgttattttttttttttttatttttttttcgttttcgtttttttttgtttttcgcggcgttagcgtttttttttggttcgggcgggggtttcggttttttgtagagtttttcgtagttagtgggggatatttcgttttagcggataattagtttttgagttgggcgagaggtgttaagggagtttttgtttcgaggattaggggatgcgaagggtaagatttggtagagttgcgtttggaaatatttttttcgtttttcgttttttcgggtacgattagtgtggtttttaagtgtttttcgtggagtttttatttcgtgtgagcgaatcgtgcgtcgg

SEQ ID NO: 7225 - DNA, 1679 bp, synthetic construct
  misc_feature 1..1679: note = Description of Artificial Sequence: Synthetic polynucleotide
  source 1..1679: mol_type = other DNA
cgttttttttcgggaagattcgttataagtcgcgtttttcgtcgtttttaatttcggggtcgttttggtcgtttgtgaagtagacgtttacgttattgtcgtcgtttttgggatttttaggtttcgggggatagtcgggttcggtattcgggtcgtcgttcgttttggcgagtagattttggttagggtggcgggatttgatatgtcgttttaggtttcggcggcgtataagtattttgtcgtagaattcgtagcggtagggcgtattgttttcggcgtgtagtcggatgtgtttgttgagattgttggggtcgtcgaagggtcgtagatagattttgtatttgagtggtttgtagttcgtgtgcgttcgtatgtggattttgagtttatatttgcgcgagtatagtttgttatagtagaggtataggtggtcggttttgggtttatttgcgtcgttgttttcgttgtcgtcgttttcggtgtttttcgtcgtcgcgacggtcggtggtaacgttttcgagtttaggcgttcgcgatttttttcggtagttatttcggatagttgttgattgtgtatggcgatttttcggtcgatgttggttagcgattttagttcggcggggtttagggcggtcgttgtaggttcgttgaagtaggagatggatttcggatattttagtagttcgtcgaagtgtaatttgagcgggtaataagcggtggtggtcggtgagtcgtagagtagtttttcgttgtagattgtaaaggtcggtatgacggcgggtaggtggttgtatttattattcggataggttttgagatcgttcgggtcgaggggcggtagcgcgtagcgttcgaggggtaatttcggcgtagggggtagttgcgtataacgcgtttttggtagcgcggcggttgcgggcggggcgcgttttacgtgtttgaaggcggacgtttttttcggggggacggagagtagagggaagtcgcgtagggttttagagtagggtaggttaggcggcggcggcggcggcgggtttttagcgagtaggtatttgggatggtggtggtggtgcgcgtggtggtgatggtggtgattcgcgtcgttcgtcgtcgagtttttttcgttttcggggcgttcgtacgttcggttttcgtttagtagtttgtttaaagcgaggtcggttttttgtttgttgttgtttttttttcggtaggggtcgtcgtgagcggtcgtcgtcgttttcgttaggtcggcgggtttgaaagttgagcgtacgtcggggtagaaagttaggttgtcgattttcgtcgaggagtcgtttacgatgtcgaggaagtgtttttgttttcgggcggtttcgtttatgtttagggtacggtttagttgttttttgttttttttgggttgtttttatttgtttggggtcggcgaggtggtcgagggcgcggaagaggtttcgcgtttgatgttttttcgcgtatcgtaggtttgaattggtggcgggtttagggggtggggtcgtaaagtttttgtttgggaaggcgcggcgaaatcgggcgtcgggggttttggggagagatcgaggttattagtcgttgggacggcgttttggcgagtcgcgtgttcgtggtgtaggaaggcgtcgtttttatcgtcgttgaatacgtagtggaaacgt

SEQ ID NO: 7226 - DNA, 1474 bp, synthetic construct
  misc_feature 1..1474: note = Description of Artificial Sequence: Synthetic polynucleotide
  source 1..1474: mol_type = other DNA
cgcgtgttagaagtttttttcgcgcggtttttttttttttttttttcgtagtaggaggtttgattttcgcgttttgtattcgtgtggattaaacgtttagtttttttcgttataatcggacgggaattcgcgcgtttttcgggttattttttgtttgtgttgagttatgggcgaattttttaaaaaggagatatacgagtgggtcgtttaattttgaggggaaacgaggatttttttttttatttttttttttgatttttttttttattcggatcgtatttttcgaattattttcgtaaggaggaacgacgaatgtcgtcggttttacgagattgtcgttttttatttatgtttaaataaggatagaattttgtagcgaggcgataagaaaataaataagcgggcgttttaaatcgagttttcgggtgtgtagattcgtagcggagtcgcgggagcgaggtgggaaattttggtcgcggcgtcgggtttcgttcgtcggggggcgcggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcgtcgggttttcgtcgagtagttgagttcgtgtgtttcgcgtttcgcgtttcgaagttgtcgtttcgaattttggtcggcgttgtttaggtttttcgttagggattagtcgggtaaggatgggaggcgtagttgtagtcggtttttttttcgcgtcgggttgtgtgcggtttcgcgtttttttggttaaatcgggaagcgaaagttggattttagtttttcggggagtaattttgtcggttttggcggtagttgtttgttttacgcgttcgggtagtcgggggcgtcgttttttgttttttttcgttggtcgcgttttcgaggggttttcggtttttggaggtcgttttttttttcgggtttgggcgttgcggttatagagatttttaacggttagcggtcgtcgtttaggttaggtagttttagcgttttcgggttttcggttttatcgagtgtcggttttcgcgttttgcggcggtaagttttttggtgagtttcgtttttgtttttttcgtcgagttttcggggttttttttcgttttttgtagggtcgtttcgagtcgcgtagagtttgcgtgtagtcgggcgcgcggtgtcgtttatttcgttttcgttcggagagtagggtgggttacggcgtttattttttattttcgcgtttcgagagcgtttggtcgaggaggatcgttgttacggattttttttttttaaggagcgaggttagagggtttcgggagagcgtcgatggttggggattcgaggttcgcgttatttattcgtaattttttttttcgagtttttgggaacgg

SEQ ID NO: 7227 - DNA, 675 bp, synthetic construct
  misc_feature 1..675: note = Description of Artificial Sequence: Synthetic polynucleotide
  source 1..675: mol_type = other DNA
cggtttcggtaattttcgtatttcggttgcgtcggtcgtggtcggacgttcgagacgcgcggaggtatagtagattttggcgtataggttatgtcgtcgtaaacggggggcgcgtatttttttttaaagtttttagaggagatacgtatttggtggtagggggtgtaggcggttgcgaagtagggttgcggaggattatagatttggtatataatatttagatagtttatgatttttcgtagcggagacggttaagtgtttttttattaatttttttttttcggagtttaggggtgttgtatgggcggcgtttggattcgcgttttggagttattaggcggagtaaagttagcgcgtttcgcggttcggaatttagttggttcgttatttttttatttttgcgattttattttcgatcgcgttttagggtagaagcgtttgagttttcgttagtgggtatttaaagtttatgttcggcgggcgtgttgacgttattcgggggttgcggagcgggagggggcggtggggggcggggatcggggggttaatggggagcgagggacgtttgttggaggggtagcgagtgtgtttttcggggtttatttttgataagtatgcggttaagggtgtcggagattatgcggtttttagcggattcgaggtttcgtatcgcga

SEQ ID NO: 7228 - DNA, 1133 bp, synthetic construct
  misc_feature 1..1133: note = Description of Artificial Sequence: Synthetic polynucleotide
  source 1..1133: mol_type = other DNA
cgtcggttatcgtcgagtttttattttatttaattagatcgcggggaaggatacgtaaatttgtcgagggttcgggggtttcgggttgttgttgttgttagcgttttgggaagtgataggtattaggatttgttggtgcggcggcggcggcggcggtagttttagtcgcgttcgttatatatatttttattcgttcggtgtatacgtcgcgtcgcgggtagtgtcgtttgcggaggcgcgttcggggttcgtaggggtagtagcggtagtttggtagcgtcgtcgcgttttcgggtatttggttcgcgaagtttcgtttttgtcgtttttcgcgtcgttcgttttacgttttttagcgcggtcgtcgttcgacgcgcgttcgttttgcgttcgtcgcgcgtcggtttcgggggcggtagaagcgcgcgagggtcgttgttcgtttttttgcgtagttcgcggtttttaggtattttgcgttgttgggttcggcgggcgggggtggggcggggagcggggcgcgggtcgagcgggggcgtttcggtttcgcggttttcggcggttgttgtagcggttgttgcgcgtaatgatgcgggttcgcgtcgcgttttagtagcggcgttgttttttttttcgtttagatgtgtgaattttttttttataataaattttttattttgttttttgtcgtttttttttagggggttaattttgaggatcgtaggggttgtcgtttaggcggtcgtaggcggcggtgtttaggcggaaaggagcggcgcgaaagcggcggcggcggggatcggggtttcggggcgaggagtttgggcggtatgatcgcggtttgttgagttgaagtcggtcgtgtttttagagttatttcgcgggagcgaatcgagtgtgtgtgtgcgcgcgcgttcgggggagaagggattaagaggagggttagggaaggaagttggggttatggaataggggtgtaatcgaggtatttagagcggtcggaaagttcgagtggcggagaggttagaggtggcgagaaggggcgcggcggtatcggacgtatcgtttagtatttggtttttttgggttttcgaggatttgaagggtcggagcgcggagagttacggagtcga

SEQ ID NO: 7229 - DNA, 1808 bp, synthetic construct
  misc_feature 1..1808: note = Description of Artificial Sequence: Synthetic polynucleotide
  source 1..1808: mol_type = other DNA
cgggcgggggacgttcggtagttttgtaaacgcgtagatacgcgaattttatcgtttcgcgcgttttttggtttcgttggtgcgtgtcggggatgcggtcgcgtaggcgttcgttttttggttttttggtcgggtagcgggcgttcggttatcggagtttagtttaagggtttagtcgaggttttttcgcgcgaggcggttgcgttaggtgagcgggtatcgcggtcgcgttttttttgttatttatttagcggttagaggtattttgcgtttgggagttttaagtgttttcggttgggtgtttttgttcgatttttaaaaggaaagtataaatttcgggtgcgagtttaatttaggatcgaattttttcgcgaatttgaagttattatggggcgggagttattttagcgtcgcgttcgttcgtttttcgtatcggttaggatgttgcggaaggtaggggcgtcgagaggtaagggtgaaagacgtcgtttatatttttaaagttcgaatttgtattttttttgcgaggcgtagggcgggaggatcgttgtagttgggagtcggtttcggataggtaaagcgattcgataggtgaacgcggcgggagggagtaaacgcgtaaaaaattttgtatttattttttcgttggcgtttttttcgggaggcgttttggttgtcgatgtattttataaagtttaaaatgataaaaagttaagaaattagtcgtaagtgtatagtaatttagtaatgtttttttttttttttttttttttttttgattgttaattatatttaatgtttttaaaatatatgtaggtgttaggcgtatatagatagtgttcgagtagcgggatttttttttttatattcgataggcgtgttgtgatggtaagcgaagtggggcgggtggatagggaaattaattattgtatttttaaattatttaagtattgaattgcggcggtttcgttggggtggttggtatcgtcgcgaatcggggttttaggagtcgtcggggcggtcgtaggtagtatgttgtgcggtaattgtcgtaggcgggattcgggcgggcgagcggcggcggcggcggttgtagcggcggttttttgggtttagaagttgcggcggttgcggttgtagcggcgggggtttttggagcgtaggggagcgggcgtcgtcggtatagcggttatggttaaggggcggcggagagatttcgagttgtttttggcgtgcgcgagtaggagacgttttagtgttgggttgggttttcgggagtattatataggggaggaggaggaggagggtagggaggggggagggagaggagggtagggagggggagaggaggggggatggttgtggggggcgggggggagttcgggggcggggaaggaaattgttggagtaataattttgagcgattttaataatttttaattttaagagggaaagagggagttggaaaagtataggcgttgcgttttggtagagggacgggaagaggcgtttaaggggtttcgggtttatagcgtagtatttttggatattgtagtgacggtcggagaattttagttagaagaatggggaaagtagtgcgtgcgaagagtttttttagaagggtagttttggcggggagatttgggcgtattggggttggtaggtagtgttgaggtcgaagattttttatttattttagttcggttttttttcgcggttttaagttaggcgtattcggttgtcggtggtcgtgcgtttttgcgtttttgtgttttagcgtttttattttatttttagcgtcggcgcgt

SEQ ID NO: 7230 - DNA, 1323 bp, synthetic construct
  misc_feature 1..1323: note = Description of Artificial Sequence: Synthetic polynucleotide
  source 1..1323: mol_type = other DNA
cggtttcggttgcggtggtcgtttatttatttttttattttcgttagtattttttttttttttttatttgttttgagtatcgggttttgggggtcgggtcgtttttttttgtttttagttttggttttattttaggagttgtcgggacgtcgggcgtttttggaggcggacgaagaaggcggtagggtcgggggcgttagcgggaatttcggtcgtcgcgggtagtcgcggtttttttttttattttagggttcgggcggttatcgcgggcggatgagttaggcgagggggcgggtggtaaggggtgtaagcggacggagggtgggggcgtttttatgttcgcgtcgggggggtatcggaggtttcggggtaggggatgcgtcgttgtcggtgtttatagagggtcgtcgttattcgggcgtagagtttaggcgcgtttgttttcggagggtatcgggcgtagtaagtcgggtaggggagagggagtcgtcgtttaggcggcgtcgttatcgcgtttaagaaagataaaagggatcgggaacgggaggggaaaagttttttgttcggttttagatggattttagttttaaattttacgttataaagtttcgaagaggcgggttgggggcgggggtcggggcggatttttaggggcgtggttgcgcgtttgcgatttcggatcgtgttaatttcgtcgtcgttttaaaatttgtgggaaattttagttttgttatttattttttttggaggacgtagataggatttgttttgtaggagtttaggtcggtcgattcgcgtttcggttataaagttgtatttcgagagtttaaattattcgtagataaaatttatttttgggaataaagtattcgtttgtaggcgtttttttcgggttggaaggttggcgtgcggaaacggatatatttattcgtggggttcgtttttagttatcgcgggattatcggttatcgagttagggattcggtttttttagtttttcggagcggttggggagttttagtcgattcgtagtattttcggagtaggtatcgtaggattttggttttacgtttttcggacgttttttttttagatgtcgttcggcgggtcggggtttttttggcgggttgcgcgggcgttgcgcgagttaaattaaatttggtcggaaaagacgcggttaaggttcgttcggtttacgtttttcgtcggttcggtaaggggtttcggagaacggtttgggggggcgagaattatgggcgggggaaatggaagatagagggaattgaagtacgggggttttcgatgagtagtgcggatgttcga

SEQ ID NO: 7231 - DNA, 1501 bp, synthetic construct
  misc_feature 1..1501: note = Description of Artificial Sequence: Synthetic polynucleotide
  source 1..1501: mol_type = other DNA
cgttattcgagttaatgaacgcgattgttttgataaggcgtttttaattttatcgattttggtaaattgtaggagatatttagtttacgttatataaaaattattaaagtgggatcgtcgtagttgaaaagttcgattagtgtttggagattagaacgcgagtttttaaagtatatacgtattcggtatcgggaaagtttaggcgtttgtgatttttcgaaggattttgggttagtattttcgcgtttggattatttagggggttattagaaagtaatatacgttataagaaagatgtgggggagatttcgatgttcgcgtttttgttaggtggaggcggggtgtaggtagaagtcgcgcgttggattgttggatgaatttcgttacgcgtaggtttcgcgtcgatttcggaagggataggtaggttcggaagggatttttggggtttggggacgttttttagggtagagagtatcgttgcggttcgagcggttcgggtttttaggcgtggggtattcggtttttaagcgtttttcggggacgtaggcgtttacgtatcgtttagttgcgcgtttttagtatttagcgttcggcgttttcggcggagtttcgcgtattttttcggaaagtttgggggtttttttaatttaggttttttcgggagttttggggcgggggttggaagaaggggttatttatttcgtcgttcggttcgtttcgggttttcgaagtgtttgttttagtcgcggtttagtgcgttcgtaattaagtatttattttcgttttttttagtgtcgaagtttttttttcgcgttgtgtttttggtgaaaataggatatttttttcggttattttataataaatagcgtatataagcgggggagaagcggggcggagggagaagtcggtttcgagggggaggaggaaaggagaggagttaaaatttcggattgcgataggggggaaaggagaagaaaagaaaatgagagagcgcgtttagtcgtcgtagtcgttatttttcggtttttttcgtagttttttttttttttttaaggtagcgataattttacgtggataggatggaagttttgcgcggaagtcgggaacggtcggagcgtgcgtcgcgttgtcggtagtttcgtatttgcgtagggaggtggggcgggggcgacgtcgttatcggttattgcgggttcgtgaggtcgtcgggggtttcgggggaggtcgttagggacgcggggggcggcggcgcgcgggggatttatttcgtttttatttgatttcgggtgattgtttattgttatggtttgcgatttcgcgtggggatcgtttagggtttcggggttttggatgtttcgggtggcgtcgtcgtaattttcgtgtttttcgcgtcgtttttatttcgtttttattcgggtcgattcgagcggttgtagtttttaggttgaggggagggattcgcgatcgcgtttttttttttgggtcggagagttattgtcga

SEQ ID NO: 7232 - DNA, 1744 bp, synthetic construct
  misc_feature 1..1744: note = Description of Artificial Sequence: Synthetic polynucleotide
  source 1..1744: mol_type = other DNA
cgttttcgcggttgttttttttttagggtcgtcggtggtttaggatttggttatcggggaggggcgtggttttgtcgaagtcgatgagttatacgtcggcgcgatggtagtgatcgtgtataaagaggagcgagttgtcgattatttgcgagtttcgtatcgttaggtcgcggttttgtttagagacgtttttgtcgggttttcgttttagttttcgcggttcgggtattcgggtagtcgtcgtttatttcgtgttttttgaagaattcggatatttttagggtgtttcggatttgttgtaggcggtttagatatcgtttttgtagagggtggggtgggagaggagggtaaattaattaaacgttaaatgagtttttgttaacgatgaggagtcgggatttacgttgtgtttggtaaatgtcgttaggaggaggatttagggtttcgtttagcgtggtttagaagggaaggagcgtagagtagttgcgagttagcgcggtgagggttatggtggggatatagtcgagggtattgggttagatgataggggtagttttcggttttaggttttttaatattttagggtttgggatttcgtttttattagtatttttttatttttttgtataaattttttaaagacgcgaagtatttgttttcggtttcgcgtagttttgaagtcggtgttgtaggagtcgttcgttttttggatgtgggataggagtgttaggggtttcgggttcgttagtggggaagaggatagcgtagagtagcggtattttttagttgtaggggacggcgaggcggtgggagagggcggaggggtaggcggggcgggagcgggggatcgggaaagatagcgcgtagtggggttgcggcggtgttagcgaagcgcgtttgttttattttgatgttttcgatgcggaagtcgagggtggtgttggagttgatgttttttcgttattgtatgtagcgcggtttggtgacggcgcgttgcgcgtgtttttttttcgtgggagttttaggatttatcgttagtatttttttgtatatgttttttcgtagtttgggtcgtttacgggttttggttagttttttttttaggtaagttttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattagtgtgttttgttagttgtatttaggcgtagcgttttttgaaagggtttatgatcggtagattgattatggttcggattttttgttagtggtttttttgaaagcgatagggttaaggtttgataatcggcgtttcggtaatgtataagttttttttttattgaaatagggtttcgttacgttttcgatttatcgg

SEQ ID NO: 7233 - DNA, 1801 bp, synthetic construct
  misc_feature 1..1801: note = Description of Artificial Sequence: Synthetic polynucleotide
  source 1..1801: mol_type = other DNA
cgcgtagtttaggatagtagcgcgcgggttacgggcgagtggagttgtaggggttcgggcggagagtcgttgttatttagggaagttttcgggatttcgggtttttcgcgaagtttcggacgggcgttatcgaagtcgagagtttcggtcgagttttttcgtacggtgggcgtcgcgtttaggcgagcgcgcgaggtcgggcggggtcgggggtcgttcggggagggggcggggtcgggattttcgcggtcgcgcgtaggggttgggaagttgttttttcggtcgcgtcgggcgaggggttgcgtcggttcgcgaggcgtatgcgcgttgtcgagcggttttcgtttttttttcgtttatcgttttttttttttttttttttttttttgtattttcgtcgtttttttttttttttcgtttgttgggtgttgaagttgggcggatggtagtaaatcggtttcgttagaggatcgagtcgtttagtttcgttttttcggatttatcggcgcgttgtttatatttttaggcgatcgggtaagacgttgtttttaaaataagcggtgttaagtaaatgatattaaaatgtttgttttgtattaatggatggattttttttaaggtaggggggaggtgaaggaaggagggggcggagagcgcgatcgtttatgtttcggcgggggcggttgcgcggcgttggggttttagttgtggtcgcggcgttttgagcgggagcgggggtcgcgtcgcgggttcgggaagttgaatttcgcgtcgttgtttggacgcggttcgttcgtcgtttttagttgttgtagggaatcgggcgagtgttttgttcgtcggggaacgttcggttaggttttagagttttcgcggagagcggggcgtttgttgggggcggtcgggagggtcgggttaggggcgcgggagatttcgcggggacgcgaggtgttgcgggttttgtgcggttggttgggaacgaggagaatgtgttattaatagtgtttaatcgattgattattttgggtgttgtgtttttttttttatttttttttatttttgggaaaatgtattgtttaggtggggaaggtgttcgaagaagaggttgcgaaaatgaattttttgattagtagtaaaatatcggaggggtgtgtgtgtgtgtgtgtgtgtgtgtatgtgtatgtatgtatagggggtggggggttttttttgtttttttttttttttttagttaaaggaaagggagttttggcgtgtgcggcgcggggtggattttatagttatcgagggggcgaggacgaggaacgtttattaatcgcgagtcgttgttcgggtgggcgtatcggagttttttttgttgtaggtgatggtggttttttcgtgatcgatggaattatagtttaatttttgttttttcgttagtttttttgttgttttttatcgagtgttgcggtagaggttgggtgtagatacggtcgttttttttttttttttttgtttttttgtttttttgaataaatgtcggaggattaggggatggcggagggatagagttggattcggaagtcgcgggtgggagttgtttttcgcgagttcgaggttgttggtattttgtcgcgggtagttcgcgttagtttcgggagtttttgggtttcgggagagcgagtcggggtcgtttggttataaagatgttcgcgcgttcgttttgcgtacgggattcgttttgcgttttgagttttgcgtttcgttcggagttcgggacgtcggtttacgtgggagaatttttgtcgttcggggacga

SEQ ID NO: 7234 - DNA, 1801 bp, synthetic construct; identical to SEQ ID NO: 7233
  misc_feature 1..1801: note = Description of Artificial Sequence: Synthetic polynucleotide
  source 1..1801: mol_type = other DNA

SEQ ID NO: 7235 - DNA, 1684 bp, synthetic construct
  misc_feature 1..1684: note = Description of Artificial Sequence: Synthetic polynucleotide
  source 1..1684: mol_type = other DNA
cgtttttttcgggcgcgcgggttttttgtcgtttggagtcgagttggtattggagcgttttttttttggagcgtagaggtattcgacgttttgcggtagttcgtagttttttttttacgattttttagaatagttttgttttgttttttttcggtttttcgagtgcgttcgttattttgtttcgcgagaggtgaacgcggagaaagtaggatgattatttacgttttcgagaaattttgggtaaagaaaggtattattttagttcgtacgttgaaagtcgtttttttttttttttttttttcgttgtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagcgtcgggggttcgggcgcggcgcgtatttgaggtcgtcgtcgaggaggcgacggggagtagcgcggttaagagtagtagcgtcgtttaggatagtcggcgcggcgcgcgtagggtcgtttcggtttcgggggttatcgagagttcggggtgggtcggggttgggtgtttgcggttggtaggggggcgttggtcggagtttggggagtgtcgaggcgtcgtcgtcgggttttcgtcgtcgttcgtttgttttgcgcgttttgcgcggtgttcgtcgcgtttttgtttcgcggcgatcgttttcggtcgtatatcggtagtcgcgtttcgttattgaggtcgtcgatttttcgtcgagttttttagttgcgttcgggcgttttttgtcggtgtgcggggtcggggttagggtcggcgggggcgattcgggcgataggggcgacgggggcggcggggttcgggttggaggcgggcggggcgcgggacgaaggggtcggagcgtttcggattgatttagcggttttgaatttggggcggtcgttgtgtcgggttaagtggttgaggaagttttttttttcgtttaatttttttattttttggttggggaagtcgtttatcgcgtcgaggagtgttttttgtttttttatagaaatatttttgcgttttaagtggggattcgggtcgggattttttattcggttcgtagcgttgtagtttttgtggttagtttagtttttttacgtttttattcgtattcggcgcgtttacgttaggggtttttagcgtttttagattttgtttcgtttggttgttatttttagggcgcgtacgatgcgggtcgaaaaggaatttagtttttagtgtgttttgttgtttaggttaaggatttagcggatttcgttttttttttttttgtaattgtaatattgttttaggtttttttatttttttttttttttatttttttttttagtttggaagtttcgcggttttttagatggattcggagcgtttttggaggttatagtgatttaagttttaggaaggtcgggttttggacgtcgcgtgttgttgttcgtcgtcgatcggtgttttcgtagagataatttggttgaatttatcgtttagcgt

SEQ ID NO: 7236 - DNA, 6657 bp, synthetic construct
  misc_feature 1..6657: note = Description of Artificial Sequence: Synthetic polynucleotide
  source 1..6657: mol_type = other DNA
cgtgcgtgattggacggttttcgcgcggagcgaggaggttcgtagcgtcggggggagggcggtttagtagggagggcgatgcgagtttggggaggggttagcgattcggttaggaggtgaggatagttttttaattttcgggaagggaagggtagggggtcgcgtttggggggcgtcgggtagggtgcggacggcgaagggggacggaagggagagaggcgttggggaagggatttttcggaggtacggggtagcgtgcgggttgcggtagcgatttcgattcgggttttcgggttttgtcgggttgagtttgcgttcgtttcgtcgtcgttaagtttttttaattttgttcgttgcgttcggatcgcgcgttaggtttgggggcgtagtaggggttgggggcgtacgttgcgtattcggggacgttcggggttcgaggtggcggggggtttggtcgcgtcgtttttcgggggtggttcgggttttaagttttttaggtttagcgttcggtcgcgttcgtcgtttatttgttcgttcggtttcggtttcggggttgcgttcgtagtcgtcgtcgttttttaagttttaatttcgttttcgggattgaaatttttttttagtttcgtttatcgatttgcgcgcgcggtttcgtttttcgtcgcgcggtcgggggggaatttaagttcgttttgttttttttcgttttttttttttttttttttttttttttttttttttttttcgtttttttgttcgtttgcgcgtttttttttatttttttttttttcgtcgcgagttcggttcggagtttttggttttttttttttttttttggtttttcgagttttttgtttttttcggtttttcgcggtaattcgttttttttttttttcggcgacgcgtaggggttggggaaggaggggaggttttagaaagcgtagggggcgttttcgcggttcgttttcggtttttttcgtttatatttaaaaggtggagggggtgggtgggtgggtggggggagtgggggcgatagttgttggttgaataagttattcgcgatttttattattttaagtaaagttaaggcgtttttaggttttttcgtcggttcgttttttattcgggagggtagggatttaggggcggagaacgtagggcgtaggtcgggttttttttgtttagttttggtttcgttttttttttttatttattttaatttttgtgaggattttagggggttttggagtatttttcggtttagttttattttgataatttgtttgtgcggaagttttcgttcgtatgttataggaagggaaattgagttaagagaggtttagaatttggttttatatagcgcgtcgaaggtagagttttaggggtagtttggattttcggtaggagtttcgggattttacgtttgggtcgggtaggtttcggcggtgtttggataagttcgcgttcgtagaacggtcggcgtttggggattttttttagttttcgcgtagttcgcgcgttttcgtcggcgtttttttttcgttttttgtttttcgttcgtttttggttttcggttttagtattttcggtacgtttttcgttcgtcgttagtagttgggtaatttaacgagtatataaaagagttgatttaatttaaaggtagtaaattaagataaattttatagtgtgtggggatcggagagggaatgtgaatgaacgtttacgacgtcgtttagttttgtatggatcggtttagttcggttgtagggtttgatacgttcgggttttagggttttttaggagttagaatcggagagtgggttttgagttgttttggtttttaggtttttagtattggttcgaatttagtaatttagagtttgtggtttttttcggttggttgggtggggttttcgtgataggggtgtagagttttgaaggggagtgttaggacgaaagttagtgcgtttttacgattttatgtaaatattggggggtaggggttttggaaatttagtatagttttaggggtcggtaggaagggtatcggtggtttggaatatttaagttgtggtttttttttttttgtttcgatttggattacggttagagttaggtcgtaggttaagagtaggtttttgtttatttattagatagatattgtaagtttgggatgtgttaggtttgggtttgtggaacgaggtcggcggtgagcggggtatttttttttttttgtttgtttgtgaggtttttttagttgtagttttattagggagaagttggtcggtttttagagtttttttggttacgtttggaaggttttagtaagttattttttagtttttggtttggttagttttgtgtagaagatgattatcgggtttcgggttttagtttatttatttcgtttgttaaatataaattttaagagaggtattggatttttatttttagtaggtttttttaggtttgtgttggttaagtgtagtcgaagttttggaatgagttttttttgttttcgtaggtgtttttcgtgtgttttgcgttgtgttgggcgtttgttcggaggagtcgcgttaggacgttttgttattttttaggagtaggtatgatgagtttattttttcggggtgtaaattgaggtcgagggtttttttagagcgtttttgatcggtattgtttgattttagaggttagttttgcggttattcggggtttgagatttacggagaattttagaggttaatttgaggggcgggtaggggtacgcgcgcggggtcgtgggaggcgagatttcgtaatttgaggagttaggattttagtagagagcgaaatttggagttgggggaggggacggtagaggattggaggtcgggttgtacggtaggggtcgagttttcgcggtcgttttttttttttatttcgagcggaggttgcgtcgttcggttgcgatcgagttttcggagtttcggtcgggtcgtttttttttcgtggtcgcgtcgattggcggtttgttgttattcggacgtcggcgtcgtcgtcgcgaggatatttgttcggggtttaacgtcgcgttttacgttttttgttttttttttagatttagaatcggggagaggacgcggcggtgaagttgggaggttggaatttggagggcggcggagtttcggagttaacggggcggggggcggggtcggcgttggttttggggataaagatttttacgttgtttgagggttgggttttgtagatatcgaggtaggaagaaggatttcgtatttttcgttttttagatttttaaatttatttaggtttagatttgagtgtttaggtggggtgggggagatcgaatttttttgggttttcgaggcgcgcgaaggcgacgttgaaggggggacgtcgggacgttgttttttttttgtatacgtcgttcgagttgtatttttaaacgttttaggagtttcgcgggttttttttgttttttataattttcgaagttgtttttagcgattttttttcgtttttagatggggtcgtaggggcgggcgaatgtgttgcgttcgtcgtgggttgggaggaagggcgcggattgtaggaagtttttgtttttttttgggtagtttggtttcggggattcgcgtttagttcgcggcggaggattcggtcgggaatggtgttgagattgcgcgggtacggtttagggtcgtgatcgggtggttatcgtgtagtttgggaagagaaaaagttcgggggggggtcgatatttcgagatcgaagagggaaaatgggaggaaagtaggcggtagggagggaagagcggcggaagagggattaggagagttgggggttcgttttgggtttcggggtttcgttttattcggtagtttagtttagtttagtttcgttgcgttagtttttcggatcgggagaggttagggttatcgacgtttattaatagtcgcgagcgggtttttttcgggagtttcgtagcggtcggtagagtttagttatcggttggggtgggggcgggggtttcgtaatatttttttcggaggtttaagcggcgcggggcggggcgttgcgtttttttacgtcggttttgcgaagtcgaggtatttatagtttattttttttttattttcgatttcgagattaggttttagatgaagaggggttcgtttgtggtttaatttggggcgtcgcggttattttagcgtattcgaaggcgcgtttagttttttttttttttttttgtttagtcggttttttgtttttagcgcgtttcggaaagtttcggggttttcgcggcgtttttttagttttaggggttcggagttttggtttttttagtcgcggcgtcggggagggaagtttgttcggtttaggttcggcggtcgttaatttcgggtgcgttcgttttcgaatttgggtgggtggatggggacgttcgggagtcgcgggtttcgagcgtcgtatttagagtttcgcgggcggggagattcggttttggcgcggacgtcgaggttagggtattagggatggggtggttcgggttgcgagagtcgttggggattttgcgttgtttttcgtcgttttttttagagagtatttttttttttgttttttttaggggcggggatttttcgatttcgtagcggcgatagaggggtttttcggtttcggatagttttttgttttttaggtttttttttatttgggtcggggtgcgggtttcgggttggaggtattgtcgcgggcgagtagagcgcgcgtatttcggtttttcgagtgcggcggcggcggcggcggtttttttttttttttttttttttttttttttcgggttcgttggttttagatagtttttttttttttttcgttttgtcggtttttttcggagttcgttcggttggattcggtttgcgattcggagtttagcggagtcggcgggagttaggttgcggcgtttattgcgttaagcgcggggcgagcgcggggcggcggcggcggggatcgcgcgttcggagttcggggttggtcgggtaggcgggggagcggcggtttcggtttcgattcgggttcgggcgcgggcgtagtggtggcggtcgcggtagcgtcgaggttgtagtatattttttttgagcgtgatggaaggttttatgtgggagagcgcgcggggagggatggggagggggcgggggtcgcggcgggggcgatcggaggggcggggggcggggtcgttgttcgtacgtcggtgggttggggggtggtcggaggggggtttcggaggggaagttggagttagtcgcgggggcggcgtgggaagtcgagtggcggtttcgttttttttttttggttcgtttcgttcgttttttgttttcgttttaggttatttagaggtttttaggtttcggtttggaagagaagcgttcgaaggtttgggggtcgggattttggtggcgttgggaggtgggtttttgggtggggatacggttgtgtttataggcgttcggtaatttcgtggaagttgattttaagttagattttttgtgagcgcgcgcgttcgcgagggttaaagtatagttcgtaggacgcgcgtttgcggggcggggggagagcggggtatttgggggcggggaggtggagcgagagggtcgtcgggtttttggcggtttcgcgtttttagagattcgtttttttttaaggtcgtcgatttttttttttttttttttttcgttgcgcgtcgtttttcgtttttcggtcgggaggagggggaggcgtgggagcggttcggcgtttttcgattttcggaaggttcggtttagcggatttttttttttttttatgtgttttcggaattttagcggattcgaaatcgcgttttcgggttttgagtcgaggggtttttcgtcgttttttggtggtttcgagttttcgtcgagcggttttacggttttttagggcgtttttcgtttttattcgttttttttttagtttgcggttttcgtgtgggttaaaaattttaaattaggtttaagagcgttttcgttcggttaagttttcgcgcgtcgttttataaatcggtcgcgtgcggagttgcggagttcgggatttttagcgcgcgttgggcgcgatattttggatttcgttgttagcgtcgcgttttttcggtcggggagttttatatcgttaagagggtagggagaggggaggggaggggattattggaggggagggggttgtttttcgggtgtttttttcggaggaggtttcgggataggggtgggggtggcgcgggaggtcgtagatagcgcgtttcgaggatggtcgggtcggggatgggcgcgcggggtttttgttcggacgtgggtttaacggttttttcgtagtttagaaatttcgtttagttcgcgggacggtcgttcgtttttcgatttcgagtttttattatatttgtttttgtaggacggggttggggggattgagatcgtgattgaggtcggggtatggaggaagtgtcgtcgtttgttttcgggattgttggatacgaagggtggaggttaaggacggagtttttgtttgcggttgtttagtttttagtttttgcgcgggggcgtttagatttttagggaatagggagatagagcgggtcgagttcgg

SEQ ID NO: 7237 - DNA, 546 bp, synthetic construct
  misc_feature 1..546: note = Description of Artificial Sequence: Synthetic polynucleotide
  source 1..546: mol_type = other DNA
cggaggcggcggggtcgcgggagggagggggtcgggtttaggcgattggtagcgcgagttcgggagttttttcgtgttttcgttcgtttcgttttcgttattatttgttcgggatttggcgtcggcggtttcgggcgtttttagtttcggttcgggtttcggtttcggtttcgggcgtcgattaggtttttttggttttcgtcgcgcgttttttaatttgttgttgtcgtcgtcgcgttttttaggttttgttagttattcgcgttttgagttcggggttagatttttatggaagcgtcgcgatgttcgtttttcggttgttggatttttagaagacgaaatacgcgaggtgagcggcggtcgcggaggttcgcggggagggagggaggggcgcgcggcggcgggggtcgcggaggttattttggttttcgggtttcgtcgttcggagcgttagaggggatcggcggatttttgattttcgttcgagaaaattaggatttaggtagtttcgttttttcgttgggatggagtaatcggggcgttcgc

SEQ ID NO: 7238 - DNA, 288 bp, synthetic construct
  misc_feature 1..288: note = Description of Artificial Sequence: Synthetic polynucleotide
  source 1..288: mol_type = other DNA
cgcgcggcgtattgcgggtcgggaacgtgttgcgcgttgatatcgggttagttttttgtgatgggattttttttttaaaaacgtaggcgttttttcgggtcgtagtcgtagtcgggagattgagggttagggcgcggtcgcggggttttttgggtcggggcgcggtttacgttttaggtttttgcggttttgattagaagtcgttgcgtttttggtcgttttttattcgtttcgttttcgtaattttaggtttagggttatagcggtttagttttttttttttcgcga

SEQ ID NO: 7239 - DNA, 947 bp, synthetic construct
  misc_feature 1..947: note = Description of Artificial Sequence: Synthetic polynucleotide
  source 1..947: mol_type = other DNA
cgtgaggtcgcggtgttagtttatattttattgtgggtggcgggttcggtttcgcgaggaggcgtcgtttttaaattttacggtttcgcgtagcgaagaggcgaggcggtcgcggaaggtaggcgtagtttatttttttcgagaggtttcgatatttttcgggtgagtttcgaaaagcgcgcggggatttcggttgagcgttgggtcgttagtaattcggtttttagagagttatacgaaggaggggaagcggttttttttggggtttttgggaggtttggttcgggtttttttcgtagttttcggcggttagtttcgcggttttggggcgttcggatcgagtaaaggtttcggcgggcgggtttttttttcgttttttttaagcgttcgtttttcgtcggtttagcgtaggttttttcgatttcgttagcgtagggggcgcggttgtcggggatttagtagcgggcgcgcgggtaagtgcgcggcgggcgcgggttgcgggattcgtttcgggttttatttcggattttttttggtttgtttgggtgtttcgggtcgggggtagtcgaggtcgcgcggcgttttttttttgggttatttttttttcgtttttttttaggggagacgaatcgattggttgttcggtcgtcggaacggtaggtttcgtcgtttttttcgtttttcgtattttcggttcggtttttttttattatcgcgtttcgttttaattcgtagttagtattttttttttatttttttttcgttttcgttgttatttttttttttggatgttggaagcgtagttggtattttcgtttttttaattttttaaattttttttttttattcgtttattttttgtgtttcggttttttttttgggtgttgcggaggttttttcggttcgggggcgtgtgtgtagggaggcggatcgcggaatagatacgg

SEQ ID NO: 7240 - DNA, 1313 bp, synthetic construct
  misc_feature 1..1313: note = Description of Artificial Sequence: Synthetic polynucleotide
  source 1..1313: mol_type = other DNA
cgagaatttgtcgtagggggagatttcgtcgttaggttttgggaattgtttgggcgtcgttaaagttcgagtcggagttgttatttggggtagcggtcgggaagaggtaacgatgttagtaagaaagtagcggaggtaggaggcggtcggaggagtggattggagcggacggagtttcgtcgttttttagttcggagcgtttggagcgaaagttaagcgtttttcgagggcgatttttttttttcgggcgcgcgtttattcgttgtagtcggtagttcggcgggagaggtggtagttgtagtttcgtatcggggagagcgagttttttgcgcgcgcgtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcggcgcggcggttatcgagcgtttcggtatttacgcggcgcggggtttttagggtggttttaggatatagtcgaattttatagtttattagtattcggggtcggatttttttttggttcgttaaaatgtttataaatatagattattttttagaaaaaaatgtatcgtattttttttattttttgttttgtgatttgtttattggattaagtaatttcgcggttgttgtcgagaattaatttttgtaaataagtatattttcgagatggtttttgcggtaagtgtaataaaagtggttaaatgtaaaagttttagaagtggtcgagtcgtatttttaggaatttattaaataagtgtggagaaggtaagagcggagttcgggtgaagggattacgttggattgagtaaagattataatatattttatttagagtgtattatattattttttcggtgacgttacgtgggatttttgaatttttaaattattgcggttcgttggggagggacggagcgaggggcggggtcggcgcgtcgagggggtaggtttcgtttcggtttcgtttcgatttcgtttcgtttgcgcggattttggtgtattcgttcgggagcggtagcggcgggggcgattgcgtaagtaatagtttgtagagtttagcgtcgtgtgatacgg

SEQ ID NO: 7241 - DNA, 848 bp, synthetic construct
  misc_feature 1..848: note = Description of Artificial Sequence: Synthetic polynucleotide
  source 1..848: mol_type = other DNA
cgcgaagtttcgcggtttttgcgtgttttggtttcgggaggataaggatttttttttttttttatttgcgcgcggagtcgagtttttgttgaggtgagggtttcggaagtttacgtagtttcgtaggtcggtggtggtcgcggttgttttgcgggggtgagtgtgttcggtcggggtcggagtttagcgtgtgttcggtagacggcggtgttcgcgcgttttttttttcgcgttcgcggtgatagtttagatattagttcgggcgttgatagacgattttttttatttgttagttttttcgtttgttagtagagttgttggtaagtgagagaaaatagaggggcgcgaaggtaggcgcggttagggagtgagcggggcgttgggcgcggggcggagtcgggtgcgcggcgttcgggttaggttttatcgttcgcgtcggttttcgttttgtttagtcgtcgtttttttttttttttttatttttttttttttttatttagtttttttttttatttttaaattttttagttgcgcgttgatcgtttttgtggttttgtttgggggtagggggagaatacgaatagattcgaggtgtttttttttggagttggagtttaattttaatttttatttttatttttatttttgtgtttatttttgggtattagttcgggattatggttggttttcgtagttgttttcggagcgtatttggggttatggtttgtcgcgatcggagttcgttttaagtcggagtttgggggcgtagaagggggagcgcgtcgagaaagtgtcgggtaaacgcgcgtcgcgtttggttgggtatcgcgagttgggcgaggagacgg

SEQ ID NO: 7242 - DNA, 2406 bp, synthetic construct
  misc_feature 1..2406: note = Description of Artificial Sequence: Synthetic polynucleotide
  source 1..2406: mol_type = other DNA
cgggggaggggtatacgtagttttcgtgcggaaagatggtgttttttttttatagggttgcgcgggtatttattttcgttgtaaagcgttcgggttaggcgcggtttgtttcgggtcggggcgagttcgttgttttttgcggtagatagcgatgcgcgtttttcgttttagttttcggttcgttcggcggttcgcgcgttttttcggtgtagtatgcgggcgttgtgacgttttcggataaatgtcgtgtaattgtgtaggcgaatgagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatttaatgtgattcggttgattatgtaaagattaggattggacgtttttgtagttttatttcgttatttatttttttttttttatttcgtattagaaataaagtggggggggggggcgagtttttggaggagaaaatgataattggtatttaattttaggtttatagtgcgtcgcggtggggcgtaaagacgtaaattttcgggatggcgagttttcggggttttattgggttaaacgaaaattgatttgatttgttttttaatattcgagggagagaaggggagatgaggggagggagggtagggtttgagtgtgtgcgtgtgcgtgtgcgtgtgtgtgtgtttggggagggggaggaggtattaagttgtagtttgcgcgcggttttgcgtttcggcggggttgcgtgcgtgtgtttttgttcgcgttgttgaaacgggtttttcgagggatcggcgttatatgatttcgtttgtttttcgttagcgcgtagatcgttagttttttagtttgttcggtatcggaggagggtcgggcggtatttttcgggtattggggttttgcggagcggagaagaggttttagcggggaatggtatatttggatttaagaagtcgcggttcggcgttagattttggagtgtagatatttggggggaggggagagttagagggagcgagcgagcgagcgttagagagaggtagcgcgtagcgcgtacggacggggggttgttgcgcggagaagatgtaagcgcgtggggtttcgttggtttttgagtattatgtagaaggggattcggttgaatgatggttacgtcgcgtttttgggattgttggcgcgtaaggacggtacgcgtaaaggttatttgagtaagcggagttcggataatataaaatggtaaattaagtggttcgcgttgttgtagaatttgtttttttatttcgagagcgattcgagttcgcggttttcggggttttatttgttggagggttgcgtttgcgatcgcgcgtttttttttaagtcggcgttgtcggttaaggagtcgttggagaaataggtgaggcgagcgtcgcgttttgatttttttgcgtttcggtcgcggttttgggggtttagggttttcggttggttgatggcgtttgaattttggtttttttatttttggcgttttaggcgttttttgtatttttagcgagaggggaggtttgtttttagttaggcgagtgattgcggcgggtagagggggtagggattgagggcggggagtagatgtgggttgcggttgtttttcgtcggacgagtttcgtgggaggcgggtatagaggggtcgatatttggagatgtagaggaagatggggttttaaggattagagacgatgagtttggatatacgtttagttaaaaatggtgtttttaatttttatttttatcgtttagttttaatagtttcgatcgtttgttttatatcgggaacgtgtaatttttcgcgtttaggtatgggaagggtaagacggaggcgttcgagcgttgttagtttttgtttcgtcgtagttgagggcggagagcggtttgcgttagtttttcggagttgggttggggttatggggttatacgggtcggttcggtattatcgagcggtggtgggtttttagttggcggtcgtcggagtaataagtttaaagatttttaaggatcgttttgatgcgtcggggttagggttagggttgttgcggaggtagcgggacgaagtgggcgttttttttttttttcgttttttgcgtcgtcgtcgtcgtcgtagtcgcggttatagcgttgcgt

SEQ ID NO: 7243 - DNA, 1218 bp, synthetic construct
  misc_feature 1..1218: note = Description of Artificial Sequence: Synthetic polynucleotide
  source 1..1218: mol_type = other DNA
cggatttacgtcggttttgttacgtgttgttcgtagttttcgttcgtttttttcgcgttggtaacgggtattgattgttcgatattttagcgatcgtagagatttttttaatgtcgggcgtattatcggcgggttagcggtttcgttggtttttttgatatattttttatagttattttttttagttgagatttttttttttaatatttcgttaattaacgtgtaattttttggttaaaatgttagagttaagattaaatttgaagaaaagaatgaaattataggaagttttttagatttagtcgttagtaaggttatggttcgaagcggtgtaggggcggcgcgtcgggaagttattggtagagttgtgcgtattggggggtgttgtaagcgttggggagagtgtggagaggttgcgtggagttgcgcgttcggggtgggagttgtatttttaatgaagcgcgtgaagggtaagcggtgatgggttttgcgttagtggggttgggagcgtgttgggggttgtacgtggggttgcgcgtaaggtgagaattgcgtatgtgggtttggggattgcgcgtatcgaaggttgtaggcgttggggagggtgttgggggttgtgcgtggggttgtttttatcggaagttgtacgttcggggaagcgtagaggcggggtgttgcgcgcgttggggagtacgtggggggatacgtagggggatacgtagggattgttcgcgcgaatggtttcgaacgtatgcgttttattttatattttatagtcgttatgacgatcgggaggttcgttcgttaacggttagttaacggttgcggggataagttcgttgaggttgttaggcgagttaggtttttttggatttcgtttgattcggatgggttgtgtttgaaattgatttagttttattagggattatgaagaaataaggagtaaatttaaagtcgttgtaattttttcgttttagttcgtttaagcggtcgtacggggtttttttcgttcgggagttggaggtggaaaagtcggttttaggcggcgggaaattgttagggggcgttaggaggtttttttcggggaggattttaaatttgaaaaagcgaaaaggtttggagttaaaggtggtggttaagatttttttcgattttttttagttcgttcgtaattttttggcgtagtttcgggaagaggtgtacgaattgtaggcgcgg

SEQ ID NO: 7244 - DNA, 1848 bp, synthetic construct
  misc_feature 1..1848: note = Description of Artificial Sequence: Synthetic polynucleotide
  source 1..1848: mol_type = other DNA
cgtagtacgagtgttagggcgcgtatttggggggtgttttggcggtgtggagagagaagagagagggcgcgggtgatattacgttcgggttttttttttttcgtcgggtgggtggggtttcggcgcgtcgggagggcgcggggttaagtagggggaagaggaggagtaggtatgaatgtgtttgtgtgaagatcggggaggggtggaggaggaggaggaggaggagaaggaggaggaggaggaggaggcggcggcggcggcggcggcggcggcggagggcggggagggagcgcgcgcgtggttcgcggcgttcgggtttttttttagttttcgatttcggttcgcgacgcgtcgttttttagtcgtcgtcgttcgtttcgtagttgggatttatttcgggtttggggattcggcgggcgggagaagcgggggttttcggcgcggtttggaaggagcgagaaagtaaaagtaaggcgagtagtattttaagtttttttaatttcgttttttgcggcggtaggcgttttgttgtttagcgcgtttttttcgagttcgagagtggttgaaagaaaagggattgggcgggggtcggggcggaggaagagagagtgcgagggagcgaggagagttcggtaatatttgttaaaatttgggggaggaggagcgcggggaggaggaggaagaggaggagagaagggaaggagggagcgcgcgggaggggagcgcggagtcgagggataatttttttatttcgtgagtagtgtaggcggtgttaggtcggggcggggggtttttttatttagtacggggtattaggtcgggatgggatttttttttagaaagtcgattggatgttaggagaggcgtacggttgggggttttttttttttttttttttttttttttcgcggttgaattaaattagaattgttatttagggtttgtgagttagaagggatcggattatacgattttcgaaattgatgtcggagttgtacgagcgggagggagcgggtaggggtagcgttatcggcgcgttcgtatattcgtattcgcgtatattcgtcgtttttatttattcgcgtcgttttttcgtttttttcgcgcgtttcgcggtcgttcgcgtcgtattatgttcgcggcgggcgtatttcgcgtttagttcggtcgttcgtggtagtcgtagtcgttcgcggtcgcgcggagcggggagtcgttagtttgcgtttcgttcgcgggtttatgggaagttcggggatttgatagtcgttgtcgtcgtaggtacgtttcgttcgaagttttttgtttcgcggatttcgtagttcgtttttgcggtcgcgttcgcgttttcggggttagaggtggtttttagcgtggggacgggatggagtgaaaatggttgttaaaaggcgtttagatttagagagtcgtcggtgaggcgttcgagtaaggtttgtattcgttttttttttttggaaggtttttttcgaagagttcgattcgcggatcggtcggagacggattggagaattttatttttcggaggggggacgaagtttgtcgtagtggtggcggcgtttttcgttttcgtttttatttaaagggtttagaagaatttcgcgagtttcgtacgcgtttggtttttttttttgcgcggtggcgttttacggttcgggtttcgggcgcgtacggcgttcgggatgggcggaaggaggcgggaggtatggtgggtgcgcgcggggattttcgtcgcgggggtcgtcgtcgttggggtttttttagttcgggttatgtttcggagggcgggggtgtggtgtgagcggatggagagaggcgcgttttcgtcgt

SEQ ID NO: 7245 - DNA, 2119 bp, synthetic construct
  misc_feature 1..2119: note = Description of Artificial Sequence: Synthetic polynucleotide
  source 1..2119: mol_type = other DNA
cgcgggaggtagatagcgttttcgtttttgtaattatttcgttcgttcgattgggaagatagtgataaagttcgggcgtagaaaaggtagggttagggtaatcgtcgagtggtagcggtagggattagattgtgtttgattttggtaaattttattttttttgggtcggaggtatgtttatagaagggtggttagtaaggttggaagagtcgaagtttttttttattatttatatattattttcgggttcgtagggttgggaggcgagtttagtacgcgttttaggtgcgtaggggaagagtttagcgttgcgcgtagagtcggttttggagtttgttttgggggtttgtttttttcgtttatttttagtttttttgtggggatgggtgcggtaaaagatcggcggatttttttggtcgtcgtttggtcgtttattagttttttgattttggttaaatttttttttttttatatttgttttttttttttatattttacgttaggggcgtttcgtggattgtaattttgaagagagttttggtcggagggtgttagtttcgattgcgtttttaattcgtaggagtgattttgaatatatttttattcggagttttagtgtttttattcgtcgtataggaaaaagcgcgttcgatttcgggtatttttagtatcgttttagtaagtgtgttcgagattagatgaggggtgcgcggttgtatttatcgttttttagagacgtgggcgtttggcggggattaaggtggttgtgattagtaagtgcgacgtagttattacgagtttaaagtttatggttagtaggttgcgtacgggtagtaaggtataggatacgaaggtgattaaaaggagttgttaaattttttgttcggcggtcgttggttttttagcggtttcggcggaatttcgggcggggtcgtttagcgcgaaaggatagtagagtagcgcgaaggtgaggttgaagagtagcgttagttggtcgatttgttgtagttggggtatttgtagggatcggacgttggttattacgagtagcgttaggaagaggacgtagtgtatcgggtgtgagtttttggttaggtcgggcgcgggtttcggcgcgtttagtagttcggttagcgttagcgcgttcgttagtaggttgagaacggttagcgtttttagcgtggtcgtttgttttagtcgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcgtttttcgtcggttcggggcgtcggggcgcgggcggcggcgtcggggcgggcgggcggcgggcggcgaggcgtcggggcgcggggcgcggggcgggcggagttggggcgtcggttgtttcgcgcgcgcgttcggagcgcgttttttttcgttcgtcgcgtttgcgtattggagttcgttcgcgtttcgatcgtggttttcggcggcgatcgcgttgcgatagtcgagtttcgggagtcgcgaatttgggcgcgtatagttcgcgttttaatttcgcgttttgcgttttcgttcgtcggaggagtcgcgtgatttcgagtattttttttgtttttttcgagttttagtttttttatcgtgtatagtggaatttatttttttggcgttatttggggagtcgaaaatattgaaattttgcgaaattttttgttgcggggtagttaattttggaaaatatgtgtttttttttatttaataaaattaggttattagatttgagaggggttcgcgtttgattgcgaatttagggttttcgtttttacgagacggagaatcgacgtttaagaattttcggggttaggaggaaggtggaggtttggggcgtacgttttttttatgcgtatgagggatttttcgtttttcggtaatttttttttaagttttagggtcgcggagattttgtgggcgggtgcgggttgcgggagttgtgttggggaggcggcgg

SEQ ID NO: 7246 - DNA, 562 bp, synthetic construct
  misc_feature 1..562: note = Description of Artificial Sequence: Synthetic polynucleotide
  source 1..562: mol_type = other DNA
cgggtcgttaggagggggagggggacgcgcgtcgtcgggttcgttattttgtattcggggtcgttggtcggtcggggtatttttacgttcgtttcgttggcgagattggagggattcgggatatcgtaaagtattttttttagtgtttgggagcgttcgttgtacgtttagttttacgtttttggaattggggttttttggttttcgggtttaggtttcggttttaggatgcgagtgtttattcgagggggtgggaaaagttgatttttcgtaagggaggggaaggtgtaatttatttttttagataattaatggaatatttttcgtttttttttttttttatttgtttacggtagaagttaggatggcgttttttatgttggtttgggtgtatatataagtgcgtgcggaagggtggttgtaggcggaggtgatagcgaagtaatttcgtagttcgttcgacggttttttgcgttttagatttttttttggcgtgtaagatatcgtgtgttttcgtaaaacgggaatgttatatttgatagcgtattttttcgttttacgg

SEQ ID NO: 7247 - DNA, 1404 bp, synthetic construct
  misc_feature 1..1404: note = Description of Artificial Sequence: Synthetic polynucleotide
  source 1..1404: mol_type = other DNA
cgtttgttttagcgcggttttcgggggaggtagtagcgttttttgtttttcggtttggtttttgcggtcgtagtttttcggttttgttagggttgtcggcggtttcgtttgtttagttagggttgcggtttagaggaacgcgcgtcggtgtttcgggttgtcgcgtcgttggattttagtttgtatttcgtttttttttttttgaaaaggtattaggaaaagagagagggagagaagagtttatagtaggtaagtttggtttgggttatttgttattttagtgggagggtgtgttggagatcgcggtgttaagcggggatagtcgggatttgggggtggttgtgggttcgaagtggaggacgagtatggtttgggagataaggaatcgttttgagatagagaaggttttcgggagcggatagagagtgggcgaaatcggtgcgtagtaatcgcggcgttagttttagcgcggtttttggggcgtagttttatttcgttttagtagttgcggagttttttgacgagttttcgtttggtagtattgtataaagttttttttttgagacgcgtttaggaattttgttttttttttggttttttggtttttttattattttttttggtttgggtagtagagagcgtttatgaatgtgttttcggttttcgtaggttgtaggtttatttggagacgttttagtcgggaatattcggggagtatttgattaaagggtatttgcgttttcgttcgtttttttttttgttggtttgggagaagggaaaggggtaaggaagaaggaagggaagcgtggtggtttttgttgtagcgttttggaagaggaatgggcgacgttttttttttcgtcggggaatcgcgacgtttcgtttgatggaagtgtgtatttttttagatttagagggaaagttggagttaaatagtagttataaagttggttgtttgaaatgtggttaaggtaaaatattcgggggatttttttgtagtagtgggtttggttcgttttggaaaggtcggatttgattcgtgttgggtatttaattaggagtgcggtttttagggtgttttttttcggtttttgtttaacgagtttggagttaatgcgttaatgggttattttggtagcgtacgggtcgttttcggtattgtttttttttttttgatgattcgagtttaattttttgggttgagttgttttgttttcgttatagtgtaaggagggaagttgataggaggaggagacgtcgcgttgtggtagggagttttgggatttaggggattggaagagagtcgcgcgttagtagttggggtcgttggtgttcgggatttcgagttatggggataggagttaaatagtcgaatttttagcgatttcgtttcgagcgaagcgg

SEQ ID NO: 7248 - DNA, 819 bp, synthetic construct
  misc_feature 1..819: note = Description of Artificial Sequence: Synthetic polynucleotide
  source 1..819: mol_type = other DNA
cgcgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcgttcgattttttgtattatggatttcgttcgttttttggggttgtcgattttgttgttttttttgacggaggttgtattgggcgatgttgtttaggagttaataggtatttggtcgttttaggagtttttttttttaatcggcggagagggcgtagcgggttatggggtttcgtgtaggcgttttttaagtttcgttttttttaggtttttgtcgcgcgtttcgttggtaggggggattcgtttttaagtttgtattttttttgtagaggttttttcgttcggaaggggatagaatttttcgggatgttttttttttttaggagttacgtttgattatttttttttttttttgttttttttttgttttttttttaggaaataacgcggagatttgttttttgtttttagattacggattttgtcgggttttattttttcgttattattacgataggtatacgtagagttgtcgttagtttttgtacgggggttgcgagggtaacgttaataatttttatatttgggaggtttgcgacgatgtttgttggaggatagaaagtaagtgttttgcgcgtatttaggattttcgcgttttttgcgtcggcggttggtagtagtttcgttagttttttacgtttcgt

SEQ ID NO: 7249 - DNA, 1128 bp, synthetic construct
  misc_feature 1..1128: note = Description of Artificial Sequence: Synthetic polynucleotide
  source 1..1128: mol_type = other DNA
cgcgagggtttttagcggttcgcggtttcgggcggatttttagaacgagtgcgggtcgttcggattggtagattgcgagtttcgaggggcgcgggacgtagtcggtttagataaagaaatcggcgttagcggtcgtttttgtcgttttttttttttttttacgtatttttttaggaaaaatagggtatattgacggttaaaggggttggtttttttttttagatagttggacgggaggtgttttttgcggggttttgacgtttttcgtagaagagtcgcgggtttagcggttttcgatagcgttttcgtttcgtttttcggcgggcgtttttttttgttttttcgggtgcgaatcgggcgttggtcggggatttcggggacgcgtgcgtttttcgtcgcgcgaggtgtcgtcgagttagttcgagagggcggggggcgggcggggcggcgcgcgggggcgggggagcggtcgggatacgtgtggcggcggcgggggggacgcggcgttcggggttttaagaaggtgtggagcggggcgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaaaattgaatgagcgagcggcgcgtagggcgcgcggcggcggcggcggcggcggcggtatggagcgtagtggttgggttcggtagattttttttttagcgttgttgttgggggcgacgttgagggcgcgcgcggcggttggttattattttcgtttttcgttttttttttttttgtgtatttattacggggagttggaaggggatggggagtagggcgaggtgtttatttttttgtatattgcgggtaattttatttattacgtttcgggataagaatattatggtaggtatcgtagtattttcgcgttcgtcgtcgtcgggtgcgttcgttagcgt

SEQ ID NO: 7250 - DNA, 1128 bp, synthetic construct; identical to SEQ ID NO: 7249
  misc_feature 1..1128: note = Description of Artificial Sequence: Synthetic polynucleotide
  source 1..1128: mol_type = other DNA

SEQ ID NO: 7251 - DNA, 1128 bp, synthetic construct; identical to SEQ ID NO: 7249
  misc_feature 1..1128: note = Description of Artificial Sequence: Synthetic polynucleotide
  source 1..1128: mol_type = other DNA

SEQ ID NO: 7252 - DNA, 1921 bp, synthetic construct
  misc_feature 1..1921: note = Description of Artificial Sequence: Synthetic polynucleotide
  source 1..1921: mol_type = other DNA
cgggcgttgttttttgcggtttttttcgtcgaggtttgtgcgtggcggggtttttaggagcggtagttcgtgcggtttgggggcggtttttttttcgtatcgtagcggggcgtgtaaagcgtttgcggttgtagtgtgggcgtttattttacgtgttcggcggcgtgcgaggagtagtaatattttttgtgggcgatgaaggtggataggttgttgaatttgatgttgtaaagacggtagtatcggtggttgtcgttgggtagcggcgtcggcgtgtttttgttgggagtttggacgtttttgttcgagtaggaggggggcgtcggcgggggcggtacggtttcgggcgcggcggtcggggacgggggcgggtcgggcggcggtttttggggtttcgggtcgaggtcgtttcgggggttacgggattcgggttgcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtcgtttttcgcgtcgtttacggagttattcgggttttggttgttttcgttgtttcggtcgttcgcgtcgttttcgggcgtggtcgcgtttttagtttttttttcgcgcgtttcggggttcggggacgagcgcggcgcgtcgggttcggcgggttggtcggggggcgcgcgggtcgggtcggggggcgttttgggtttgcgcgcggtaggcgcgttttcgggcgtacggcggtttgaatagtagaggcgtttgtgtacgtagtagttgttgacgttgttgaaggtgatttcgtattcgaagtacgtagcgtttttgggggtttcggggaagagttcggtttgcgcgtcgtcggcgttcgcgttcgcgttttgttgtagtcggttgtgtattagttcggatattttggttaggattttcgaggcggggggcgtcgcgtcgggttcgaatacgtattgcggaaggaatagggtttcggttaggtttagttcgtcgggtatcgggttggagttcggcgtggggttggatagttcggttttgattttggtcggggcggggttgcgcggcgacggcgttcgcgacggggtttggggtttaggtttttcggggtttaggatgggggtcgttttcggtttttttatcgtttttattttgatgtttttgggggtcgtcgggggttcgttgttgtttttattttgggttagaggtttcgttttggttttttcgttggtggtttcggttagggtttttttgtttagttttggcgatggggtgggcgttaggtttaggttcgcgg

SEQ ID NO: 7253 - DNA, 2872 bp, synthetic construct
  misc_feature 1..2872: note = Description of Artificial Sequence: Synthetic polynucleotide
  source 1..2872: mol_type = other DNA
cgggtgttagggcgcgttgcggtttcgcgggtgggtagaggcgcgtagaaaacgcgcgggtggcgcgcgcggttatttagtgggtttcgttcgcgtcgtcggcgtcgtcgtcgtcgtcgtacgtgcgtcgtcgtgagcgcgaagggcgttcggattcgcgttttgttcgttcgtttgttcgtcggggttattgtggatttttaggtaatagttaagtgagaagttttttttattatcgaaaggtgtttgcgttttttttacgtttttttattaagtgtcgcgaggtgcgattttattttaaatttatttataaatagttaggcgatttttttaaagcggaataaaagtaaaattaggttagatatcgggggaagtcggtcgtgttaacgcgtggatagggaaaggaacgcgattaaggtagtagttatttttgtgtacggttatttcgaagcgttagtagggtttaggagttttttgattttagaaataggagtgttttttttttattttttttttttttggagaagtatttttgagatgaacgttgaagtgtttaatttagacgcgagaagcgtgtatttgtttaattgagtaaataaaggttagtagttggattaataaagtgtgtgtttttaatcgttagatgtttttattgttgttttttttttcgaggttgggggtgggggtgcggggaggaaggggaaaagataataaataattaaaaagaagagagtaaataaatatatatttggtgtttcgatatatatttttttttagtcgaggttttttcggacgaagtaatattttgtattatttaaattaaaaattattcgtgagttaatagtaaattttttttttttattttttttttttttattataaagtaaaatgaaagagaataataagtggtgatgttgggttcggaatgcgattttaacgtcgagtttaaatttgatatatgttatattcgtttcggtaagtagggcgttgtttttggggcgaaattttgtcgttatcgcgggaggagcgcggagtagagtaaagtcgtagttcggtttagcgtggaggtggttgggatagggtggggtgcggaggtgtagcgcgttagagtgagggttaagaaatttatcgcgatcggggacgtcgtgggtagcgtttcgggaggtggtattcgcggcggcgaggtagaagtttttaaataatatatttacgcgcgagttcgggtagttgttgtcgcgagtggggggcgcgttcggggagggggggggtcgaggaagtcgtagttagcggacgcggtcgtcgtataaataatcggggcgggcgttcgcgggcgggttgcgggtggcgcggggttagagttagggcgaagcggcggtcgcggagttgtacgcgtcggcgtgtttcgcgttttttcggaggttcgcgttgtttcgcgtagtcgttttttttattcggatttgtgtgtgtgtgtgtgtgtgtgtgtgtgtttgtgtgtttgtgtgtgtgaatgtgcgttggtaggcgcgcgtattcggtcgcgcgcgcgtgttgttggtaatgcgaattgtatatatattgttcgcggggttgttttttttcggaggggcggggtgggggataggacgtcgtagaggattttgaagtatcgtcggattatttgtttgttttgttttattttgtgttgttattgtcgttgttgttgttgataggtttggaattagttggttaggatgtttttttttttcgtttatttattttttttcgttttttaatttttttaaggagggggaaacgcggggaagaatattgttcggatttgtagcggagttttttggttgacgttaggtttatttgttatgtaaataattcgttggagaatttgtttgtgttacgttagatttttttttatttttatttttttttttattttttgtttcgttttttttagttcgttttagacggcgagttagggaagggggtggggagggaggcgagaataaaatcgtatgttgtattggtaaagtcgagttgtgtttgttgttttttggtagtttttaaagtacgtttttttagtagacggagttgttggtaaatgaaataggggattttatttgaagtgtagaaagtttcgaagggatttaaagttttcggtggtagggagttaaaagtatatggtagtcggaaagggagattcgagcgtgcgttaaagcgttgattggtttttttttttacggtgtgcgtttttgcggtttggggtggagagaggtcgagtgtttttttttttattgttgttttggtttttgttttatttgggttaaggagttttcgggttttttcgtggtcgcgtagtttaggttatcggggcgcggtttggaaggaaggggtcgttaagttgggatttagagagtttgaggttttcgggaagggttttattagtgattgaggggagtaaaagtaatcggaaagaaaggaaagaagaaacggttagagtttgtttcgcgcgtattttaaagtcgaggcgttcgcgtgggggatgtacgggtttagtcgttagttttgggtttcggtttttatttatcgggtgtgattcggttgggcggtttgtttgggatttagggcggtgataggggaaaggtcgagggaggagagagcgggtttcggaggggacgtacgatcggaattttggcgaggggtttttttcggagttttagtttagaggggggttagcgtttttttttcgtcgttttttttcggttttttttttgttcgcgggtcgggcgatttttcgtcggtcgtttttttcgcgcgtcgtagattgagttcgttgttttgttcgtaagttagtcgtaaagcgtggcgtttcgagaggcgt

SEQ ID NO: 7254 - DNA, 2906 bp, synthetic construct
  misc_feature 1..2906: note = Description of Artificial Sequence: Synthetic polynucleotide
  source 1..2906: mol_type = other DNA
cgcgtttcgttttttttggttcgttcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggtaggttttcgtatgcggtatgcgaagggaatttcgaggtttttttgtagaattcgagtacggttttttcggagttttttgtttcgcgtttgcggttttttgaattattttaataaaatgatcgtttcggtagttatttatgtttttttttgcgtagtgttcgtagcggatcgcgttgtgtggtatttcgagttttggggattttgttgtacgcgttttttagattttcgggggcggggagtggggagataatcgttagagtcgcggggcgggataaatggcggaatcgtcgcgcggcgttaggtaaattttgtaagggaatcgcgcggtttgtcggttttattttaagtattttcgaaaagaaagtatgtggcgggatatttgttatttattatgtgttattttcggtgacgttttttggagttgtgtttatcggggattcgggttcgcgggtgttgttcgttgtgttcgggcgggcgtcgcgttttttcgcgtcggtttcgggttcgttaggtagtcggagtcgttgggtttttttataattatatttttttttttatcgttttcgtttttttttatttttttattttgtagttgggttttttttttttttttgggggcggggaaggggggatgatttttaaaaattagaattattgatatttttggttttttcgtcgttttaggttgaagagcggagggggattcgcgggtcgagggtttttttttttgttcgcgttagggtcgttgggtgatatcgaaatttagaggttttcgtttttcgggggttttttttttcgtttttcgaggtgattggttggcgcgaagcgattggcgatttcgggcgcgattttggtcgcggtttttcgcgtcgcgtcgggtgaatggtcgcgggcggaggatcgggaggcgtcgggcgtagattaatcgcggtcgtcggtgggagtatttgttatttatatggaagagatttggcgtttgttaggttagtttagtttttttagtttagagattagttataagtgcggtcgttgtgttcgttttatgcggcggcggcggcggcggcggcggcgttgatatggagttgcgggttttcggcgggtttttttatcgcgttttttgcggggagtagggtaagattcgtcgttcggtagtagaaagcggtttcgaggaaagtaagtgtcgaattacgggataaaaagtttttggtttttaaatttttttaaaacgttttgtttgttggaaaaggagaattttttcgttttattttttttttcgtttttttttttaaaattttttagcggatagttaggtgtattatttttttttatattattttagtgatttgttttttttgagtataagtagatggttttgtatgttcgtagtttgtgagagaaatagcgggcggaggtgacgggaatggggggagaaggagagtgggtattagggggcgaggggttggtcgggtattggagtttgattgggtgtttgttgattttacgttgtaaagaataaggtagttattttttttgtttgtttatgattatattatagtaaagaggtttagaaaagagggagattttattcggaatttttaaggtttggagatgtgattttttaaaagtttagtcggcgaatgggagattgaagggtgacgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggtattttcgtttcgcgaatttaataggagggatttttgaagttagcggttttcgggatgagtcggggtaattttcgttttttgagcgtgggttggatggatgtttaattaggatttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagtttcgtgttttgttgggggttggggggatggagaaaaggtttcggggattttgtttaaaaagtaaaggtaaacgtattttaatagtttttcggtagttttcgcggttggcgcggttttagtttcgggcggtttcgcgcggggcgtgggcgcgggcgttcgggcggttaggtgcggcgggggcggaggttgtatttttagcgcgtcggaatgtttcggggcgcgggaaaggtaaaagtagtttggcgttttttttacggttttagtttttatttatttagaattcggttttaatagtttaaggaattgagaagaaaaaggaatttgcgttgggaaataggggtttttggcgggttgagtggtcgttgttatggtagagatagaaacggagaggtagagatggatcgtttagttatgttaagcgcgaagtttattcgtttagttagaaagttcggatattttttgagtttcgtatagttggtgaaaaaataatagaattattaaaaaagaaaaaaaaatttttttcgtttgatacgcgtttttttggtgtaaatgaaatgcggagggatacgcgagttatttagttgcgtaaaatcgtattttcgcgg

SEQ ID NO: 7255 - DNA, 2906 bp, synthetic construct; identical to SEQ ID NO: 7254
  misc_feature 1..2906: note = Description of Artificial Sequence: Synthetic polynucleotide
  source 1..2906: mol_type = other DNA

SEQ ID NO: 7256 - DNA, 1696 bp, synthetic construct
  misc_feature 1..1696: note = Description of Artificial Sequence: Synthetic polynucleotide
  source 1..1696: mol_type = other DNA
cgaaggaggggttggcggtagtgtagtagcgaagttcgggttttcggttttgggagtttcgtggtttcggtcgtcgtttttcgagtttttattacgtagtttcgaatttcgaacgcgagttcgcgtttcgttagtagttagcgggggtgaggatgacgcgggtcgggcgagaggtaggttaaatgtagtagtttcgtcgcgggtcgtcgggtttttgagtttcgttttttagagttagggggtttcgggtgcgggtcggagggcgggggtcggcgcgggttttttcgtcgtagtttcgcgtcgttttagtttattagcggttatttaattgtttttttcgatcggtttaaaatagttgcgaacgtttgcgatttgcgcgcggttttttatttgacgtttatttcggttcgttcgttcgttcgttttggtttcgtttcgttcgtttagagggggcggggaggaagcggttcggggaggggggaggggggagggggagagaggaagagaggaggaaggaaggaggaaagaggaagacgggcggtcggaggcgcggggttgcgcggcgtcggtcggcgcggcgttggaaggcgtcggcgttaatttcgcgaggtaggcgacggagggggagcggcgttaatatataagagtattgtattacgttaatttttttttagaatagtatgcgttagtagtatatttacgttttgattgaaggataaaaggatgagagagtagtttgcgtggttgtcgtttgtaatatcgcgagttcggcgcgaggaggagacggtgggcgtcgcgcgtaggggtttcgttgttgttgttgtcgtcgttagttagcggggattatgtttttgggtttcggagcgtttttcgtagtcgcgattttcgttgtttacgtcgttgtagtagttcgttggcggcgcggttattgagggcgtcgggagtcgaagtcgcgaattcgtttttttcgtataaagtcggagtcggcggcgcgtcgggggtcgggtagcggcgggcggcgacgggcggttgcgcgtcgtcgggggttgcggtcgtcgtcgtcgtcggattcgcgttcgttttcggattttttgaaggggtttgcggtgcgggcgcgatcgcgggcgtcgcgcgttttttcggtcggcggatcgggttcgagcgtagtcgttacgtcgttggttttcgggggtcggacggagcgtcgtttcgcgtgtcggtagtcggcggattggagaattgatttttcgtttttgttttttttatttttcgagaagaggcgaggagaaagggggtgtgtgtttggggagggcgaaggcgtcgcgaatatttttttttaattttcgtcgtttcgcgagtttacgatcgtaattagttgtcgtcggttcggagcggtcgacgtcgggagagggagcgtagtatttagcgagtgcggtttgggcggtttcggggcgttttcgtatttttttcggcggcggttcgtagagcgggtcggggtcgtcggagcgtattttggcgatgaagcgttttttttcgcggttggagcgagtcggtgttagggtttaaggataaagtcgggaagcgttggtggcgtcgttttttgggcggaggggggggtatgtatttgtatagttcgtcgggttttggtttttttaggcgcgttttaatttcgcggtttcgtcggtttcggtttcgg

SEQ ID NO: 7257 - DNA, 2054 bp, synthetic construct
  misc_feature 1..2054: note = Description of Artificial Sequence: Synthetic polynucleotide
  source 1..2054: mol_type = other DNA
cgacggttagcgtttagagttgtaaatttcgaggcggttgagcgtttttttttgagcgcgcgtcgtgcgtttcggttatttatgtatgttttttttttcgttttatatcgttatcgttagggtagtttcgtgcgggtcgaggggatttaggggggtgtcggtaaacgttggtgcggaggagagtcggtaagtcgggcggcggcgggtgggagtatgtagggaggcgttttttgttttttttgtcggtcgttttttttcgttttagatgttagtcgcgagtttcgagttagcgagagcgagttagagagggagcggcggcgggcggcgggcggtagggaggagaggaggcgaggcgagggagggaggaagggaagtagggagggcgggagggaggagaggaggatttagagagcgttaggtagttggagtttttgtagcgtttggtcgggttttaatgtatagtagtagcgagtcgcggcggtagtaggtagttcgggagtttcggcggcggtcgagttagcggcggtttcgttttttgttttttgtaaattttgcgagtagttcgttcggggggtcgggggcgcgttcgggaggttcggttcggttcgcggtcgagtttttcgtcgtcgtagcgttagtcgtcgtagttattatcgtcgtagtttcgtgttttttcggggagtagtcggcggttttcgcggttttttagtttcggttttagggtattgttcggcgagtgtttcggtaagggtgggggttgtcgcggcgcggtcggtcgcgggttgtcggggggcggtcgtcgttatttagagaggcgcgtagaggcgtcgagagcgtttttcggcgggtttttcgcgtattcgtcgcgttcgggtagcggttcgatcgggcgagtatgggcggcgcggagtgacgtcgttgtgttcgtttggtattaaggatatttagttcgcgggggtggggacgaaggggggtagttcggcgtcgttatcgtagttttcgagagtcgtcgtcgttgttcgggtttcggggttgggtggaggaaaggggtgttcggaatcgatttttatttttcgatttttttgttggatattacgtttattttggacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgtttagaggagggcgagaggtagcggtataggttttatttgtagtgttaatgcggcgttttcgttgaaggagggaaacgcggcgcgtttaggtaaggagtcggttcgtcggggagtggggtcgggcgggcggcgagggtagtaaggtcggatagatttgggtcgattcgggagtttttagtgtttcggagttagttcgcggtatacgtatacgtatatacgtaggtatatatatagatttatatcggtatatacggcgttcgcgtatttgtttacgttttatttggacgttcgcggaggtgtagcggtcggagtagggatttttcgggtgtgttttttttttacgtttttggatttagatttttttttttcgggattttcggggtgggattttgtgtattttcggttttgttttttattcggggaggttgagggagtaattttttagtttttagtttttttcgtttttagttgggttttaaaatgggagaagttttgagaggttttcggagatttatttagtgttatcgcggtttcgtggtttttggatattttgggattttaacgggagatagatttatagatattcggacgtatatttggagagagtggtggtttagcgttcggggaggaggttagataggcggttggggttgtagttttgtagggcggcgtatatgaaatagatattgcgtttttttagtaagaggtagtataaacgtttttttgaagcgtggtattgttttttcgggaatgcgtcgagattttaggtagaaagcggtttaaagtatcgtcgcgt

SEQ ID NO: 7258 - DNA, 1258 bp, synthetic construct
  misc_feature 1..1258: note = Description of Artificial Sequence: Synthetic polynucleotide
  source 1..1258: mol_type = other DNA
cgaataacgtagcggcgttaggcgttagggtttttatttttgttttttggatttttttcgtttttttgttttatcgagggttttgtgattcgattttatcgaattaatcgttgtttatcgagggtttgttgcgtttaaggaaggtatcgggcgacgagtaaggcggggacgtagtttggggacgtaggggttcgggttttagtttagagataggaggtcggcgtttcgatttggtattcgtcgacgaatttattttaaggtttttattggcggagtttttgttatttttttttttttttaaatgtagttttcgttattttttcgcgtttaggggttgttgtttgagtttagttttgtttattggagggcggcggtggagagggtgttggtttagcgtcggtagttgggtttaggattaaggtgggcgttcgtcggttttggtttttttagttttacggtgtaggatttagggcgcggttattcgagtttttcggacgtttttttttttgatgttcgttgtttttgttttggcgtttttagttcggggtcgtagtttgttttttttttttttttttttcgtcgtagttcgtcgttttcgggtagagtttatgtttagtttgggttttcgttcgggatttaggaagaggttggcggggttggagggtgcgggtcggcgcgggagggcgcgggaggcggggagcggcggtttttgattggtcggggcgggggagtgagcggagttttttataatgtttcggtgcggtgtagtcgcggatggatgttgcgggaaggggttgttatttgttgtttttgttagcggcgcgcggatttgttcgcgtttttgtagtcgtcgtcgtcgtcgtcgttagttcgttcggtttttgtagcggcgtcgtttgcgtttttttcgcggtcgtcggagcgggcgttatgaattttagtttttcggcgggagaggagaaaggggcgacgggcggtagtagtagtagcggaagcggcgtcgggagttgttgtttgggcgtcgagggcggcgcggattcgcggggcgtagggttagtcgcggcggcgggggtcgttgttttggacgagttcgcggtcgtcggttagaaggagaaggacgaagcgttggaggagaagttgaggaatttaatttttcggaagtaggtttcgtataggtaggtgcggggagtcggtagtcgagataggtgcgtcgcggcgggagatttatttttttatttagtaaggggcgttttcgcgg

SEQ ID NO: 7259 - DNA, 628 bp, synthetic construct
  misc_feature 1..628: note = Description of Artificial Sequence: Synthetic polynucleotide
  source 1..628: mol_type = other DNA
cgcggtggttttcggtttttttttattttattttacgaatcggcgtttggtcgttttgaaatgaatgatttcgtcgcgtttcggcgtcgcgtttttagcgttttttttcgggatagcggttaaggtgattttgatcgttttcgggtcgcgggtcgggtttgggtaggggtttttgggttaggagagggaggtcgtttcgcgtttattttttaaggtcgttttttagttggtgttgttttcgtagttcgattcggatcgtcgtagtagtttttcggggtcgcgggttttagtttttgcgggcgaacgcggtttgggggcggcgggggcgggcgcggggcgcgcggcgaggggcggcggcggtcgggttcgcgaggggggttttcgggtcggttttatgcggggcgtttcgtcgcgtcgcgttcgcgtttttgtatcggggtgcggggtttagttcgacgcgtattcggcgtttcgcgcgttttgcgggttttttaggtcggtttcgggtgggttaggatcgcggcgttggtaggtcggggttgagttcggtttttcgcgttggagtttttgcgtcgggtgtcgtcgcggtgcgtttagcgtttgtttcgtcgagtcgtagtttttacgt

SEQ ID NO: 7260 - DNA, 1075 bp, synthetic construct
  misc_feature 1..1075: note = Description of Artificial Sequence: Synthetic polynucleotide
  source 1..1075: mol_type = other DNA
cggaggttcgttttcgttaggggtttcgggggtgcgtgattatgaattttagagggttgggttttgatttgagtgtcgattcgttaatgaggacgggaggataaggttgtcgacgtagcggaaggtaggggggaagcgattcgaggatttgacgattatttttaggtaggggttttttaagtaggtacggaaattaattttattaaatcgcggagtggggattgggttcgggcggtgtttagtagggtaggggtagggttagttggcgcgtaggtatttgtagggtggagtagaataatcgtggggattcgtttttttggaggggtattgtttattttttatatgagttttaggatattttcgtggggcggagtttcggagacgttttaggttacgttttcgtcgttttatttttgtttgcggggggtcgagtagggagggaggtttagcgcgcgttgtgtgttcgtagtgtttacgggtagcggggacgtttgcgttcgggttttcgacgcgtagtttggagagttgcggagggtgtttcggggttatatatttattattaattgtatttaggtaggtttttttgtttttttcggggtcgtcgttcgtgggagggaaggtgtttcgtttcgatttatttacgcgggtagcggtgtttttttcgtttatcgcgttatcggtgacgttcgtttttgcgttcgtaggtgtacggttaggtgttttatatcgtttcgtacgacggcgttttgcgtttttgggacgtgcgcgggtttcgaggtgtttcgcggtttttttcgtttatgcgtagtttttcgcggttttttagtaataaggtgggttgcgtcgtcgcgtttttgtagtcggtttgatttcgcggggtttttgtagacgttagtttagatatttagcggtttttagagcgtttcgttttgttattcgcggtggtggcgttcgatggtcggcgaggggcgaggagcgaggaagttcgggcgggaggagagttcgtcgtaggcgtttggtttttttttggtggttaggaggcgttgggagcgggagtgttcgttttggggatcgt

SEQ ID NO: 7261 - DNA, 5566 bp, synthetic construct
  misc_feature 1..5566: note = Description of Artificial Sequence: Synthetic polynucleotide
  source 1..5566: mol_type = other DNA
cgaattagttttgtcgttggatttttggtcgttgttcgggtcggcgttagttttatataatgtcgcgtgagtttttgtgcgtgtgcgcgggggaggttcgagatgtttttttttcggtaagttttcgcgttagtatcgttttttagtttcgcgggttttttcgcggcgagtcgggacgcgtggttttcgcgggtttatttgaagaaggtcggttcgagtagcgcgtatagtagatttacgtcggttagagtatgggttgcgcgtttaggttggcgtcggtttgcgagttgttcgagttcgagtttatcgataggtcgtcgtcgtttaagtcgcgggttttgagcgattcgtttagggggtcgtcggggtcgtcgttttttttggcgttatcgtgtagcgagagcgttttggagtcgtttttttcgttattcggagagtcgttgtcggcggttgggagcggttcgttcgcgtcgggcgtatatggcgggttttgtcggggttttcgggagttcgagtttaagagttgtttcgagtcgttcgcgtcgtcgttttttttcgtatcgttcgcgtcgttttcgtcgtcggtttcgtcgttttttttttttttcgcgttcgtatagtaggttttcgcgttttttcgtcggtcgaattcgggtcgtaggatgttgtcgatgaagaagttggtgatgcggtgcgggtgttggtggttgtcgggcgtttgtaggatcgcgggtagtattagagttcgtcggcgttcggtgttcgtttcgttcgggttgttatcgtcgtcgtcgttcgagtcgtcgtcggggttggatttcggttgtcgttgtttttttatcgtcgtcgttgtttcgttaggtttggggttatttttttttatgttgtttatagtaaattttatattggtttttcggggacgtttttttaaattagttttcggttttttcgcggcgtatacggagattttcgcgtttttatttcgtcgagtttttcgagggcgtgcgcggcggtcgcggttagggttgaggttttataagtcgtcggtcgcgttcggcgcggagttatttttgaatttacgaattgggttagaaatattacgagtcgtttcgttcgtttagacgatgagagatttaatagagttaagttttcgatttcgtcgcgtagtcggggtttagatagtcgtagtggttcggcggggacgcgggtcgtttttcgggtttttcgttttttttcgcgttcggtcgtttcgggtttcggcgtcgtcgtttgggtcgttcggggcgagagttgcgcgtatgtaggtagcgcgtttttcggcgtttacgttcgttcgggtcggtttcggtcgtcgtcgtcgttcggtcgttttcgttcgtacgttttagtcggttttcgagggtgtcgggcgttcgcggttagcgcgttcgttatcgttcgtacgtatatggaggtttttttttcgcggtcgtcgtttcgttgcgggtcggggcgttttatcggcgtgcggtcgcgttttcgtcgagtttcgtagagtttcgcggttcgagtcgtatgggtgagagacgcgaggttagggttcggtcgggtcgggttgggtcgttcgcgtttttcggtcgttcgtcgttttcgtcgtttcggttttcgcgcgggttcggaaatttttaggttattcggcgtaatttgagatatttttattttggatttttgtttttatttttaatagagttttttcgagtgacgtcgtaggtcggttttttggatacgtgtttcgggttaatggtcgcggcgtcgcgcgtttacgtgacgtttcggtcgtcgttgggtgataggagtagttcgtcgttttttttttttttaaagcggtcgcgtttttcgtttcgggtgcgggagtttaggaattcggagagattttcgatcgcgttttttgcgttcgttcgcgttttttttgtcgtttcgcggtttaggggtgtgagttattcggcgatagtttcgttaggttatttcggggcgcgtaggtggatacgtataggaagatcgttatttttaagatttttatattgtttatcgtggggcgaaattttataattttttgtataaaatgtataaataatattaaatgagttgtcgagatataaagggatttttgtggttcgttttttttgttgatggagaggaatagtgttatttttatttgattcggtaattcggtagttttttgttttaaacgtagagttggcgcgtaggatattttttttgtagatatttattgtaagtgtgcgtgtgtgtgcgtgtgtagggaggcgcgtgtatacggtcgtattttattcggggatagcgatttttatgaaatatgtttagcgattcgaaagagcgggggaatgtagtatgcggttttatttgcgaagggagaaatttaggagtttcggaggttttaaaggaattttttttgttaaggagaggaggggtgattgtttagttaagattttaaaattaagtcgttcgtttttttttaatttttttattttgattgaggagtttttagatcggttatttcgttttttttgttttaaaattttttaaattaattttgtcggagagtagggtttatttgaaacgagaattaggaatttaacggtaagggtgggagttttagttggtttttttttttttttttttttattttttttagattttttttttagttgttgttagaatgtttaattggaagttttgtttttttttttttttttttttttttttcgggtttttttttatttgtttttgtttatttattaaatattcgttgttattttaggttcgtttgtttattatttaaaatgtatttttatggaaatgtgtgaatttttggaaatattcgatagggtagttttgggggtgcgggagtatttgtacgttatgagtatttttagtgcgggggaggcggggaggtcgtagtttggtacggatattttagggttgattggttttgggtagttgtatcgtgtttagtaatttagattttcgtagaggtagttagtaggttgttgttaggttttgagtgaatttggggagtttggtaagtattttcgaggtagcgtggtttgttaggttatttggggtttgaaggttgtattttggttttgcgaagttttttttttagtgtttattttacgtgttgttttttttttgtaggttttagagtgttggttgggttgggatgagaaacgatagtttttatagttgtttttaggaaaattatttttttatttaggacgggaatggtgggggaggaggtgttgggttggttttttggttattggacgtggttttggttagagtgtgttttttgttcggtgtgtttagggtagggtggggaagttttttttcgttggggttggatttttttattttttttttattggaggagtttttattaaatgttttggttaggtatatatttgttaggggtttttttcgagttttaaaaaattaaattttatagtttatttgtttttcgggaaaatagggttggtgagagtttgtgggaagttttattgacgtttatttggttttttggggggagaattttttgtaattttggaaattttgatgattattagttaggaaagggagggtttaacgattttgggttttttgaatatgatattggggggaggaggggttttgagttttttggtttttgtaaaattattttaggttaatggttttatttgttttatgaaagttaattaggcggttttttgagaagtattttttgaatttttgggattttttgtttttgattgttttagtataaatggttttaagacgttgggttttagttttgtgtttttttgcgatttagattttaattcgtggttgtaatagagattttgggaagtagagcgttatttttagggcgtttggcgggtcggtgggtagagatttgttttcgtagggtttgcgggttgggttttggggttggttggaggaagaggaattcgtgggtcgtttttttggaaaggaggaaggtgagaggtggagggaggaataggagaaagagaaataaatgaagagagagataattagagggtatcgggttttttagagtggatttaaatacgaaataattttgggaaagcggtaagaggggttatcgtttaaagggtcggggaagttgggatggggttgtagaaagttgagttgtttaggggttgggcggtgttgagttttatatatacggaatttcgtaaggtgttttaggaagtttcgagaagcgcgtatgaggatcggtttcggtcgtttgttttagttgggacggcgtttcgcgttttttggggatgcggggtagtggcgtgttttttttttgcgatgttagtttcggttgtcgcgttttcgcgagtttagagttttcgttttttttttcgaacgatcgtcgtttttaaggtcggtttttttgtgcggattagacgagtttttttcggatattagtttttttcgggatggaaagtggggtattgattcgggaatttcgttttttttttagttttatttaggaatcggagagcgttcgcgattattcgtttgcggaggacggttttttatattttttaggttcgttgtataaagaggggtttcggagagggcgagtaggaaagtagtttttagacgtcgtgcgttttaggatacggacgttagttttgtaaataaaattttagtgaagcgtttcggagatatcgggcgttcggatgtcgagttaggttttcgtttttatttgaaaacgaggttagagaagggtgattttttcggtttttttgcgttttttttattcgtttcgtttttttagtttgacgtggtgatatttggaaaaatggatttaatgaaagtcgttcgttcgcggcggtttcgttattcgcggggtagagacgtttaataatttttgagagcgagatttttattttagttaaagtaggtttggttagttttgcgttttcggttgggagtcgagtttcgtagttaagttttaggcgtcgggcggggaattggggtcgataggagagtaatatttttttcggggcgagtagagagttatcgtcggtttttggggttgacgtttcgattcggtttgtagataaaggtcgaaacgaaggggcgcggggagtaggggtggggcgggcggggttaacgggcggatattgcgtgtttgcgtttttttttgggcgaaggaggatcggtttataggtttatcgggcgagttcggggacggggtttgggaggttgggtttagggtttgagatttttttagaataattttcggaaggagggggttaaatgcggtagcggcgggtttgaaaagggttaggagcgtcgtaggaattggggtgtataggttttcgcgtgtttagcgtttcgttttttttcgttttaggtttgttaggggcgcgcgtggcgcgggtagagtttggtgggtgggttggcgcggatagaagttttgtcggggagcggggaggggggggtagtcgtattgtacgttttggttttgtttcgatcgttggagaagcgt

SEQ ID NO: 7262 - DNA, 5566 bp, synthetic construct; identical to SEQ ID NO: 7261
  misc_feature 1..5566: note = Description of Artificial Sequence: Synthetic polynucleotide
  source 1..5566: mol_type = other DNA

SEQ ID NO: 7263 - DNA, 1164 bp, synthetic construct
  misc_feature 1..1164: note = Description of Artificial Sequence: Synthetic polynucleotide
  source 1..1164: mol_type = other DNA
cgaacgtttggattttagcgagcgggcggttttttggcggcggtgattatcgttgtgttcgttgtttttacgcggcgttcgttaattttacgtgttcgtagtcgcgcggcggggtcgggcgttcggagttgattttagtttttaggatagaaagggtggttaaacgtagatttggtaatttttcgagtcggcgattatagattgttggtggttgcgttacggtttcgggagggttagtttttcgttgggtttttagggtattaagaaaagaggggtatgcgagtttggaagttggagagagttcggggttttttagagcgggtgggacgtcgcgtttttaggatttcgcgttacgcgtattttttttatttcgatatttattgttatttttatagcggagcgaggggtttcgtcgagggcgagcgtatttcgtgcggttgagatgttcggaacgttttttcgcgtttcggtttttttagaaggggttatagtcggttcgcgagttttcgggcgggggttgagtcgtagtgttaattaaggcgaggttattttggttcgcgcgttttttattttagggttttttcggtagagaggtgattgtaggttatcgttagtcgggtttttatttttcgttttcgtcgtttcggtttttatatttcggaattttttcggcggagtttgcgagttcgggaacgcggttttagttagagtggaagggatagcgcgggaattcggtagagagaaaaagcgggaattgggcgtcgtcgttttacgatcgggaggagattttttttcggttttttttggattttatttcggggatcgtttcggggttagagtttaggttgggagagtttttgggcgtatttatcgttttttttaatttttttttttttatttttagttcgggtggtagtggttattcgtcgggtttgtaggtggaggggagtttgcgcgtaaaatttacggtcggcggcggttattttttcgcgggaggcggttagattttggagttatacggttagagttagtacgagtagggttttgttttttatttcggggcgcgtttttttggaggagttgtaaggcgcggatcgattgatgagtcggttgagtcggaggttggagagggttggagtcgcggtttggcgttgagtaagtcgt

SEQ ID NO: 7264 - DNA, 1495 bp, synthetic construct
  misc_feature 1..1495: note = Description of Artificial Sequence: Synthetic polynucleotide
  source 1..1495: mol_type = other DNA
cggcgcgtattttatatcgtttgttttgtgttttaaaacgtcgaagttaattttttacgcggttttttgttcgattatttatttttgcgttgttaggtatatcgaggggatcggttttttttttaggcggtttattttagcgtttttcgttagagggtatacggttttcgtgtaaagcgtttatggcgcggggtacgcgcgtacgtagtttcgatttttatagtttaggttttattttcgggttgggtttagtcgttaaggcgttggggaggggtcgtgttagggagcgaagcgttttcgggattttgggagggtgcggtcgggattgttgttttttgttttgagttttgggcgtaggcgttcggtaggattcggcgtttaggtgagcggcggtttttaggaggggaagtatcgcgcgatttaacgggcgtttagagcgtagggcgaagaggatgggcgagggagagggggagggagaggttacggtatttgaggaggaggaggagtaggaggagtaggaggaggatcgtggggttcgggtcgcgttgcgtatttatttgggttttggttgttcgtcgcggatttcggttttttgtcggagtttcgttttttttttttgtttttttttttgtttttgttttttttgcgttcggatatttcgtcggagacggagcgttttacgcggacggttttcggcgtaggcgagtttggtttaagggttcggatcgggtttgggaaaagtttgtttttcgagggggagagcgagcggtcgcgttgaggcgttcgcgttgcgcgggggcgtttttcgttgtttgtagggagcgcggcgcggacgcggcgggcggttcggttatttggaacgggcgttcgttttggttttcggggttgtttttgtcgtttcgggaagtcgtcgatgggttttatcgttggcggttcgcgttttggtttttgttcggcgttttcgtaattcgatcggggagaggttattatcgttttgtttacgtttttatcgttcggtagtcgtcgtcgtttagtttttggttttcgcgcgagttcggagttttaataagtttcggggaatttttcgtcggtttttttttaattgtttcgtagttatttatttttcgttcgtaggttggaggtaggcgtttttttcgtatttttttttggtttcgtttttttttttttttttattatatttttattttgaggcgcggatacgttatcgggaggagtttgggttcggcgttttcgggcgtagtttttttttttttcgcgttggtcgggcggggggtggcggcgcggttgtcgggaattttcgataggggtcgttggacgttgcgcggagatcgaggttagcgtttcggagattcgggaatttaggcggagattcgaggttttcgttgttcgttttttttcgtagttaggtagcgtttgggagggttgtttcgttttattttacgcggaaaaggacggcgtagagaaaagtttgcga

SEQ ID NO: 7265 - DNA, 352 bp, synthetic construct
  misc_feature 1..352: note = Description of Artificial Sequence: Synthetic polynucleotide
  source 1..352: mol_type = other DNA
cgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttatagttggagttgcgggagcgtttgttttgttcggagttcgcggttttttttcggttgtttcgcggtggcgttacgcgtttttttcggagtaagttcggtgcgtagggtcgggggcgtgggcggttgttgttagaggcgt

SEQ ID NO: 7266 - DNA, 1141 bp, synthetic construct
  misc_feature 1..1141: note = Description of Artificial Sequence: Synthetic polynucleotide
  source 1..1141: mol_type = other DNA
cggggattaggcggtgtgtcgttcgggtagttagtgggtcgggcgagtttgcggggttggaggggacgcggggttgggaggttggggagttgggggttgatttcgggcgggcggggcggggtagggatttgtcggtttggggcgggcgtattagacgagtttttcgttcgtaggtttttagcgtttagtcgcgtttcggttgcgtttcgtcggtttcgtttcgtttcgtttcgtagagtcgtcgttagtagtgggagacgtgcgttgagaggcgggggttgcgttcggcggaatagtagttttcgggcggagagcggggtcggggttcgagagtaggtgatgttaagagttgagcgggattcgtgagcgcgcggtttagtatttattagggcgtttcgtaaaaaatttcgttttcgtttgtttttgggaattataggtaagttttgggttttcgaggtgtagttttaggtagagtttcgtgttgggaggtgggaagggggtttgattttggggatttaggtagtttggggatagttttattaggggtcggtgtttagaattggtgagggaggtattttaggggttgggggagaaggagcgagcgtttttcgtttttttttggtatttagcggcgcgtttgttggtcggaaaggtagcgagaagttcgttttttttgttttgttttcggcgatttgcggttcgggtgggagttcgtaggtttcgggtttttagcgtcgttggttagggcgcgggtaaagtttgttttttcgcgtttagtcggttttttcgttttcgtagcgtcgtaggtgtcgtttgttttcgtttttttgttgtaatcgttttattatggatttttcgatttagatttttcgcggggagtcgggttttatttgcgtttcgagcgtttgtttgttttttaatagtagcgtttggtttttcggttgggtcgagttcgatagtaacggtagcgtcggttcggaggacgcgtagttggagttcgcgtatattttttcggttatttcggttattattacggcggtttatttcgtagtgttcgtcgtgggtttggtgggtaattcgttggttatgttcgtgattattcggtgagcgcggggatagcgtagcgttgggggttgggcgg

SEQ ID NO: 7267 - DNA, 3297 bp, synthetic construct
  misc_feature 1..3297: note = Description of Artificial Sequence: Synthetic polynucleotide
  source 1..3297: mol_type = other DNA
cgagacggataggaatcgaggagatttttttgtagcgttttttatttttcggatagaaattttgtagattacgtttatttttttatttcgtgtatcgttcgtggttcgtgggtagtagttgtttttttgggatttttttcgtttgttcgcgagttttcgtacggtcgcgtttttgttgttggggtcgttcgttggttttggttgttcgttaggatttttttttgatgttgttaagttcgggaagtttacgatgtattttagtgttcgcgcgtcgttttttttaaagttttttttttatttatttttttataagcgtggagggagatggggtaggtcgcggcgtttatagattttttttcggcgtttatttttttttttttatttttttagtagcggtagggtcgtagcgtacgtaaatttttttttaaaacgtttattttatttttagttagtcgttttttttagggttttttcgttcgagttgggtgtggggatcgtcgcgtatatagagacgggaaagttatttcggtttcggagcgtcgtttttttagaggtttttggttcgttcgtttttttagcgttggaggatagtcgcgtatatagatttttttttttaacgtttatcgcggtttttagttgtagtttgtatttttatttttcgtttttagtttttcgtttttcgttttttgttttttagttttcgtagttcgggcgtttagatttgtttcgattttttagggtagtttcgagggtgcggaagattaagtgttcgggtttgttttaggaaaatttcggcggcgtttgtacgttaattgttttggcgtaggcgaagggtggagggtatttttttgtttattcggtttttaagagcgtgaatagaggtttcgagtgaacgtttatatttagtcggttttttagggtttacgcgtggggcgtttatttttttattttgtttttcggtgtttttgttttggttgtattttttttaaaaggaggcgttacgattttaggaggttttgtttttttattttttttagcggcgtttaaattattagtttcgggcgtttaattttttttttgttttttttttatttcgtgagaaagtcgacgtttttattcgtttggttttttcgaaatacgtttcgggtggttaatgcgatttttagggtttaaagattagattttcgcgttttttattaagatatcgacgcgaagtcgtagaggtggaatcgcggacgttttggtaggttcgggatatattgattttggtggcgcgatgttttttttcgtacgcggacgtattcgtagttttatttttttaaattcgtattgcgggaaggaattttcgattcgtatcggttttcgtttcgtagtaacggcgatattttgaggttcggacgagcggcgcgttttttttagtttcggttattttttagtacgaagttttagggcgagttcgagacgaagaaagagagttcgaggaattgggatatttacgagtttatcgtttattttgtcggtcggggaggaagtttcggtcggttcgttttcgttcgtcgtgcgtatgcgtttcgcgggtgtttttttaatattgtagcgcggagggttgttttttttacgtcggcgattgtttatcgcgtttttcgttttttttcggttttcggtttttgttttagtttttttttttcggtttttttttttttttgttttgtttttttttcgtttttttattttttttattcggtcgggtaattttacgtttcgtttttttttagcggcggcgtattttatcgtcgcgggtgttaggggtattttcgaggttttacgcggggcgcgatttttatttcggtcgtagttttattgttttagtttcgtattagtaagttttaagagtgtggatgcgaagttaggcgcgcgtagagggcgttcgcgaagttttttgtgttatcgttttttttcggcgcgcggggtcgagcgagattagagtgtgttggattgcgtgttcggatttcgtgaatgaagggagcgggaggaaggagcgggggtgggcggtaggtatggagggggcgtttggtttttagagtttcgcgtttgtggattgcgcgtttttggagggtagttttttatttttttttcggttcggggcgtttttttgagttttgttttcgttttatttcggcgtagtttaggttttcggttttttcgttttggaaagcggttttcgtttttttttagttagttagagcgcggaggttttatttagtaatcgagcgggggataagggggggaattaatttttgattttagatttcgttgagattttcggtagtcgtttttcgcgtttttttttttagggatttcggagttcggggaaaggagtagattagggggtagcgggagggggaatttagtcgtttagtttttcggattcgtagtatcgcgtgttttcgtagttcgtagcgttttttcgggagtgggattcggtggggtcgcggggttagttttttggagttcggagggttaagttgaagttggaaattgatttgatataaaaataatattacgttatttttttttttgtttgtcgagagggtaggggagtgggagagcgagcgttgggagtaggcggaggcgcgtttgggggaggttcggagtaggcggaggagagcgatacgttgagagtttgaaaggtagtttcggggaagagcgagggttttttttcgtttttttggattatggaaaggaaatggtttaggaaaaagtagtttggagtgttttttcgcggggaggggcggtgtttcgggagtcgttaatgtttcgttttaggatttgtttagttacgtttcggttttttcgattttgttattttttttattgttagttttagcggagcgggttagttggggttaggaagaatcgggagaggttggtgttttggggaggttgggtgtggggcgtagtggagattacggtatttatcggtataggcgagttttgtttagcggtggcgtttttttttttgggtttggttatcggatgggggggttttagcggacgatttttcgagggtcggtcgggtagtgttagcgtcgtttcgagtaggagcgagaggcggttcggtagtttttcgtgttttttcgagagtcgggcggtcggtagggcgggaagtaggggggagaagtttaggcgttttcggggagtttcgggagggggtcgtcggagaaggtgagagaagaattttgcgaggttggaaagcgggttagaaaggaggtcgaatagtttcggggcggcgggcga

SEQ ID NO: 7268 - DNA, 2213 bp, synthetic construct
  misc_feature 1..2213: note = Description of Artificial Sequence: Synthetic polynucleotide
  source 1..2213: mol_type = other DNA
cgaaggcgacgggtttaggatttgtagaaatcgttgcggtttggggcggtcggggatttacggttttttggggcggttttgaataggttttggggcgtagcgttcgttttttaaagaagtttgggatcgggttttgtttcgttgtaagttacgtttttcgtgagtttataagtgtaaaattagaaaagaatgtttcgtttaaataattaaagagcggtggttttcgcgggggtagcggaggcggttagtagggttttcgttttcggggagaagtgtttacgatttaagggttgtttgttttaggaattttttaaagaattatagatattgagagtattcggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcgttttagttgggtatcggtttggaagcggtttggaattagattggattcgaggaggtaagatttcggtagcgcgaggttaattataggttttattcgcggtttttagttcggttttatcgtagtcggcggtagatattttaaattttttatacgtcgtttttagcgaggcgtttcggggaaagtagcgtgaggtagtgagtcgaggggcggggttaggaggacgtttcgttttcgagttcgtttcgtcggagggtttgattaatgattttttaagtcgttttagttttcggcgtagttttttcggtgggttaggtttttcgttcgatttgttttagtcggtcggagtatatacgtttggtcgcggggcgttcgtataaaagttatagttagcggaggttggaaatagtcgtcgatttgggtatcggtcggacgaggatggagtgattagcgcggttttggttatataggttttgttttacgtttttcgttcgtttttacgacggagcggagttttatttagtcgttttaggaaaggtgaggggttcgttagacgcgtattgcgtagttttcgggttcggaacggtggcgggtgtcgtatttcgaggtgaggttaagggtttttcgtttttcgggtagaaattttttttggcgtgaaaggtcgagggcggttggtgagtcgtggtttttcgcggcgtcggcgagaaggagtcgcgttatttttcgtgcgtgtcgggttggataaagttatttaagcgcgaacgagtgttgattttgagttgtgttttcgagattttttttttcgggtagagtagattttttgtttaatttgtttttgaaaagtaaagtcggtattgcgtttttttttatttttttaggaagtttaagaatttcggagtttcgtaattttttttagacgttcggaagtaaatcgcgttttaggtaaaacgagttcgtttgagagcgtttttagtttcgttgggttgttggtgggcgtacggggagaattagggggttgcgtttttcgggttaagttcgatcgtttttcggttttatcgtattttcggttttttgtagcgcgcgcggcgcgggaagttgttatggatcgcggtcgtttagcgggtagtttttttagcgttagcgtcgagttcgcgtttttggtcgtcgttattcgcgattcgcgtttcgggcggatcgggtcggggtcggcgggttttgggggcggttcgcgtttcgggagcgggcggtcggcggcggcgaatgcggcgcgggagcgtagtcgggtgtagattttgcggtacgtttttttggagttgtagcgtacgttgtcgttcgtgtcgttcgatattaagttgtttaagttggacgtgttgttgttggttattatttatatcgcgtattttattcgtagtttgtaggacgacgtcgaggcgtcggcggacgtcgggttgggcgttttgcgcggcgatggttatttgtattcggttaaggtaagcgggcggggcgtatcgcggggttggggtcgagattaggatattttgatttgttttgttagttatcgttttgggtagatgttttaattttttttcgggtgaggcgggaagtcgatcgggagaacgatttcggttcgcgagggtattggtggtaaggttttcgtcgcgaaagtcggttttttcgcggtttataggtggttggagaggcgtttaaagtcgg

SEQ ID NO: 7269 - DNA, 363 bp, synthetic construct
  misc_feature 1..363: note = Description of Artificial Sequence: Synthetic polynucleotide
  source 1..363: mol_type = other DNA
cgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttttttggagttcgttgagtacgtatacgcgtaggcgaagttgtttttttaggtttttggcgttttcggcgcggttgttttcgcggttgttttcgtttatggtcggcggcggtgcgtagcgcggcgttgttcgtcgtgttgagcgt

SEQ ID NO: 7270 - DNA, 960 bp, synthetic construct
  misc_feature 1..960: note = Description of Artificial Sequence: Synthetic polynucleotide
  source 1..960: mol_type = other DNA
cgtagaaaacgttgtaggggttaggcgttcgagatatttcgcggggtagtgggtattaggtttaggtttcggttgtagagcggaggggcgtcgggtttaggaaaggggttgtgggtgggggtacgggggagattcgaggggtgttgggaagagggtttttttttttagcgttagttttggtgtcgttgtgtattcggagtcgcgcgaagggcgtttttcgattcggaggtataggagcgtttagagaggaaagaaagaaaaagttatcgttggttcgaatttttggaagtcggagtcgggttttttgttttaaatatcgaggtagaattttttttagcgttgtttcggtttttttgttatttattttcggtttgtttttggaagaatcggttttttagtttttcgtcgtcgtagttgtgatataagtaagtgtagtcgcgttgttcggggttcgttagggtttttcgcgttcgttttttatcgtggttcgcggcggtcgcgttttcgtttcgtttcgttcggtcgtttcgtcggtttttgtttttagttgggttgtcgtgacgaggagacgttgttgtgaaattaaatttgattttgagtttttaggcggcggtcgagagttcgcggttgttgatgtttttgggttttatttcggggtaggagggcggcgatcggcgttcgggaagcggttgaggggcgtcgcgatttttagcgagcgtcgttcgagttttagttcgttcgggtagttttcgaggtttagggcgtcgtcgttaggtacgcgaaagttatttggaagggagttgggtgcgcgtaataatggggttttgagtcgtggtcggtaggggagaggtgtagtcgtttaaggttcgtggcgtcgggcgttgtacgtggagggatgtgttaagggtcggtttgttttttttcggggaggtggtaattgattgggacgtcgggggacgg

SEQ ID NO: 7271 - DNA, 1404 bp, synthetic construct
  misc_feature 1..1404: note = Description of Artificial Sequence: Synthetic polynucleotide
  source 1..1404: mol_type = other DNA
cgttcgttttttttaggttcggtgggattagattcgaagttaattttcgttaggcgttaggtgtagattttaggttaggttagagtagtttttgggttttcggatcgggatgttcgttttgtttttttttttggtttcgttcggtttgttatagggggaggtttcggtttcgtatttcgggtagcgaatttcgtcggtcgaggttagtttcgtgcgggggtttttcgcgggatcgatcgttaagcggtattgttcgtttcgggcgttcgttcggttttagacgtaggttttgcggtcgtttcgtgataagtatattgacgggttattgttttttgacgagtgttaaaaagttcgtttgttttgaacgttaatttttaagtgatttttacgaggttttttttttcggttttttcgttgttgtttcgttcgtattcggtttttagtaggtgtttaagaaacgtttagtaaacggtagcgtaggcgagtttgttttgcgcgttggcgcgttttattgtttacggatggcgggcgattttacgggattttcggttcgtaggattttcgttttcgaggttgtttttgggtcgggaggggttattttagaggggcgtttattttcgacggcgggggtcggggcgtcgcgggtaggggagggcgtagtttttaagtagttttagtttggtttagatttcgcgtttagcgagtcggtcggttaggtttatattttttatttgtcgttcgttttaggggaagggttttttcgacgacgttcgagtttttttttttttcggagggtcggaggtcggcgtttattggtcggttttgggcgacgtttcgttttttcgacgttacgggttaatgagcgcgcgttgttagtttattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcggagggtttttttttcgcggatttcgagttcgtttcgcgcggtttcgcgttttttgtttttttgtaaagtaatttttagggtcggttcggggcgtttttttttcgtagttcgggcggtcggggtttttgagttcggcggggtcgtattaggggtgggtgggtcggggtttcgggaggggaagcgcgagcgcgggagcgaggaagaaaggcggcggttttcggggatttcgcgt

SEQ ID NO: 7272 - DNA, 1247 bp, synthetic construct
  misc_feature 1..1247: note = Description of Artificial Sequence: Synthetic polynucleotide
  source 1..1247: mol_type = other DNA
cggggggtaggtcgcgagagggagaggatttcgggagtagacgaagaagtggagtagttaaagtttgcgttagaagaggttggggattgcgagaggagaggttggggtttgtaggggagcgtagtagtttttagtatcgatttaaattttaaagattcgtggtttttgtttgatttcgagggtcgggaatagacgtttgtttttgtggagagcgatatttaatcgagaaaatggggttgtttcgagttgggttttgcgtttggtttagggcgaggtttttttggtttcgggttggtttttgaggggcgtaaacggtaggtttggcggttggggtcgaggagggagggtattatcgtttcgaggtagtacgtagtttgtagtagaggcgtttgttttaagttgttttttgggggcgtcgtcgtcgtttttttttttcggggtcgttcgtttttaggaaagtggaggcggttggcgaggatcgagagtcggggtcgcgttgcggagggattatattttcgggagttcgagggggattttggcgcggcgggttagtttttgtttttcggttacgggtcggtagcgttcgttttttttcggttagcgtttgcggttcgcgtcgcgcgtatcgttcggtaatttcgcgcgcgtttcgcgggggcgttgcgtttttttgttatatcggcgtatcgcggttttttttttttatattttcggttcgtattattcggttttttttttattttttttattttttttttgttttttttttttatttttttttttttggcgaggggcgggagggggcgtggcggggtcggggtttgtgtggttgggattcggtttttcgtatttcgagttcgttcgaggagtcgggtttcggtcgttgtttagtcgtttcgtgtttcgcgcgttttgcgtcgtcgttatcgttttttggggagacgtagttatttgttcgttatggatatttttagggttttgttttcggtcgttttttttattagttttttgtgggatttgttcggtttttagtaggtttttattttatttttttcgtcgttcgtcgagttgggttttattaagggtatgcgaagtcgtaaggaaggtaagatgtagcgggcgtcgcgcgatagtgacgcgggtcgggagggttaggaattatagtcgcggttttaggacgaatttcgggtttagtagtttcgggcgtaggagtcgttaggtaggggttcgcgcgtggtgttttacga

SEQ ID NO: 7273 - DNA, 1861 bp, synthetic construct
  misc_feature 1..1861: note = Description of Artificial Sequence: Synthetic polynucleotide
  source 1..1861: mol_type = other DNA
cgtttattgggcgacgtggggaaataagttttagttttcgaagcgcgattaaaaggagaaattaagtttttatcgttagggcgggggagggaagttgggtgtcggtaggcgtttcgtcggagacgagatttttttcggttttagaagcgtttcgttagggttagagagggcgagcgtggcgggagggaagtttttgttttttagcggttaggcgattcgaagtcgagcgtcgtgttatacgtatttcgtttcgttttgtttgcggtattttcgtgtaatttttatgaaaatgttttttcgtttttgacgtttcgcggtgtaatttttattttttaacgaggagggggtcgtcgtaggattgggaatttagtggtcggcgttttagtattttcggacgcgtttcgtgttttttttagtatttttttgagggatcgtttattgcgattttacgtagtgtcggttatttcgttttagtcgtagggagtattaaataaaagaatttttgtaaatttttttttttggatattcgcgggttttttaaatttggtttttatttttttagaatttgtatgtagttaaataggaaagttggcgcgggggggatggtgtgcggaggaagggatttcgaagtttttaggttatttttggtttcgaggagcgcgcggagtggagtcgttttttcgcgggttcgatttaggttttttttttttgttattttttttttttcgttttttttagattacgtagtaagattcgtcgagggcgaagaagttgggagtgattttaggggtttttgcggttagattaaatcgtaattttcggtgtttttattttcgcggatcgcggggtaacgttagcgagtagcgtttttttgaggaagggaagagggggaaagggtgatcggacgagcgtatttgttttagcggattttcggtgtatatttggggattgggggttttttaggtggcgtttttttattttttgcgggtttttttcgtagttttaaatattttaaacggcgcgcgtatttttcgtttggtttatttatcgatttcgtcgatacgtaggttattaagtttaaggtgagtaggatttacgcgcgtcgtatattttttagggatcggttgtttttagtcgttgtttgtaattagggtaaaacgaagttttttgtttagcgttcggcgtagttcgcgtatacgaattcggagtagagtatcgtagcgattgcggtttaggttcggggattcgggttcggggttcgggggcgttcgttttttttttttgcgtttgttttcgtcgttcgtagttgcgtttcgggaacgcggcgtttttttatttgttggtttttgtattttcgatacggagttggtgtttcgggaaggttgttttttgaagttttttttgttttgttgtggttttgttttttcgcggatttttttttcgtgtcgaggtttagtttttggttttaaggaataaattcgttggtttgaaagggagttacggtagaagtttaggggtagagcggcgggagcgcgcgattcgcgcggttggagtttcgggggtatttggagagtagcgcgtttaagcggggttattggtttcgcggttgcgtttttttttttttcgcgtcgcgttttttttttcgggttttttttttttttttttttttttttttttttggtttttttttttttgagtttgtttttttgggtttttttgggcgattggggagaggaggcggtagtgtgatttttagataaattcgggagaaatttttataggattatacgtcgattggtagtttcgaggattagtgggcgtcgcggtttcgcgttgtggttgcgtcggttttgtttatcgg

SEQ ID NO: 7274 - DNA, 3044 bp, synthetic construct
  misc_feature 1..3044: note = Description of Artificial Sequence: Synthetic polynucleotide
  source 1..3044: mol_type = other DNA
cgtcgagggggaggggttggaagatggcggcggacgtatatttattcgatcgcgatagagtttaggtttttagttcgcgtcgtcgttcgttgttcgtagttattgtgggtagttttgttttgtttcgcgttgttggtagagtcgtttcgcggaggcgtgggattagggtggcgttcgtattttttgttagcgcgttttcgttcgggttcgtttagggagtatttgtgtacggttatattggattttgtgttttagttattgttttagcgcggcgggaaaggagagggtacgtatagagtttgggtttagttttagtttcgttggggtttcggagttaagatgattagcgaggaaattcggaaaggcgttaaggaaaattatatcgtttaaggttcgttatttttattttagtcggttttggcgtttttttttttcgatatatatttttgtttttagatatttttaaaatagttcgggcggtcggcgttggtcgtagttttcgtggtttgggcgtcgttagcgggagggagggcggcgaattggggcgcgtaggcggtcgtagggtagtgggcgagggggcggagggtagggagagaggcgggaatatggagttaggtttttatttgagtacggattgtttttttttttttttttttttttgtttatttatgacggttaggatgattttttttttttttttcgtgaggtggttgaggttaggtatttcgggttgtagaggcggttgagaggtcgtcgggatgggagttaggcggtttcggggttcgataggagtcgatatgtttggtggagtcgaattattttagggaagcggggaggtaattttattggtagcggcggtatcggcgcggcggttggggtagtttttagcgttgggataaatatatataaattaatggtttttaatttaaggcgatagttttttttttttaagaaaagtagggggaggggagggcgagcgcgtggggaaggagggttgaggagtgcgtttcgggaaatgtttttttttttcgggggcgaagggttgtgaagtgagcggtttaagggaaaggggaattggaggtcgggacgcggagtgcgcggagaggcgggggagggtggtggagtaaggtggcggggatagttaagggtggggtgattggagggagtaggcgggagggcgataggcggatcggggcgcgagtgtgttcggtcgcggttagggtcgggagcgcgcgcgtcgtttcggaggggaaggggtgtttgcgaataagttttcggggaattcgtttcgagcgttcggaggcggagtattgtcggttcgaggggtatttaggcgggagtcgagagggtcgtgaggaagcgaggacggtttttcggagaagtaatttattcgtttcgtcggttgacgtattatagggttttcgcgcgttatagagggagaatttttttaggtatattcgggagcgggtcgcggggtcggaaattttcgcggagattttaattttatttattttattttcggttagagtggagaagcgaaagcggagaagatatgacgggggttagcggcggagagtttcggggttagggtttttcggttgttaacgttcggatttaggcgagtttcgacgtgtagcggggtttggcgtcggtttttttttattacgcgttcggtttagggtcgtttagtcgtcgttatcgtcgtcgttttttgggtcgatggagtcggcgcggaaggttcgcgcgttttgcgtcgtcgtcgtttagtgtcgtcgttagtatttttttcgttttttcgtttttcgggtttatttcgcgggggcggcgttattttttcgttgtttaggttcgggtatcgcgggcgtttcgcgggcggtagtcgtttttttcgagcgcgatttttaggttgggttcggggtcgggcggggagggaggagagattgagcgtgaagggagagggcgttcgagttttcggggacggaagtgtggagaataggagcgtgtgagggggcgttcgaggtgtcgggggcgggggaagagtatgagtaggggtgggggtaggggtgttaggtgtagtaggtagggaggtagaggcggcgagtgggggcgttcgagggatcggggcggggcggggagcgtaagggtggtaaggcgttcgagagttagggttggagttgaaggtgggtgatagggagggggcgtttaggtgttaggatttgaggagaaagagtgcgcgtagcgggagggtttcgaagtgtcggggcgggattttggaaggagggagaacgtgaggagggaggaagggtttttggggtgttagggatgggggttaggaaaggggtagagagttggaggtttataagtggggatagcgggggagggaggttggagcgagtggggaacgtaggtggtgtcgagggcggggatagggcgaggggagcggggcgtgaggaagttgtgggaaatcgcgttggacgttgagaatgtgcggaaggattttgaggggaggacgcgagatagcgcgaggagagacgaggagagttagggttggtcgggagggtgcgaagatgaagcgattattggaggttgtgagggtgaaaggagtaagaatcgtttagagacgggttgggtcggtgttggggttaaaggtttttgtttgttaggttttttttggcgtttattttagaaagaagaggcggagacgcgaagagatcgggttagagttagattttcgaagtacggagatgggtttaatgaaaggacgaggaaagacgagaaattagcggtcggagaacggaggtggtcgtcgtcgttttttgttttgttcggggttgggcgtcgttcggagagttttttcggagggggcggggcggggtcgggtgaatagagttgggcgggttcgttagtttttttaggcgttttgggtaagtaatgtgggtgattgagttcgggtgtgtgtgtttgtgtgtgtgtgtgtgtgtgtgtgtgtgtacgtatataagtgagcgtgtgtgcgtattttatttagttttttatacgcgcgt

SEQ ID NO: 7275 - DNA, 1603 bp, synthetic construct
  misc_feature 1..1603: note = Description of Artificial Sequence: Synthetic polynucleotide
  source 1..1603: mol_type = other DNA
cgatttgatttttgcgagcgtgtttgtttcggaaggtgttttttgattcgtcgtgttttttaagtattatcgggattttcgggtattcgggggtttagggttatgtatttttttgcgcgtttatcgttttgaatttatagttttcgcgttgggaagtgattggcggttttttttagggaggatttcgcgcgttattagggttagatattattcgaattttcgttcggttgagcgttttggcggcgtgagtcggattcgttcgaagttttaggatacgatttgttagttattagttcgcgttcgtagggtagagacgtacggtcgttcgtcgtagaggcgcgaatttttatatttattttttgtttcgtttcgggtttggtgtggttttggtatcgtttaggatcgggattttgacgttttgattttttatcgcgtggggaagttatttttttcgtttcgaggtttcgatcgtttagtttttttgagaagtttttattttggttattaaaagtggtttttaagagtagttttacgttaatcgtataaagtaatgataataataataataagcgtttaaaggagcgggattgttttttcggttggacgatagcgtcggggattcgtagcgtgcgcgggtcggaattaaaaaagtagttcgggagcgcgagggttgagcggggtaagtatgggttgtttttcgtagttttttttttgttcgaggttcgggttggtcgtttgtttgtttatgattgtttagttgttttttcgattgtttaggtaaagtttgagatatttaggggatcgggagcggattttttttagtttcgttatttatttatcgttttttcgtttcgcgtatttcgtttttgggtaataattttattaattttcggtttcgcgcgtaaatttacgtttgatttgtcggggtttgttttgttttcgtcgggatatttcggcggcggttgttgtcgttggggttttcgcggtgttcgcggtcgcggttgtcgttttttcggttttcgtcgtcgtcgtcgtcgtcgtcgtcgttggttaggttcggttcgtcgtcggtcggattttaggtgtttcgggcgttgggttttttcgggagtcgcggatttacgttcggagatgagtaagtaaatgagagaagagagacgggggtatagagagtgtgatagtgaggaggggagggggagaggagagcgacggggggagaatgggaatgtataagcgaacggttagggagagagaaaaggggaaagagaagagaaaaataatacggaaagaaggaagagaaggagggagggacgggagagcgagtagcgaggagagggggagcgcgggggcgtagggcgcgggaggaggagcgcgttcgttcgtttttcgtttcggcgtgcgggacggatatttcggcgtcgtcgtcgtcgtttcgggtcgcgtagtttttgttttgcggcgggaggcggcgaggcgcgcgagggaggggcgcgtcggggttgtggggaggggagattattttattagttaaaggaggattggttgtatttaaatttagttcggatgtaaattacggtttcggttttggtcgggcgaagtgcgg

SEQ ID NO: 7276 - DNA, 1365 bp, synthetic construct
  misc_feature 1..1365: note = Description of Artificial Sequence: Synthetic polynucleotide
  source 1..1365: mol_type = other DNA
cggtttgtatttttatcggaaagtgcgtttgttatattttttcggattatttcgttttttcgagagcgttttgttttttatagttcggaaagaaagaaattttagttgtgaagtgatcgtggagaaagcgtaggaagcgatataattggttagggaggtagagagtgtgagcgggcgtattttttgtttggggatcgcgttcgcgggcggggacggagtattttagtggttgtattcgtcgtttcgcgtttttgtttggcgtcgttaatttcgcggcggtcgttggaattttagagttgttaggcgtttttagtcggtttcggtaaatttttttttagtttacgtgttaattaagcggttcgtttttcgagttcgggatggagtatcgcgtttagggaggtcgcgtcgttcgagacgtgcgtacggtaggtaatttatattaaggtagtcgtagttgcggcgtttgggtatatcgtcgtggattttaaatggtttaagagcgtttttttagttttgcgtttttagtgtttttagagttttttttttttttcggagcgtcggtataacgtattatgtcgttgggtcggagtttagggttcggtagaggttgttaatttattgattataattatttttttttttaattcgttcgtagttgttcgttttggattaagtcgtttcgcggttcgtgttaggtagtgggttcgtttttttttttttttttttttttaaattgggacgtgcgaaggcgtagttgttttttcggggttttttttattttttatatattttgttttcgttttttgttttttaggttcgtggcggagagatgttgatcgcgttgaattgatcggtgcggttcgggggtgagtggcgagtttttttttgagttttttttagtagcgcggtcggcgtcggttttttgggcgaattttttagtttttagattttgagaggcgtttttttttcgttcgatcgtttagatgtagtttcgtttttttttttttgtttttattattttgaattgtatggattatagttattgttaaggtaatcgatggagacgtagtaagcgaggtgggtttttttttgttaaaggtgcgtggtgggttttaggggtggcgtgtggaggcgtttatttacgttttggtttcgggggtttagatggttagggttgtgttttttattttagtttttgcgggtttttagtttttatttttaggattttggagttttataaaatattttgttttttgtattttggaggcgcggggagtcggagcgagacgcgttgggagttcggcgagtcgggcgttaatcgggcgtttagggttaagtcgtgcggttcgtatttatgttcgtcgt

SEQ ID NO: 7277 - DNA, 419 bp, synthetic construct
  misc_feature 1..419: note = Description of Artificial Sequence: Synthetic polynucleotide
  source 1..419: mol_type = other DNA
cgtggcgggcgttgtttattcggcggagtcgagcggcgtgtagaggttataagtgtcgtagttggtgattgggggatttttttcgggaatcgtgtcgggagagcgcgcggtgttggagtcgtatcgggtggtcgaagtagaaggtgagtggcggggagtgggatggggtggaggttttgaatgtaagggtgagagttttggagtttagtagagttggagcgtatattttcgttttttttttttcgttttcgagtattaggcggatatattcgtatttcgaatgttttagtgggcgtagagtttattagaaatggatagtcggatttttcggcgtttgttgggggtatcgttgttaggtgtttggggttcgttttttcggttttgttcgtatagggcgtatttagaggtcgttttttcga

SEQ ID NO: 7278 - DNA, 3675 bp, synthetic construct
  misc_feature 1..3675: note = Description of Artificial Sequence: Synthetic polynucleotide
  source 1..3675: mol_type = other DNA
cgtagcgaggtcggttgcgcggtcgtcgcgtgggtcggagtttagtgttttttggtggcgtcgaggcgggtaggcggttttcggatcgcgcggaggttcgacggttgtgatttaggggtggcgtcgttgttagggcggcgggaggtttgattggggtttcgtcgtgggttgagttacggcgtaattaattattagttgttgggaatttttgtcgttcgttcgcggtgatttattcggtagttaggtttatttgtcgagcgcgggggttttggtttttaaaatgaatttggggagagtgtttgttcggggtagggtttttcgttttttcgttttagggcgttcgtagatttagcgaggatttgacggtttagacgtagtttatagcgcgggttttttttttttggtgggtattcgtgatttttgaaagtggggtgtagagcgttttagttgggaggtttcggtgaattattggggttttagattttttgggttcggggtttttgaggttagggagttcgagtatcgttttagggggcgatttatagaagggattggttttttggagttcgcgagttgttcgagggttaggtttgattttttagttattttttggttagttgttagtttgtcgttaggtaatttttttttatttttattttttttttggttggggttaggagaggaagaggagtttaggggtttttgaggtttgggtttgtttttttggagttttagggttttaggcgggatttaggaagtcgaaggttaaggaaaagtttttcgatagtttaaagggagagggcggggagggggaggaggtaaaggaggttaaaatgggaaggagataaagtttggagagggtttatttggaagtagggaataggtgcgttttagttcgagtttcgtgtttttattttaggtggtttcgagggggttatcgcgtggtttagggttgtatttacggcgtattttgcgtttagttgtggggaattaaagagtgattatatatattaaagagtgattatatatatatatatatatatatatatgtgtgtgtgtgtgtgtgtgtgtgtgtgtgtgtgtgtgtgtgtgtatttttttttttttttttagtaaagtaatagagaggttattgggtcgggggattgcgatgttttttttcgttgttttgattttaaaagtggcggtttatgttgtttttagcgttttttagggaaacgattcgggtttgtaggtgttggtttaagcgggttgtgtcgttgggaggcgagggggtcgaggtagttttcgggattttattattttacgaggttatgtttttggttaatgatacgttttcgcgtcgggtggttaggtggggggtggggggtggggaagatttcgtgaatcgttgttgtcgtttttttgtgtgtttatggttttttttttttttgttttttattttttgtttaatttgtttgaagttgttagtttgttatttttggttgaatttcgttttttttttttaatttcgagttttttaaattttttattcgttagggttgtttgcgtttttggggagcggggttagaaggatttaagaagtcgcgtttatttttttatttttcgttaaaattcgtcggcggtttcgttttcgttttttttttggcggtttaggtcgtttttttcgggtttttttcgcgtgcgttttgcgtcgcgttgggtttgtagcgggagttgttatagtagtttcgttagttggttggggattaggcgggaggtggcgcgttttggaggttgtgggagggagggagggagggaggttcggtttcggcgtagttcggttttcgtttttcgaggttttttcgtcggagcggggttgttaagcgtatatatatatatatatatatacgtatatatatacgcgtatatatatattcgggtttttaacggcgcgtacgtacgtagcgttcggggtagattagcgcggcggtcgtttttcgggacgttcggacgtcggagggtttcgattttcgcgcggtttatgcgttcgcgttcgtttcgttgtttcgcgaggttcgcgggatttttttcgtcgtcgtcgtcgcgttcgtcgttttcggaggagcgggttggtcgatcgttatcgcgtcgtttttcggtcgttttcgaagtcgttttatcgcggtttttgtcgttttggggtcgcgtttcgttttcgcgttttgggggttgagtcgagtaaatttcgcgtatcggtcgacgttcggcggggatttcgttgcgtattcgcgcgttcgggtgggcgttgggcgcgcggatttttggggagcgggttgtttttttcgttgtatttgttcggtttttttttcgtttgtaggggattttagagatatcgttatttcgtaaattttttttttttattatcgagagggggcgaggaggggtaaaaggggaagtaggtttcgttgggcgcgcggatttgtaggttttttgttgggtatcgttattcgcgagttggatttataggggtatcgggtttcgcggtcgtttttcggtcgttttttggtttcggttttcgtttttgcgtttttcgcgggagcggggggcggggtgcggagggtagtaaggttcgcgcggtatttagcggggtcgttttgtatggttttgcgtagtggggcgggttgtttcggtcgggtttggcgtagggtgtcggggttttcggacgtttggtttcggcgttcgagtagttttttgtgtttgttcgttttttcggttgagttcgggttcgcgtcgtttttgtttcgttagtcgtttcgcggtggcggtggttgtggcggttttagcggagggggttttttttagttttttcgtttttcgtttttttgttgttgttgttgttgttgtcgtcgtcgtttataatttggaggcggcggcggcggcggcggaggaggaggcggcggcggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaatttaaagtcgaggagattcggattaaggggaagtataatattagtagcgaggattatcggtagttggagttggtgattttgtagtcggaatcgtatcgcgtcggcgtttagtggaaattcgtcggttttttttattttgcgattacggttattattattataggtaagggttgggcgcgtcgttgggttttcgcgtttcgggaggagttcggggaggcggttgagcgcgtcgcgtcgggttgggtgtagggcgtcgagggttaaacgtagttttttttgggggttttttcgtagcgtttttttttttttagggagtttttttttcgcggcgttttcgagttttatttttcggggattttattcggtgttttttatcgcgttggtgtttgggtcgggcgtgcgagtttcgagcgagtgtgtttgagtcgggagggcggaggcgttatttttgcgaagagagtggagcgttaagaataattttatagtagatatttatttatttatcgtttcggcgcgggttgggttgcgcgg

SEQ ID NO: 7279 - DNA, 3675 bp, synthetic construct; identical to SEQ ID NO: 7278
  misc_feature 1..3675: note = Description of Artificial Sequence: Synthetic polynucleotide
  source 1..3675: mol_type = other DNA

SEQ ID NO: 7280 - DNA, 3378 bp, synthetic construct
  misc_feature 1..3378: note = Description of Artificial Sequence: Synthetic polynucleotide
  source 1..3378: mol_type = other DNA
cgggtcgggtcggcgaggggggtttcggtcgagacgcgaggcgcgttacgggattcggcggcgggagcggatggcgagcgagcgagcgagcgggcgggcgggcgggcgggagggaggtggcggtcggggttgtttaagatggggtcggagtcgcgggttaggcgcggaggagacggaaggggcgggtagggtcgcgcgggcgcggtgcgggcgttttttttcggtagttagcggtagcgcgtcggtttttcgtttttcgttattgcggtttcgcgtcggtcgtttgggtttggagtttcgcggcgttttcggaggacgggtttcgcgttttacgatttattttcggaggcggggtcgggtcgatcgggggcggaggacgtcgtaggaggttgttcggatttcgggcgtttgttaggttttttttggggttttttatgttaggtttcgcggttgtgttcgtaagcgtagatggtttcgggattcgggttattttgacgtcgtagatttagtacgttgcggatcgggtacgttggatttcgggataagtgcggagggtcgggggttggaagggattcgagagtagagttcgcgtttttattttacggacgcggttatcgaggttcgagaggggtcggagtttgcgggagagggaagggttttcgagggttttataatttggttgcgttttttttttagttcgggattcggatgagtgttgtttgaggtcgaggcgacgaatcgttttttattcgtttttgcgcgggatttcggtaggaataagcgttcgtttttgggatcggaggcggtaaattttaggttcgagttttttagcgtagcgtttattcgcggagtcgcgcgtttttttggcgtatttttgggtttcgcggttcggtttttagtcgtcgggtttttcgggttagttttttgttttttagatcgaggcgtaataagtttgaaagtagcgttaaggagtagttagcgagtcgaagggagggcgtggggcgtcgggcgtttcgggattttcgaacgcgcgtaacgttcgttttcggggatcgggcgcgggcggtaggcgagcgggattgattcggcgggttgcgtatatttttttttaaggtttcgattgtgcgcggacgggggcgcgtttaggaattttcgttttttttttcgtttgtttgattttgttgggtatttaaagtcggattcggcggtatttcggcgtgcgggcgtagagtttcgttgtcgtttacgggagggagcggttcgatttttttcgttgttttttcggtagtcggggtcgtagacgagtggaaggtatgagggttttaggagacgtgatagtcgtttttttagattttatatatcgtatattattttttttttagatagaaaagggatttagtttttttttttttcgttttcgttcgcgcggtttttgttgttttttcgcggcggttttcgtttcgagggggcgtgtgtttgtgtttgtggggagagtatcgagggttttcgtgggtttttaggatggagcgggagagtagattttttagttttttttttaatataaacgataagcggtttttttggggcgggagtgtaggttttttattcgtttatacgtttttttgttttttaattatttcggagttgtagtttaggaatttgcgttttagattcggaggaagaacggggaggtcgcggcggggacgggtgttgaaagagggttggtttagggtttttcgggttttagtttaggcgtttgcgttttaagaaatttagaagtttaaaataaaagtggaaaggggtaaggtgtttagcggtttggggttggggtgttagattaggcgttttttttaggttgtcggggagtggttaagtaggagtcgtcgcggttaggaggagggacgcgggttcggagtcgtagttttcgttaagttttttcggtcgtatcgtttcgcggtgatttttagtttcgtcgttttttttcgaggtcggaggagttttttatttcgtttagggggtcgcggggatttagggagagggtttttggtcgggtttagagtttttagtttttttaggagggggcgggggtcgtgttcgtttttcgaggtagtttcgcgcggttttaagttagcgcggcgacggtggagggtcggcggtttttgtttatcggcgacgcggattcgggagtgttcggcgttcgggagtgttcggcgtttggagcggagacggtatagggtcggtttaaagttgagagcggtttattcgcgcggtttgttcgatttagtggaaaggtagataaggagggaagagttaggcgttcgcgtgggggtggggggcgtaaaaatagtttttcgttcgaagtgggggagagtatttttagggagtttttattgttaatgttaggtttataggcgagggtttttacgagcgagggtttcgagaaggagtttggggtttttttttgtttgtttcgagttttgtgcgtggggggaggacgtttcgggtttttataatgtttgtagggggttttggacgtgattagtaggagggggatacgttcgggggtttttcggagtttgttgcgtttatgtgtggttgttgggggttatggggggtttttttagattttcgttagcgtttgtgtgtgttgggggtatagcgggaacgttttttttagtttgttttgtgtatgtgatgaagaggggtgttaggttgtggtgtgtggatggggaggaggcggcggcgtcgaggagttttttttgcgtttagggtcgttttttttttagtttgtttaatgcgggttcgcggggatttgttatattttatcgttatcgttggagaaggtagggggttgagggggtagggggtgggggtttaaatttttgagttttgagcgtaaaatttcggagttgcgaagttttaaacggcgaagttaggaagtttgggcgttcgtttttttttcgatttttttttattttcgttgcgtttttattcgtcgcgtttttagtttttcgttggagttttttttattttttttagtagtagcggtttcgtcggcgaggattcgattcggcgagttgtaaattttcgcgagcgtttcgcgtcgtcggcggttgagtcgggcgttcgatcggaggtggggggggtttttttagtcgtcgtcgttttcggttcgttttgggtttcgtcgggacgttttttggagagtattcgtcggcgtacgtaggttttttttcgttttttcgcgtttgttggagtttttcgggcgttcggagggttcggatgttcgcgttgcggacgatgttggcgcgcgggttcgggtcgggttaggacgcggcgcggtcgtttgtgttttcggtttttcggtttcgcgttcgt

SEQ ID NO: 7281 - DNA, 1108 bp, synthetic construct
  misc_feature 1..1108: note = Description of Artificial Sequence: Synthetic polynucleotide
  source 1..1108: mol_type = other DNA
cgggggtttcgattttttttaggttcgtttttaattttatattgttattcgttcggcgtttatttattttttttagaggcgtatggatttcgtcggtcgggttaggttacggcggttgcgggttatagcgattttttcgggataggacgggtgcgggttttttttattcgtaggttcgtcggtagttttcgttcgcgtttttgttcggcgtttttttcgtcggttcggtcggggttttatcgcgtcggcgttgagttgggttaagatggcgaaggtggagagtcggttatagaggtagcgcgttcggagggcgtcgaggggtatcgtgcggtagtcgcgttacgattagggttcgagttgcgggggggcggaggaggagggtttgggggcgggcgggatacgggagggagataggcggagcgttagcggcggcggggacgcgggcgtttcggttttcgagcggcggtttcgcgtttcggtttcggtttcggttcgtcgtttcgtatttgcgttcgtagtcgcgcgttcgttcgttcgtcgtcgttaggtttcgcggttcgggcgtttatgtcgcgttttgcgttcgtcgtcgtcgtcgttgagagtcgcggagcgtagttcgagggagcgtcgggcgggggagtcgagcgatcgggggcggggcggggggcgagagttggttcggggttcggtagtcgttcgtttcgcgttttcgtcgtttttagttttttcggggttcgcgttttcggttcgcgcgggaaggagggggaggttcggaggggcgcgtgggcgtacgtggagcggggagggtgcgagtcgggtgtggtttgggggcgcggggcgggttcggagcgcggcgagggttcgtttcggagtttttcggtttcgcggtttagggcgtcggttggagttgacgattttgggatcgttttattttttatatttatttttttcgggttttattatttttggtgtttgcggtttattttttgggatagatatagtttttttcgcggggaggtttgtcgttggaaatttttttttgcggtttgatttagtcgttcgttgtttacgggtcgcgattgtttcgttttttatttgagtacgt

SEQ ID NO: 7282 - DNA, 1700 bp, synthetic construct
  misc_feature 1..1700: note = Description of Artificial Sequence: Synthetic polynucleotide
  source 1..1700: mol_type = other DNA
cgaatatttatacgtatatatatattcgggagcgtacggacgagttgttttttttaaggttatttaaacgttttaattattttcgggcgcgtaagtttaagcgcgggagttaggatttatcgttaagacgttttgggcgaggaattttacggttattgtttttagtagtagttatttgtatgggaaagggaggaagagagacgtgaacgtgcgggttcggtttgttagttttcgagagttatatcgaagggtttatgcgcgcgtgatttacggggattaggtagaaagtcgtttatcgtcgtagggtagggtcggttatcgcgcgttggtttttttttatgttggcggttcgtttattttgggtttcggttagttttatttagtttagaggcgatagataaagcgagtttagcgtaggatgagggaggtagtttatttttatcgtcggtttcggttcgcgagacgcggggatagcgcggtgcgcggttcgtatgtaggggtgatcggagggtcgttttttttacgattcggaaagaaggagagtttttcgttaggtttttgtgggtgttttttggtcgaggagttcggttttcgtttttttattttttttttttttatttttaagtaggagagcgtgtagttttagtttgtataaggcgttttaagtcggtgttttcgggttagggtttgggcgtcgttcgggggtcgtttttatttcgggttcggttttaggggttgttgttcgaacgtattggtttttttagaagtattcgtcggcggtatatcggtagggcggtcggttttgttgggttttttgggcgtcggtttcgggggttcgggcggtttttttcggttttcggtttggattcgcgaacgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcgttcgcgtatcgtcgggggggagggggtagcgttaataaattggggagttcggttcgtcgcgtttaggttttcgtttggagtcgtcgtattcgggacggtgcgtagcgttggaagttcggtttttcgagagttagttgttcgtcgcggttttcgtacgtcgggtagtcgtttttcgtcgtttcgggcgcgttattatggggtttcggtttagcgtttggttgttgttgttgttcgtcgtttttttgttttacgaggagtatagtcgggtcgttgcgaaggtgagttttcggttagtttcgttttcggcgtttcgtttcgagtttgggcgtttcgagaggtttttttgttcgcgtttggattcgttcgtttgtttttcgggggtcgcgcgtggtacggttaggtgtattttttgggtcggggttcgttgggggtttttgtaggttacgatcgcgtattggtggatcgagttttttttgttatggtatgggtattggagagttaaggaattttttcggggaagggaggagaaatagttcgcgttgtggcggggtgagggtgtttgggagtcggcgggatttgaattcgcgtcgcgggtatgttcggtagttgggcgtttttattcgtttcgggtgcgcgagggagttgggggttggagggtcgggagcgtttatttcgcgt

SEQ ID NO: 7283 - DNA, 692 bp, synthetic construct
  misc_feature 1..692: note = Description of Artificial Sequence: Synthetic polynucleotide
  source 1..692: mol_type = other DNA
cgattcgcgatcgtatattttgtagagattcggtttcgtttttgtatttttcgtagatttcgttttgtgattatatttttcgttttttataggtattggttcgcggtcgtgtacgtttcgtttttattggtttcgtttcgtgattacgttttcgtaattttgatagattttattttcgaggattttttttaggagtatagtgatttcgtttttatagggttcgtttcgttatattgattttttcgtgtcgttcgcgggattttatttttgttcgtttgtttcggtgtttatggggaagtttggtgttaggggttattagttagtttaatttatcgttcgattggtgggataaggataggttagcgggttataggtcggaagtgagattcgttcggtcgttttgggacgcgggaagatcgaggtttcggtggtttttttttttttcgtttggtttttttaggagaaggagcggttaaggtaggattcgatatcgcggtcgtattcgtttttttttttgttttagagtatagtttgggatttttaggggggagattgaatgagtgttgtcgaggatcggcgagagtttggaacgttcgcgttttcgtaggagaacgaggaggtgacggatagggaacggggagcggtcgttgggtgggacgtttgagattttcgggaaatggtcgggtcgtcga

SEQ ID NO: 7284 - DNA, 1924 bp, synthetic construct
  misc_feature 1..1924: note = Description of Artificial Sequence: Synthetic polynucleotide
  source 1..1924: mol_type = other DNA
cggcggagtaaattgaacgttatttttcgattaaataggagtttcgggtttatttgtttggaagtttttaggcggtttggaggggttcggttttcgggcgcgattcgtaggggttgttttgttcggttcgcggaacggacgtttattcgtcgtagttacgaatttattaacgatattaagtattggtcgggtagattaggcgtcgtggaggcgttttagttttttagtttttcgtaacgacgcgttttaggggtgcgtagtgtttggcgcggtgatcggattcggtcgttttttcgatcgcgtagagcgagaggttatattttggattttaggtcgggtttttgcggttttgggagggaggtttcggacgttttttagatttcgggtttttgtaatttcgaggtcgggttttaaaattacggttttttcgagttatacggagagttcgtggttaagggttaagggcggttttcgattttcgggatcgtttttttgagaaatggttgagagttaagtttagagttgcgtagggaagggagttaaagagttggcgtcgagcgcgaagggtcgggaggcgcggggaggttttttattcgttttattgttttgttcgttaatgacgtcgatgatagcgatagcgtcggtcgagtgttttttttgtttcgggtcgtttaggtatcgggtttttttttagtattcgtagtacgtattgaagaagacgttacggaagttttcgttttttagattcgggggaattaggaaacgcgttcggcgattttcgggtagtagtatcgggttaggtttgttttcggaatcgttgacgttattcgtcgtttttttcgtttgggtttttcgcgggtcgtaggggtggaagttcgatttgggttagggttcggatttttttttttcggtttttgcgtcgtcgttttcggtgttaggacgcgttttgttttcgtcgagatttagacgcgtcgaaagtttcgcgcgggtagtttttcgttttacgtttcgggttgcgcgttttttcgcgaagtttttgtcgagtgcgcgcgacggcgtcgtcggattttttcggatcgcgttttcgcgtacgtttgatcggagtatttcgttttacgggggcgttttgcgcgtttttttttttcggtgcgattttcgtttttttttttttcgcggtttttaggagtttaggtatttttcgacgtcgttgtcggcggaatcgggaatttttttcggggttttttgcgggttcgaagtcgttttttcgaggcggcggagttgggtagtttcgggtttcgcgtcgtttcgcgtcgtttcgcggagtcggagttttttttcggagtttggatatagtttttcgtttcgtcgtcgcgtattggatttcggtagcgtggagtttgttcgggaagttgggttgcgtcggtttggggcgaaggtttaaggggcgcgggggtcgggacgcggggttgtggcgacgatcggttttttgcgaacgtttaggtcggcgggttcggggttataggttgggagtggagttggcggttattggggagtagagaggacgtttaggaataggtgtattagggtttcggcggttgggtcgagggtcgtaagtagaggggatcggcggttgttagtaagttttaagtagatgttttcggcggggtagtcgtattttatagcgtttatttcgcgtatatcgagtatttaaaacgagtaaaatcggtttatacgttggaatgtagtttatgattttaaaattttatttttaggttgtttagattatacggtttcgttttatttatttttattgaataacggtcgttggataatttagagaagtagtagaaattacgagaaaaatagtggagttaaacggcggtaaggatcgataaggttggcggggatattgagtaaacggcgg

SEQ ID NO: 7285 - DNA, 1991 bp, synthetic construct
  misc_feature 1..1991: note = Description of Artificial Sequence: Synthetic polynucleotide
  source 1..1991: mol_type = other DNA
cgtttagtttttatttacggagggcgaagataaaaagcgttttaggcgcgtagggaaatcgcgtaacgttgtgtttattgtagcgatttttttagaaaaataaataaggtttttcgataggttattcgcgtaagtagtagtcggtcgagtttttttttttcgttaatttagtagttagcgttgtcgttttttaagattttttttaatttaagtgtaatttagtaaggagggagagttagagattttggggacgttcgaggaaatcgaatttcgaaattttttgtttttaaggcgcggtcggagatttttgggattttaaagcggagagaattttttaattttttgttagaagagcggggttagagatttttgggatttttttggagtcgaatttttttttttagttttatttcggagggcgggagcgaagattttgaagatttttttagcgtaataaatttttttaattttgttggaacgcgggttttgggatcgcggggaagtttagaggggcgaatttcggaattttttgttttgagagcgggattagggattttagggattcgggagtagagggaattttcgtaatttcgtcgaaatatagggtgagagatcgtggggaatttcgagtcgagcgaagttcgtaattttgttcggcgggcgggattagacgcgttttcggcgtttttagatcggcgatgtagcgtggtcgggagtttaggattttaagcgtcgtcgttgtcggtaagtatcgtcgtatttttttataatttaggattcgtatggtaacggttatgttggggggattttatttaagaaattcgggttttgtcgggagcggtggtttacgtttgtaattttagtattttgggaggtcgaggcgggtggattatttgaggttaggagttcgagatcggtttgattaatatggtgaaattttcgtttttattaaaaatataaaaattagtcgggtatggtggtgtgcgtttgtagttttagttatttgggaggttgaggtaggagaattgtttgaattcgggaagcggaggttgtagtgagttaagatcgcgttattatattgtagtttgggtaatcgagcgagattttatttaaaaaaaaaaaaaaaaaaaaaaattaaggttgaattcgggttttcgtacgttcgtatttatttgcgcggttattacgcgttgtttttcggcgattaggttgtattttttgtattggtagtcgcgttatatgtagaagcgtttgtggtttttgagcggcgaggcgtagtcgtggtttttgtagcgtgcgtatttgggtagtcgcggggattttttgttttcggtatttaggttcgacgtttcggagtcggagtcgttttttttgttgttgttttcggcgttcgagtcgttggtcgtttttattagcgttttagacgttttgttaaagttttcggttttgttttgcggcggtatttcgggggcgtgaggggttttcgacggtgtagagggtttgttgaatgtttcgtcgttgggtatggtgtttttaggagaagtgcgagtattttggttttttttttcgtttggagattgttgcgagggatgaattcgacggatagcgacgtttcggaggaggaggcgtaggagacgtgtgcgttgtagtcggaggcgtagttggagtggcgaggtttgggtacgttacgttcggagtggtggggggttgtgtttttttttttggcgcgcgcgcgatttagaattttcggatattttttagaatattttcgggattgtttgggagggagcgtggttacgtttatcgtttttcgattttagttatcgttttttagttgtttgtaaatttgtatcggttgtaagtatttagggttttgttgtagggtttttgtaagcgtatcgagagatatagagcggtttgggaatcgcgtggtatttttcgtttcgttttcggaggcgttaagattcggttgttaaagtacggtgtatcga

SEQ ID NO: 7286 - DNA, 1667 bp, synthetic construct
  misc_feature 1..1667: note = Description of Artificial Sequence: Synthetic polynucleotide
  source 1..1667: mol_type = other DNA
cgattttatcgtagtgagtgtgcgtacgtgggttttaattttgttttgttttaatttcgttgtttttttgtttaatttgatacgtttcgaattttttaatttgggaaggtatttggcgatattgacgtatagtttcgtcgtttggttgttcggaggcgttttttttgcgggcgcgagtgttattcgcgttgggtttagatttagtcggtttttttcgggagaggaagtttcggtttggcggagagtaggaaggaaagtttcgataggtttacgttttaaaattttgtttttagtttttttaagtggagttgtagttggtatttcgaagttgttttcgcgttcggttaaattttcgtattttagacgtttttatttggtttggcgagttgcgtttgtagagtttcgggttgcggttcggtagtttaacgtagtgcggcggtcgcggttaattcggtagtagggcgcggcggttgcggttgcgacggttgagaggttggcggcggttgcggggcggcgacggcgtttttcggcggcgggggttttggtagagcgcgtagcgagtcggggatgaggttttttaagttttcgttggtttgttgtcggcgtagcgttatttgcgtagttatgattcgttgtcgttcgatgatgaggatgtatttttcgtaggtgtagtttttgaagcggtagtaacgtttgtggtttttgagttaggataggacgttatggttgcggtagcgcgcgtatttgggcgtgcgttgtaggggcgttcgtggcggttgcgatatcgggtcgtttatgtataggtagggggagtcgtagtcgtttatgtttcgggttttcgaatgagttggtagtttggttgcgggagagggttagggagcgttggacggcggggttgcgaggttcgtttaggggcggttttcgggcgacgcggtttttggtttcgtagtttcggtggtcgtgtgtgtttcggggcggtcggaggtgtcgtagtcgtttttttagtttttttcgcgtttatagttcggttttttagtttacgtttagttaacgtcgacgcgggtttttgttttgggcgcgtagtcgggtcggtacgttttttttcgcggaggcgttgcggcggttgtaaggagtcggcgatagttttgattaaggtttgagttagtttttttgtagttttttcgtgagtcggtcggatttaatattttcgtcgtttttttttaatttttttttttttttatcgttattttcgtttttggggtttttgtttttttgtatttttcgttttacgtttttttttttttttgcgtttttcgggtgtttgtattttattttttttgttatttgtagttaggttattttcgcgggggcgttcgcggtttttttttttaagtttttttcgttattttagttcgcggttggagattgcggcgttttagaacgcggcggtgttcgcggggcggagaaggggaggattagcgggagtgagggtgggggtgtttgtaagcgagtgaggtggtcgtttcgtttttttttttttttttttttttagtttagatttggtcgcgttttttcgagtttaaggtcgtttttatttcgatatttggtcgtagaagtttagtttcgggagaattcgaatttacgggagtgttgcggttgtatttcgg

SEQ ID NO: 7287 - DNA, 433 bp, synthetic construct
  misc_feature 1..433: note = Description of Artificial Sequence: Synthetic polynucleotide
  source 1..433: mol_type = other DNA
cggttttttgtagtttcgggcgttttattttgttgaggtcgttttcggttttttttgatttaggttgggcgggaaaggtcgggtcgttttcgtttggtttagatcgttggtttattcggcgggcgcgcgtagttgtatttagcgtagcgttattggttttagtttgtagattgcgtttttttttttagtattgttcgtttaggtttcggagttttacgttttttgattggtcggttgttaggcggtgtgaatattgattggtcgaggtacgttggtagggagtttttcgtttttcgcggtttatatttttttttttgaagcgtttcgttagagttcgtttatcgggttttcggtgtagtcggttcgtttgtttagaatttaaattcgaggtatgacggtgtttgtaagagagaagttattatttatttcgcgg

SEQ ID NO: 7288 - DNA, 896 bp, synthetic construct
  misc_feature 1..896: note = Description of Artificial Sequence: Synthetic polynucleotide
  source 1..896: mol_type = other DNA
cggttttatattttggcgggcggcgtacggagcgtttcggttttcggtattagttagcgtcggagtgggtaggattggagatggtagttttcggtttaggggaagcgggattttacggaagggttgggaagagggtaggaagagggggcgggggcgggaattgtttcgttttttttttttttgtttatttttattggttaagggttttttggttttaatttatttttcgtttttagggcgtcgtttaaagtgtgcggagtaggtgttttgggtggagttataattttgcgcgagtgttttggttgagcgtagcgtttatttattgttcgcgagcgtttatttatttgttcggtcgattgtttagcgaaaggggttttaggtcgggcgtagtcgttattcgggggatcgaggttaggagaggggttaagagcgcggttgatttttgcgggtcggggtaggggacggtggtcgcggttatgtagttttgtgttagggcgtgggggttgcgtttgggtcgcggggtcgggggcggtcgtcgtttggttgggggatcggggtcgtgttgggcgtcgcggagtcgggatagtagtagtggcggcggggatagcgtcgcggttggggtttcgcgttttttggagcgttttttgtttagatacgacgatttcgttcggaggtatatcggttttggggataaagattagagagagatgttgtagattttggggttggcggtaaggatttttattcggtttttcgcggtttttttttcgttttgttcgggttttgtttgcgcggtttttcggtttttattttgagttttgttgcgtttcgcgtggttttcgtattttgggtttcgggtcgtggcgtggaagtaaattcgtgtttttggttttcgt

SEQ ID NO: 7289 - DNA, 1494 bp, synthetic construct
  misc_feature 1..1494: note = Description of Artificial Sequence: Synthetic polynucleotide
  source 1..1494: mol_type = other DNA
cgagcggtttaggagcgagtttaaaatttcgtataggtttgttcggtcgcgttttttgattggttaaggcgcgttcgtcgtttcgtcggtcgtaggcgttacggtagttttagtagtttgggtttcgttatcgttttcgcggtagtttcggtcggcgtaagtgcggcgcgcgttgggggagggggcgcggcggagcgttaggttggcgtcgggttatcgcgggattaagttttttagttacgcgtgagtgtttgtgcgttttgattcgaagtttttcgtcgggtcgttattttagaagagaagatagtgagcgtgggcgaggcgaggtatttagaggtttcggcgatttttgttttttagtttttcgttttttcgcgtcgcggttttgggcgggcgtcgcgagtcgggtaagcggcgtttgagtttcggtttagaggtcgaggcgcgttttcgcgttttgcgcgcgcgtcggcggggaaggtgcgcgggcgttttgggttcggcgtttgggggtgggggtgggggcggggatgggggtgggggtgggggtgggggtaggggtggcggcgggtcgtggggcggtggggcggtgcgtttgttttatttcgcgcggttcggcgtttcgcggaagtcgttgttgtggtttttttaaaaggatggggtttagaagttttttttgttattcgtaagtttttattttttttagtttcgcggtggataattttagattttttagtattttcgttattttttttttttgttttcgttgattaagaggtttaaaagtttttttttttttttgatttagaggggtatagttttggtgtcggggggttgggggtggggtgttagtttgggggttcggagcgtagattaggtttttagggcgcgggagtttgttgtttttttttgtaggggtcgttttcggacgttttattcgtcgttacgtggtttcgggatgtgcgggttgcggtagagagtgggtagtaatgtttttggttttgcgttttcgttttagtcgcggggatttcgaggcgagtcgttaattggtatcggtgtttcgttttttatttttggtatcggcgtttttttaatcgtcgttttcgttggtgggagtacgttggttttgttttttttttagtttttttatttttcgcgttgatgggcgtttttgtttgcgatttggtagttttaggatgtcggatgttattagggaagcgatgtttgggagacgttttgtgttttgcggagttgcgcgtttgttgggtggtgatggtgtatatttttgtttgcgttttttgtagaggtataaaggttgggttatttttgtttgtagttatatggaaattaagcggagattgcgggggaggagaagtggttaggcgtcggcgggaggtagaggtcgtttcgtagttattgggggcgagtgggggtttttggagatttttattgcgcggtgcggtttttgaggtgtttcgtttgggaagatttcgg

SEQ ID NO: 7290 - DNA, 828 bp, synthetic construct
  misc_feature 1..828: note = Description of Artificial Sequence: Synthetic polynucleotide
  source 1..828: mol_type = other DNA
cggaggttacgagttattagttcggacggtgaaatttattttttttttgcgttttacgttcggatgggagaattttagttttttacggcgtatcggggaataattttagagtagtacgcgagtagagtttttagcgtttttacgtttacgtttacgattttttttttaatcgcgcggtataaggaggtatttacgcggagttaatttgatagttttcgtcggggtggaaattcgcggttttttcgtatcggtatttcggatataggtttcgcgtaggcgcgtagtttcggatttcgtttttgtttttgtttttgtttttattttttttgggtattatcggatagtgttttgattcgtagtttaatcgtcggggtgtcgattcgcggggatttatttttttgttttttttttcgcggcggcggcggcgttagttcgttttcgattcgagcgtggcgttttcgcgttggtcgttcggttcgggaaattgttaaattggtcgttattatttacgcgtttgtcggggaagggttcgtcggcgtcgcgttttcgaggtttttgcggcgaatcgcgttacgcgcgatttttggtcgggggcgggaggcggcggcggcggtaggagaagtttaaggttcgagcggttcgtagtttttacgtttgtatttttttattttcgttagttcgatggttcgtttcgcggcgtgtattggagtaagtaggtttcgtttcgagcgcgcgcgttttgggaagtgttgtaagtttggagatttggagtgagtttcgggcgttgttggttcgattgttcgcggtgttttttcggtgaggtcgcgg

SEQ ID NO: 7291 - DNA, 2705 bp, synthetic construct
  misc_feature 1..2705: note = Description of Artificial Sequence: Synthetic polynucleotide
  source 1..2705: mol_type = other DNA
cggggttgttcgtttatttaaatatttttcgttttagtaaaggttgagattcgttagttttgttcggtttgattagggcgtttttttttcgtcgggtggtttgggcggtttcgggttcggcgttttttatttcgttggtttttttacgttcgtcgggttttttaggagtgtattagtatcgagtgtaaggagtcgtttttgttttcggtcgaggtaggggttgtgggttttagtagagaggtaacgggcgaggtcgcggtcgcggagtatacggtggatggcgtcggaggttgttgcgaagtcgcggggatagtgagtttcggttgtagcgcggatacgggcggtagcgtaggcgtgggtttgatgggtatcggtatggtaggtaggttttggtttgtcgagtggtatagggatttgatcgggatttcgaaggttttatatttcgggtttatagggatttcggttgcggttgcggcggtcgcggcggcggttatcgaatttatgacgttaacgtgcggttatacggagttgacgacgttgttaagttggtcgggtacggggtagtttaggtggtgtatgacggacgttaagggtagttttttagtttgtagtacgtttttgtagtttcggttaataatgtttttaatggtaaaggggtgtttgaagtttgacgtggacgttgcggtcgcggcggtagcggcggcggtcgagtttagttcgtagggtgggaattgagataggcgttttacgttgtttatcgcggttgtcgcggtcgtcgtcgtcgtcgtcgttacggtcgtcgttttttgtattttgtcggggtgagacggttgttgaggttgcgattgttggggcggttgttgcgggggttgtgacgggaggtgcggaggcggttgcggagtagtaggcggttgttgatggaaatagtgtattatgtgcggcggcggcgggggcggcggcggcggcggttggggtgggtggtggtgatggtggtggtgtgcggtagcgtggtgatgatggtggtggtgggggtggtggtggtgatgggggtgaaggtgttttttcggatcggcgttcggcgcgtttttggtgtttttcgcgtgtaagtgagtatggtcggcgcgtagtattttgaagcgtttgcgacgtcgtaggaagttgtcgttttcgaatatgttttcgtagtcggggtgtagcgtttagaagttatttttgttaggttggtcgggttttcgcggaattttgatgaagtagtcgttgaaggagaggttgtggcgtaggttgttttgttagcgttgtgtgtgttcgcggtagtaggggaagcgttttatgatgaatttgtagatgtcgtttagcggtagtattttttcggtcgagtgttggattgttatggcggttagcgagatgtaagagtagggcggtttttggtcgttgtacgagttttttttcggtcgcggtatcgttttcggtttttttatcgtttttcggttcgtattggattatagaattttttcgtatttcgtttttggggtttggttgtttttattaatttttattcggtttttttagtttcgttattttgttttttcgttttttaggttttttttgttttttttttttgtttttttcgaattgtttggtgttttcgattttggtttttcgggtttatttagttttcggaagttggtaatttttggtttcgacggttgtcgattggcgcgtatagtcgcgggcggagtgtattaggtttatcgtcgttttttttgcgttttttttcgggtggttaaagattgagtgttggagttggttgtagaggagagtggtaaggggtcgtgttttttttcggtttttttgttttttttaggttcgagggaaatttagattaagatggttgggaggaaggtttgggtagtagagattttggttttttaaatttgagtttgcgtttgttgttttggaggttagtgatagtaggatttttagtgttttggacgtaggtttttggttaggtatttagttagatcgcgttggagtttttttttttttggagtgaaaaattagggtaaggagagagaagattggtttttagggcgtttttttttttttcgaggttcgtagcgtcgtcggggttagaagagacgcgtagttttaggttgtcgttgaggagaaaaaattttggtggtttttgaagcggtagcgttcgtaggttttgttgaggagtgtggggcgtaggattttgggagcgagcggcgggttggagagggcgtttgcgaatgttgggtgagtgttggtcggggaggtttagtcgttcgcgtcgtagttgtcgtttttttttcgggtttgttttgaggaggagaggcgacggtagtggtagcgacgcgtttttttggttgcgttttgtaatggttttcgagacgtcgagattttcgtagttagcgtttcgagattattatatgatcgaggttgagggatttagtcgtcgtcgtcgcgtttgtagttgaagaaggggtaagaaggcgtcgtgtttcgttttcgtttttttttttatttcgtttcgggcgttttttatttatcgcgtttattattcgttcggtagtttttagttatttttcggtgcggcgggtggcgtaggttgttcgtcgggagggggtatagtttcgggtgtatttttcgtagttgcgttttattcgggttattaagtacgg

SEQ ID NO: 7292 - DNA, 704 bp, synthetic construct
  misc_feature 1..704: note = Description of Artificial Sequence: Synthetic polynucleotide
  source 1..704: mol_type = other DNA
cggtaggggtcgtggaagggtagcgttagttaggcgttatgtagttcgcgtatgaagtttagtattttttgggagttgtcgtcggttgatacgaagattatttcgaagggcgcgggtcgtcgcgtttcggttattagcgtcgtatagaagtcgtagagtagcggcgtgaagtcgcggttcggcgcgtatcgggtcgtcgcgaagtatagtgttattattttgttttgtagcgtcgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcgtttttgttcgtattatcgggcgttggattttttaagatttgttttagatgcgtttatattttggttaggtttcgtttgtggttggagtaattgtgttcgcgtcgataatgagatatttagatattagagattttagatatttgggcgatagcgcggtattcgtttttgggagcggggttagttaggtaattttaagtttttaggtttttgtatttttttttaattgcgtttcgtttatatttttgcgtttttttattattgcgtttcgtttatatttttcgtaagttttttaattgcgtttcgtttatatttcgt

SEQ ID NO: 7293 - DNA, 950 bp, synthetic construct
  misc_feature 1..950: note = Description of Artificial Sequence: Synthetic polynucleotide
  source 1..950: mol_type = other DNA
cgtgtaattttaagtagcggtttttcgggtcggggttgcgcggtcgtcgttgtgttggtttttaacggtgggagggtattatttttttgttttgttttcgttttttagaaggttgtttcggggtttttatttttcgtttcgtttcggggatagtggttcgtttgttatgcgcggtagttcgcgtcggggtcggtattagtagcgttcgggcggatgtagcgagtttacggaggggtatgtttttacgtattaagtataatcgttttaggaatgattcggtgatatcggtcgatgattttttttatagtttgtcggtgagcggcggcggaggtaaggtttcggcggcgcgcgcgatttcggcggcggttttttatttggtgttcggcgaggcgttgcgtaaggcgttcgacgatgggttcggtagtttgggttatttgttttataaggtgttttatttgaaattttttagttcgggttttcgcggtttgtcgtcggtcgttcgggagcgggcgggcgcgcggttttcgggtagttgtagcgcgtttagtttggtcgtttcggacggtagtgcgttttcggcgtttcgcgtttcggttatgagcgtcgttaggaagggtcggttcggcgacgagtcgttgtttaggttttttcggggggcgtcgtacgttagcgattaggtgttggggttcggagttatttacgtggttaaggtgggtgcgggcgcgggtcgttttgggggttgggggttttggggttagttcggggtagatttttttattttttgaagttcggggtgcggggcgttttcgcgattgttacgttagaggtaagtaaatgcgtattttttagtaattagttcgtttgatagcggtgaggagggaattataaatgcgtttttttcgtatttattgggaaaaggtttattattcgggtggttcgtttcgtttcgg

SEQ ID NO: 7294 - DNA, 4861 bp, synthetic construct
  misc_feature 1..4861: note = Description of Artificial Sequence: Synthetic polynucleotide
  source 1..4861: mol_type = other DNA
cgcggtttttgtttttttttttttcgattttttcggggttatttaaaagtcgattaagtcgtcggttttttagttgtttttatttttttatcgttttttttttttgtttcgtttgtttttgtgtttttcgttacgttatagttcgttggtttttacgttttttttggtttttttgcgtatatttcggtggcgtttttggtgtttttatattattgtttggaattttgtttggtttacgtcgtttgtttttgtttttttttttatttgtgtcgtttgattttttcgattttcgtttttgggggttttgtttttcgaatttttcggttttttttttttagggcgtgcgtttcgtttagtttttttcggtttcggtcggtcggttttttttacgtggtttttttttttttggtttttttttcgttttttttttttttgggttttttttttcggtttagtttaggggttgggggtggcggcgcggggcggggcggggcggggcggtgacgcggggttggtcgggtaagaggcgcggcggcgtggggagggggcgtagtttcgggttcgatcggtcgagtttcgcgcgtttcgttcgcgttttgcgttttcgttcggtcggtcggcgggggagggggtatgagtcggcgttcgcgcgtcgtttcgagttgcgggtcggtttagagtttcgcgcgggtttcgcgtcggagttaagtcgtcgtcgtcgtcgtcgttaaatcgcgggcgtagtagtgggcgtcgcgatgtagcggtcgggggagtcgggcgtcgcgcgtttcggttcgttcgagggttgcgcggattatcggtcgtatcgttatcgtagttttatgattgaggagatttttacggagttattcgggtttaagggcgtcgcgttcgtagtcgtcgttgtcgcggcgggcgagttgttgaagttcggcgtgtaggcgttgttggcggcgcggtttttttatagttatttgggtacgtgtggcggtcgcggggtcgcgggtcgggtttggcgggagatagcgagttgaatcgcgggggcgtttcgagtttttttcggtatcgaagtagtttcgggaagttgttttgggagcgtaggttttgggatcgtttttcggagttttttaggcgggaggcggagggtgtaagttttaggttttatagaaattaggtttcgtgttcgcgggtcgttcggggagggtgttcgtttttttttttattgttttttttcggtttttagttcggggatttcgagtgagtatttttagtgtaggcgtattgttaggttacggattttcgtgggtggaagcgattttaggttacgggcgtttgggtttcgtcgtagagggatggtcgggagtggtcgcggttgtttaatttagggaagtcggatttttggggaggaggtttgcgttttcgagggttgggtgttgacgcgggtttaagtcggttcggagttttcgggagttttagcgggcgaggaacgcggttttggtcgtagtgcggatttgtttcggttttgttttggggttagaggtttgattgtgagtagttgtttggttgttttttttggttttaggtcggttgggtttttgtagggtttgaacggtttgcgtagatttttttagtttttgtttttttttttaatttggcggggtttgttttgttttgatggtgttgtttttatcgtattttattttcgttttgtttttttttatttcgttttttaatcgtttgtcggtcggtttttttcgttttttttattggggtcggtttgttttttattttttattttttttttacgggttttttgttttatatttatttgcgttttgttttgtttttttcgattttagttaggttaggattcgtattttagtgataggtttgtcggggaagggaggtttttacgttgtagtcgggattttagttttttaagtcgttttttttgtatttttttattttttagtcggtgttttttagtttggagacggtagggttagcgcgttttttttaagtttagttgggattcggttattcggttatttttcgtttttatttgttttgttgttattaattcgtttgaagcgggtatataattattttaggattgaagaaaatggaaatatttgtatggggaagcgtttgaaaatagaaaacgtgaataataatttttaggtttttagggtattttggaattttcgggaagtatttaatttcggtttagatgatttttggttatcgtatggttgttgtgttacgtacggaagagtaaatgtgtacgtttcgtgtatgttttttttttaacgtagtaaggttgatttggttggagtaaacgttatttttttaggattagttgtcgttttttttttggtttttatttttttcgaaagataagatatatttcgagtttttcgtagttgtaaatatgtttattaggaatttcgagattttagaggtagttgaggtttggggaattttaggatagaatacggatagggtcgaggagatatttttttttaaatttggggaacggtaacgttgaggagggtttttatttgcgttatcggcgtcgatcggtagggcgtggaggttttgcgttgggaggtattggttaagcgcgagtattttcgcggtacgtggtgcggtagtttttggggtagaggagcgcggtcgtagtttattcgggtttttatttttttttttcgtagtcgtgttgaaggtcgagtaggcggcggtgtttaagtttttattggcgtcgttgggttgtttagggttgagttttgcgttgttggcggtagggttcgggttgttcggcgtcgcgggtgcgttatatttgtcgttcgagttgtagtttcgcgggaagttggaggcggtaggttttggggagttaggtattaaagttaagaaggggcgtcggagtcgtattgtgtttatcgagttgtagttgatgggtttggagaaacgtttcgagaagtagaagtatttttttacgtcggataggtagggcggtataaggttggggttagcgggttgtgggagtgtggttatttgttttgttgagggtgcgttttgttttttttagaatagattttgttgagtttttgggtttgagttagttgtaggtgaagacgtggtattagaatcggaggatgaagtggaagaaaatagtgagtgtgtttggtggttttttattttttagttttttgggttatgtttcggtgtatgtagagttgtttttttttttttttttattgagattttgtttaatttttcgattttttcggtgtttggtacgtatcggaatttttttagttttttttgttttttgggtaagttaatatttcgttttttttcgcggtatttttaggttttttggtagttttatgttttttaggtcgggtcgttttttaggcggtatttggataaatggtcgttatttttcgggatatttttttattatttttttatatggattttgtattttttagttttatttgggtttaagttttttcgggggtttttagtttacgtgttggtttatttaggtgttggcggtttttcgtgtaggtgttgtagggcggcggtttggagttttttattaagtttaaggggcggtttaagaagaatttaattttaacgagcgagtagtttattgagtaggagcgcgttaaggatgtagagaaatcggcggaggtgtcgggcgagtttagcgataggagtcgcgaggattgagggcggtatacggtgcggggtttgggatgttcgcgttattcgtagtttttttattcggcggaaattcgcgagtcggttttttcgcgtttaagaagtttattttttaagtttttttattatgattttgaatgcggataattggggttaaacgaggaaggatatagatttaaaagttagatttaggttttagcgcgtttttgggttttaatttgggagattcgtatttagttcggcggaagttatagtttttattttgagtttcgtggcgtagagcgttttacgcgtatttacgtttcgtttttcgtttgtatttttatttcgtttggggtttgttttttcggtcggggagtttttaggtatatattcgtttttggacgtcggggatttagcggttgggtttaggttataacggtttgagattgtttcggggtaattcgtcggttcggtttggaggtcgggttttcgatgtcgttggggtttttatttttttttgcgaagacggtgattttttttttaataaaatattttatgatataatcgggttcggtggagtagtttttgaattcgtagggggtgagggtgggggtgggggtgggttcggtaagataagcggaacgcgggtagttgttttttaaattttttttttttcggttttgtcgaaggtagttgtgttttttattattaagttcgggttaggtacggcgggcggttcggtggttgtaggattttaggaatcgtttttattttgggcgtgaggggttagtttgaattttatttttttttttttgttagttagagagtcgttggtaggagcggtttggtcgtatcgcgggtgtttaaaggagcgggagttagaggttcgtcgtagagttcgtttcggaagtggttcggatagagagtcgtttcggttgttgtttcggttttttgggatttgaaggattagttcgtgcggtttttgagatggtttttattaattttttatgaggcggatgggaagtcgaggacgtaaggtttggatagagtttttttattagcgcggtagttcgttcgcgggtttttgtagtagtaatggttttttagagtttttatatttttcgtaggatatttagggcggcggcgt

SEQ ID NO: 7295 - DNA, 999 bp, synthetic construct
  misc_feature 1..999: note = Description of Artificial Sequence: Synthetic polynucleotide
  source 1..999: mol_type = other DNA
cgttgggagtcggggcgcgtttttgtttttcgcgttaggagaattattttcgttttcggagggagttcgttttcgtgagggtcgtttttagtttcggttcgtcgtttgaagatagtagtttcgggaatcgcgacgatagtatcgaattggagattaggaagttttggtggaaaaggttaaggagtggtgtgtacgcggagttcgggattcgggcggggatagagcgggagcgcgggcgtagttcgttagcgtcggcggtagagttttagttagaggttgcgaggggtttaataggtcgttaaaggtgtttttggttagagatgttatagcgcgtatttaggtaggaggtataggggattttttataggggttgcgggagttggcgttttttcgttttaggtcgggagttgagaggggttttagcgtttaggtcgattgcgttttgatcgggagttattgcgtttagcgtagttcgagggcgttgagttcggaggatgcggcgcggggcgggggtttcgggagtaatagagattgggattcgagggttcggttcgcgttgttgtttacgtagcgtttttattttggaaagagtgtttttcgcgcggcgggtcggtttttttagcgcgtatttggggttgtttttgtagggttattttcgtttttagggaggtttacgttcgtcggcgaggaaggatggtgagttttggtttagcgggaaggttggaggaacgtaggttcggaggaaaaagttttttagatttgggttattaacgaaggtttttatagggattattaggatcgggacgtcgtgggtagaggcgttatgttttttgcgttatttttttggggatcgcgcgttagttcgtggtgtagggtcgagttttggggttgtgagcgcgcgtttcgttttcgtgcgttggtggaaagcggggtgttcgtgcgtgcgtttgcgagcgtgtgtcggttgtaatcgtagggagcgtaaataggtcgttacgt

SEQ ID NO: 7296 - DNA, 1750 bp, synthetic construct
  misc_feature 1..1750: note = Description of Artificial Sequence: Synthetic polynucleotide
  source 1..1750: mol_type = other DNA
cgcgtacgtattttagaggttatttagattatgtttcgtcgtttgggcgtttaagttgtagtcgttttttgtgtgtaggtagtagttgtttggtaattttcgagttcgttcgcgtttttagtatcgtagaattagggttaggtgttttagtggttgtagttaagttaggtattttgtttagcggcggttgtataggagtagaatcgagaattcgtcgtttaattttatacggggtgattgtcgagtgtttatgttagcggttttaattttttttaggtggaggagtgggcgggaggtacgatttgggggtttttaggttgggcgcgttggcgatttcgaggtcgattaggttatgtatttttagttcgtttgggtatttaagttgtagtcgttttttgtgtgtaggtagtagtttttaggtaattttcgagttcgttcgtattttttatattttagaattagggttagatgtttttgtggttgcggttaagttaggcggtttgttttgtagtagttgtataggggcgggaatcggtttttagttttattttcggtggttgtagagggtttttggttagaggtttcgagttttggtagaggaggagtcgggtgggggtagggtttggcgggtttttaggttaggggtattcgcgatttagaggtcgtttaggttatgttttattatttgggcgtttagttataggcgttaggtaatttttaagttggttggcgcgtttagtttcgtagaatcggggttagatgtcgttgtggttgcggttaagttaggcggtttgttcgcggcggttgtatcggggtaggaatcgatttttagttttattttcggtggttgcggagagtttttgttagcggttttattttttttcggaggaggagaggagcgggagttacggttaggcgggtttttaggcgggaagggatgcgcgtttgcgatttcgggatgttttgcgcgagtttaggagaattcgtaagttagcggcgtttgcgttcgagttgtagtcgttttttgtcgtttacgcgagttcgagagcggttttcggagttcgggttagcgtcgagttgtaggcgcgcgtttaatcgttttgttgggtttacgcggtttgagaggtcggagcgtttaattgttggtacgcgagtaacggtttagttaagtttattcggtttgagaggtcggaggttgcgagtgtcgttgttgaaggttgtggtggatcgggttggatcgcggattttgagttatatcgcggggttgggggtggattttgggtttgggggtggattgttggtttggtggtggattttggatttaggggtggatagcggggtggggagggggatcgcggatttggaatttggtcggggtggaaaggttacgaggagtcgcggcggtttagtagcgggtggttggcgtttgagaagtcgttattatgaggaaattttttagtttcgggagacgtttgggttaggcgtttttgagttttatggattaagagtacgcgggtcgggggtattatatcggggattgggaattgcggaagatttatagggtggttattaagggcgacgtcgcggaggtggagcgttgtttgattcgtaggtttcgggatttggatgttcgcgatagaaaggataggtagcgggggtttagttcgcggtgggagggggtttttaggttttgtttgttcgtagcgtttgaggcgggggttttggaggtcgtcgggttttggagtcgcga

SEQ ID NO: 7297 - DNA, 391 bp, synthetic construct
  misc_feature 1..391: note = Description of Artificial Sequence: Synthetic polynucleotide
  source 1..391: mol_type = other DNA
cggtgttggagcgaggatgcgtagatcgaggtagggaggcgggggtgcgggaggtttcgcggttgcgcgggcgcgtgttggtggtttcggcggaggtttagtttcggttcgcgttcgcggcgttttcgttgcggttcgagcggtttggttgcgggatttgtgcgtacggatggcgcggtcgtttcggtagtattcgggggtttgggcgtcgttgtttttgttgttattgacggggttcgtcgtttgcgtagttagtttcgcggacgacggtgcgggttcggggggtcggggatttcggggacgcgcgcggggggatacgggcgtcgacgaggcggtgtcgcgttacgattttttttacggtattttcgcgggggagttttacgatttgcgt

SEQ ID NO: 7298 - DNA, 817 bp, synthetic construct
  misc_feature 1..817: note = Description of Artificial Sequence: Synthetic polynucleotide
  source 1..817: mol_type = other DNA
cgcgcgtcgtttttttcggagttttcgagttgttgaggagtttggattgtgtttgtttttagtgttagatgaaagggcgttgaggtttttggtcgttgtttcgcgtttagtttcgcgtacgtttttttgcgagttcggtcgtttagcgttttttttcgttcgagtcgtcgtttgcgtttcggggtagtcgttttgtttttagcgcgatgtggtttcgtttggttttttgttgttggggtttggcgttcgtttcgggttgggcgattttttagtagatgttttcgtcgcgtaattttagttttcgtttttttttcgagatcgcgttcggggttttcgggagtattttcgcgtcgttcgtttttggcgacgaagcggcggggagtagagtggagcggttgggttaggcgtttcggcgacgcgtgcggttgttgcgggagtttagcgagcgtttggagtttgtttttttggtggatgattcgtttagcgtgggcgaagttaattttcgtagcgagtttatgttcgttcgtaagttgttgttcgattttttcgtggtgtttacggttacgcgcgtggttatcgtgattttttcgtttaagaattacgtggtgtcgcgcgtcgattatatttttattcgtcgcgcgcgttagtataagtgcgcgttgtttttttaagagatttttgttattttttatcgaggtggcggtatttatattaagggcgttttttagtaagtcgcggtaaggcgttcgtttttttcgattcgggttttagttttcgggtttttcgatttatcgttgtttgttcgtttttatttcgg

SEQ ID NO: 7299 - DNA, 814 bp, synthetic construct
  misc_feature 1..814: note = Description of Artificial Sequence: Synthetic polynucleotide
  source 1..814: mol_type = other DNA
cggagtacgggttacgtgttttaggtttcgggaattagtttttattggtcgagggttcgcggggtcgttaggagggttttttaggttttttttagggatggagtagttacgtttttcgagtgtgtttattttatcgatggagtaaagtgaggtttttagttcgttcggatgtttttgcgtcgttcgcggggtagttttcgtatagatacgttcgtaagttttcgattcgttcgttattcgcgtttagatattcgcgagtttttggggtcgtagggacggtgtagcgttcgtcgaggcgtttttatttatttgtgattattgtcggagatttttggttttttttcgttcgtagttatatttgtagcgtgaacgcgtttcggggtagttcgaggtcggttcggaggcgtagttgttcgtttcgttcgttgaaatagagcgttcggttcggcgggttcggtttttcggtggcgtttttcgtttttcgttgttgtcgtcgtcgggggacgcgtacggttttttaggtatcgttcggcggcggcggcggcggcggcgaggcgcggcggtcgcgggtcgttcgggtggcgtaggtggtcgggtcggcggcggggcgcgggggtcggtcggttcgcgggttttttcgggttcggcggggacgttcggttagttcgtagtttagcgcggcgtttagtagttttaggtgtagtatttaattttagagtcgtatgttcgacggtttttttcgtttttttttcgtttttgtatcgttattcggagttgttagttttgggagtttcggcgtttcgatttttttcgt

SEQ ID NO: 7300 - DNA, 1429 bp, synthetic construct
  misc_feature 1..1429: note = Description of Artificial Sequence: Synthetic polynucleotide
  source 1..1429: mol_type = other DNA
cgcgagggaaggattattaaatttaaagacgcgcgtgttcgtgtgtttatatagacgtgtgtttcggcgtttgtatacggtcggcgcgtaggtatgcggacgtttatacgaatatataggtatgttttattgacgtatttggggtatttttttttaaagaaagtaaggaatgaaaatttaatttgagagttattagggtttatttggaggtcgtttaaggggtagaaaaaatttgtaatgacgttagagtgtttgtttttggtgtaattttattttcgggagggttggatataatacgtttggaaagttcgaggggttgttttaggatttgggggcggggggtggggtatttagtaatttttgtcgcgggttgtttaagaaacgtggaaatatattttgcgattttttatttttttatatatataggtacgcgatttcgtcgttatttttcggattagtagtttacgtttaacgttgggtcgattttagatatataggtagtcgggattttcgttcggtgcgtttgtttatttatttttttgcgttaggttgggacgcgtttcgtttgtaaaaggtttaaacgtatttttcgtcgcggggcgggatttaggggtttaggtttcggggtttagaggcgggtaattttgttaattttttttagcggcggggaacgtcgcgtaatcgttgagttttgttcgtcgagattaaataagtagaggaataggttgtaaatatatattttgatacgtgagtgatatttacgcggtgcgagaagttgtagttaagggaaaggtaaggggtggggggagcgggtatcgataggtacggaattttcgtaggcgtcggaaacggcggtttttcgattttttttttttttagaaagtggtaacgaatgtttaagtttttcgaatttgttttttgtgggaggtgataggtgaacggaatttaggtttggttattttcgtcgttgtttatttttttattatttgttttttcgtagataagtagattcggcgtataatgaggtagtagtttttagtcggttatcgtgattaatttagaataaaagcgttttttttacgttttttttaataaaggggttattagtttcggcgtttttcgaaggttgcggggttttcggttgtcggttgcggagttgtcgcgcgtaaatttttcggggttttcggggttgtcggcgttacggagtcggggtcgcggagggaggaagcgtaagtcgttcggagaaagtgaggttagattcggcgggggagaggggagggagtcgggcggtcgcggaaggagggtgattgattagtgcgcggtgttcggcgttttgtttcgttattagaggcggttaaagtagggttacgtaataattttagaatcgttaattaattgacgttgtaggtaattattttattgtgcgcgt

SEQ ID NO: 7301 - DNA, 7708 bp, synthetic construct
  misc_feature 1..7708: note = Description of Artificial Sequence: Synthetic polynucleotide
  source 1..7708: mol_type = other DNA
cggaggggaaagcgagtttcggaaataggcgtagtttgtggcgagggttcggtggtcgagttgaatttcggggtttcgggagattcggtttttgcgggggaggtttttttcgaagtcgttattggcgggggagtagagaaaaggggaaagaaggggagtggagaaaaagggaaaggagtcggttttaagtagcgaggtcgaggtcggttagaggtaagggtagggggcggcggcgggggaggtagtcgtggggtttaggtttggtcggcgtttcgaatttttttattttcgtttttagtgttcgggggcgggtcgagattttttaggatcggattcggggaggagcgaggggtcgaggggagggggaggattcgggttttttttttttttttttttttttttttttttaattaggtcgatttaatggagttaaagagttcgtaaaattatgaataatttattcgtgatttgttattaatttatcgggtttcgagtttttgtcgttgggattgaatttgtaattaaatttgatttcgttttattttattaaagacgagattgtaggtttaattgtttaaataatggattggaattaaattagtaattacgtcgttaggtatatatatataaaaagttggggttgggggaggtcgggcgttcggtcggttcgcgcgggattttcgcggtcgcggcgcgtaaatttaggcgtaaagtgcgcggttcgggtttttcgttcgtttttgtcgtcgttttcgtatttttagttcgttggtagtttttttcggggtagggggaggttttcgttttatcggggttcgggttcgaggggttgcgggaagaggtcgttgcggtttcgtttcggaaggatttttcgatttcgcggttcgcggttttgttgtaagtttagcgttcggcgtttcgacggcgttttttttttattcggtttttagttcgtcgttttttagtaaggtgtcgtcgcgtttcggagggattgtttttagagtaagaggttttgtaaggggtcgtcgtggttgggttataggatgtgggatattgttataaataagttcgtgttttcgtggtcggaattttgtacgtatacgtatacgattcgcgttcgtatatttcgttcgcgatcgtattttttagggttttcgttttttagttttagttgtttcgcggtttatattgcggttattttttttttgttagtgcgggaggggagggaagggcggacgttagatttaggaagattgggttgggtttcgagaggtcggggagatgttttttttttttaatttagtttcgggagtttcgaaagagttagtcgtatagttatcgtcggcgtatcgaacgtcgttttttttaggattaggagtttcggttaaggtcggagaggagggtacgggaataaatacgatatatatagagatagagatagagagaaaggacggagagaacggaaaggaaaaaaagagagagggaggttagagagaaagtgagatggttgaatggagggtgttttttgtagaggttaaataaggtttgaaatttagtttttagtttatttcgttggggtaaacggcggttgaatagtaaaaagtagaaataaatttttgtattttttattttttttttgtataattttaaaatcggcgtcgaattttcgtgtttaggaaaataatatagttttttagttattaggtgttttggagtcgagtttcgcgaggtgttttcgagtggaagttgatttatttgataaatagaagcggtttggtgttgggggagtcggtttgaattcggttttgtttttttttggggggtggtaggagaggagggatggaagttttagagagttatatttgtggtagtgtttttagtaaattttaaattcgcgttatcgatcggtttatcgttgttttattatttattaaattgggggttgcgttttttttttagtttcgtatatagggatatacgttttatgattttttaagcgatttcgttggagcgaatattcgttttttatttttttttttatttaatttagattttttaagatgaaaataattgattttttttcgtcgtagtattttttgtatagttttgggtttgtttttgtttttgtttttttttgtttgtgtattagattaaagggaaaaggaagaagaatataaaatttttaaatttaattttgttgtaaacgaaagaaagaaaataattgtatataaattttagttcggaagttcggagagttataaattttttcgggttttgtagatttcgggtagatgttgacggtttatttgtcggaatttagaatttttgtagttgttttgagtagggaggggcgcgggagggggtagagttttttcgggaatggtttggggtttaaagatgtcggaaattcgaattaagttttttattttattttattttattttattttggcgcgaggttaggtttgtttcggtttcgttttcgttcggggggttcgttttcgagggttacggtttttattttagtaggcgttaggaaattcggaggaaaaagttcgggaaaattgagatttgtttttaaaggaggatcgggtcgagtaaaaggaatcgtagtttttgtttttttgagttttttaagttcgagttttttaagtttgtcgtttttgggatattttacgaggttaggtcgtattttaggtcgagttcggcgtttcgggttatagttagtttttttttttgggattttcgtcgttttgtttcgttttttcgttgttttagttttcggtttttagtcgcgttaatttaaaatttgtttggcgttagcgtcgttttgttttttttatttttgttattttttgtttagtaaagtggggtaaaggtttaaattaaaaagttatttttaaaaaaataatttattagagataaggttttgtattcggagtagtaagggattattgtatttttttttttcgttttagtcgaggacgtatagtttggaagtttagggggttaatgttttttttgcgaggtcgttcggtgtttaaggttcgttatttgtttagtatatagagatttaatttagttttcggtcgtcgaggtcgtatatttttttttaattttatgggggcgtttcgtgcgtcgcgtatttattagcgttgtaggtcgttagattcgtatcggggttcgggtttttacgttttttcggtcgttttttttgtatagtgtttacgttattgtagtagggaagatttagagggttggtttttgttgcgtttagtttcgcgtttttggtcgtcgcggttgtagcggtcgtcgttgttacgtcggtatggttgaagtgtgcggggtattcgttttgtagtagcgtttcgaagtgtaagcggtagtagattaggttgttttttatgtcgaagtggtcgttcgtggttagtattttgttatacgtggtgtacgtgaagtagttgaggtgataaattaagtttcgagcgcgtattattattttcgaggtcgagatgtttaggtggtagcgggcgtagcgttgtatagagaagcgtttgtagggattatggagggaggggttgtgggaatatacggttgggtattttttttttttttttttaggtgtcgttgttgttgcggggggtaattttttttttaagacgaataattcggtttttatttggaggatgggggggagagagaattagattttgatttaggtttggttttgttttaaaatagttttttttaatatatttatgtttatagagatttttattttatttagagttttcgtaagttttaggaaagtttttatttgggagtggagggagatatttattatttattttttttttaatttttatttttttttttaaattagcgtttgggaattttattgatttttataatttggaagaaatatagagatagggaaagagagagagatatagacgtagagatagagatagagagaatatatatagattttaattttaaaattggggagaaggagaaatagagaatttggagtttattagtgattttggttttttgattttggttattttttatttttatttttttaaaagatttggaaatgtatttatttttatagttttttttttagttgtgttttattttagtttgggttgtttaggtttgggggtgtttgtttttataatttcggattaatttaagaaattttaaagagagaggggagtaaggattttaatttaagtttttttgtggtttaagtttcgagtaggagggtagtttttgttttttttttggtttttttatttcgtagatttttttaagagttttttaaattgttgttttaaaaggttattatttaatttgtggtggtttggagaatttggggggggagcgggggagttttgagtagtgaatttttttttgggattaaacggaaaggagagggttaaattgtaagattgtgtttgagattggggggaggggttttgaggggtagttgggtgggggggttatttgtagtagttttttttgtagtagatgttatcgtttttgttgaaataggtgagtttcgattttaggttgagtttgtattcgtagtatttgaggtagcgtatgtgttattgtttgtttatcgttagtaggtagtagcggttcgagattttgttttcgtagtcggcgtatagcgcggcgcggttattgttgatggacggtatggtttgcgaagggagggaggcggaagatagtagcgtttgcgttagttagcggttttttcgtcgtcgggaaatcggtatttataattttttttgtggttttggttattttgaacgcggagggggttgttaggatatgcggcgcgtttttttttattttaaaaggtttatttttatttttgggcggtttagaatttaggtttgtttgcgtagttttcgttagttacgggtttaggtcgggtttttggtttaaatggttttggtgtttattttttttttttttagttttttttgtttttttttttaaaatgttcgggttgtgtttagggattaggatagttattttagttaagttttttaagagttttttttaaattgttttttaaatgagttattcgggggataaggtgattattaagttattttttatatagaattttttttggagagatagcggagtttttgggttttagttttagtgatttttggatttttagattagaggttaaggttaggataagttagttaatttttggtttttttgttatacgggttggggtttttttgggttcggggatgaggtaagtggggtgtagggatatttttaaagttcgtgggtgaaggataggtttaatttaaatatttttttatttaaattgattagtagagaaggtttaatcgaagaagcgtttagaggtcgggaggatattggcgtcgttgtttttgttttcggagtagagaagtttttttcgtgttttttattttcgcggttttttaaaggttatttttgggttcgttggtcgggtagtgtttgttcgtttggtttttagggaggtttgaggcgaggaattggttatttggggttgggttcgcggagttaggtgtagagatttaaatggagtttttttcggcgagggttaggtcggagtttgaatttttagttttggtttggttaagtttgattagttaagggtttggggacgcgattaacgataaatgttggtttcgaagatttcggtttttgaaattgcgttgggggttgaggaggattttcgattgtcggaaagttgggagcggtttaagtcggttggagttttaatgtttttagttggttcgtttttttttggcgtcgttcgcggcgtcgttagtaatcggagtcgagaggtggaggagagcgcggggttgtcgatttcggtatcgggtaaggtgagaagggagtcgtttcgggtcgcggatgggatttcgtttttagttcggaagaaacgtttttttttatttttagggtcgagatttcggttttaattttgttttttttttgcgttttagtagtcgggtttttttcgaatcgggagttatcggttttgtattttgatcgaggatttttagtatttagtttcgtgcggtacgaaggacgttttttaaatttcggggagtagaggcgttgattggttcggttttattttagtttttagtttcgattttatagtcgcgcgtttatcgtttcggtgtcgtcgcggtcgatggcggagttgatggcgggagtttcgtttttggttttgcggtttatttcgtcgatgatttcgtgtatttcggggttcgatagattgtggaatagtatcgcggcgggatcggcggggtcgggggcgcggttttttcgagggagggtttgtttttcgttttagttgtttggcgtttttggcgttaacgggttcggtgtatcgttatcgcggtttcggtttcgttcgagttcggttgagtttttaggtcgggtttcgggtttcgggcgttcgcggggtaggacgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcgttcgttcggttttagcgttcggggcgtaaagtaagggcgtaaattttgttcgaggcggcgacggttgcggtcggggtttattttgaagtcgttaggtgttcgcggcggtttagttgtttggattttttttttttttggggtgcgtttttagtttaaggcgatttttttgggcgttgagtcggcgattggagtaggggttttttcgaagtttgcgagtcgagtcgagttatcgggagaattgaagaggaggaggaagaggaggaggaggaggcggaggaggaggtggaggaggagaaaaaagaggaggagtagagtgggaggaggagtcgtcggtcgcgggtttagtcgcgcgtaatgttttttaagcgcgcgtttagtttagtttcggttttgtagttcgcgttagcgtaagttttcgcgttttttttatagtcgcgtttgatattacgttttgtcgtcgtgttattggtcgttcggcgttttaggttttggtagcgcgtgtttcgggaaggcgggagatttaagagggaggggagaggtaagaggagtagaggagagtcgagatggtgggagttggtgggcgaggttggagggcgggggtgggggggaggtagggaggagggagagcgcggggtttggagtttttaagatacgaatagttttttgcgatatttttagaaaggaaaattaaattttttattttaagaaggcgtagtaaggggatgttcgttttattgcggttttttttcggtttggagtcgcggttttaggtattcgtttgggaggttcgggaaggtaggtttgtggtagagttgtaagagttttcggtcggtcgttttttatcgagtttcgttttcggttcgggttttgtatagcgggttgtaggcggtcgtgtaagttttttgggtattcggtagagtttgagtggcgagatcggcgagagttgtgattttcggggaggggggttagttagtatatttacgttttaagttcgttagggtttaatttgtagtttagcgtgtagtttttcgtttttttcgg

SEQ ID NO: 7302 - DNA, 3969 bp, synthetic construct
  misc_feature 1..3969: note = Description of Artificial Sequence: Synthetic polynucleotide
  source 1..3969: mol_type = other DNA
cgttttttttgcgagtcgcgcgcgtttgcgatgcgtaggttgttttggatttttcggggattggggggatttttttgggaagttaagggggatattttaagtgtgttttgtaaatcgtattttttgatgtgaaaatcggtatgcgcggtgcggtcgtacggggagagcgcgtgtttgggggtggggggtatcgtttaggaaagcggagttatttcgggcggaaagcgattttcgtagaaagcgtcgcgcgggcgtcgttgcgtgttcgtcgtttatagtcgtagttaaagagacgtaggcggttttacgcggtttggtttatcgtcgtttgtagtgttcgcggcgcggggcgtttcgaggttgggtttatcgtttttttcgcgtttttgaagatttttcgggttttttcgaaggagtattgtttttttttgtattttttttttagggagttcggtcgtagtttttttaggaacgcgttggcgcgtcggcgtcggtgtaggacgtcgtgggtttttttttgggttacgaagattgggaaatgcgagtttcgtgaagcgtttatcgcgtgtttcgtttagtgtttcggagatcgttttacggtttacgcggcgggggtatcgtaggttttcgttcgttttggaggaggggagcggcgttgttcgcgggtttggttgggtgttttttttgtcgtgttttcgggttagttattttcgtcgtttatttttttcggtttggtttttttgttttcgggggttgatttcgagggcgcgttcgggggtacgcgcggaagtcgggtcgaagggggttgcgggcgtcgtcgcgtaaacgtgaggttgcgggtcgatgtcggcgaggagaaggcggcgcggtttcgggtgtcgggtaattttttggggtttacgtgaatcgcgcgtggaaattcgtatagtcgttcgcggaaatttaaatttttcgtttttattcgtatcgcgttttcggcggttagattcgttttttttaggttttcgttttggttcgaggcgcggtttttgttcggttttttcgatagcgagtttcgggttttttcgttagtttttggcggttttgggtttttgtcgtttttttcgttttcgtttggggtttttttgtttttcgcgatttttgagagttttagatttcgcgcggatttttttggggtcggttttgagagtatagtttttcgtcgtagtttttggttttttcgtaatttcgacggttatttgtggataaataggatcgtcgttttgtttatgggaagacggggttggtgagggttagagacgtttagggcgaggtaatttcgtgcgtttagtttcgagtaggtcgttttttaggacgttttatagtcgaggggatcgttattcgggagcgtcgtgagttgtgggtattacgcggtggtggagagtgattttcgtttcggggcggtcgtgttgttcgaatttgttttagttcgcgaggggagacgggtttgggggtaggcgggagagggaggtttcgggaggaggcgagcggggttgagaggacgcgcgggaggggttttggagaggtcgtaggaggcgcgtttcggagggacgatttttgttgggaggacgaggttttaggtggacgttgtgggtcggtgggtaggagttcgagttttgtaggagcggtttaaattggttattgagcgcggaagaagggacggaaggtgagcgttattgggttacgtggggtcgagagaaaggttattgtttgttttttttaaaattagttttatacgtcgacgtttttagagaattggtttggtttggaaggaggttgaggatgtaggcggggatattaaagaatcgggtttaaggaggtgggaatttacggatttcgagtttttataggaggtgttttgggcggtaggagtgggaggggaggtttatgtttttgtagttttcgatatttacgttttcgggatatttacgattttcgggatatttatattttcgggatatttacgtttttcggatatttacgtttttgggatatttatatttttgggatatttacgttttcgggatatttatattttcgggatatttacgttttcgggatatttatattttcgggatattttcgttttcggaatatttatattttcgggatattttcgttttcggaatatttatattttcgggatatttattttttcgggatatttatattttcgggatatttacgttttcgggatatttatatttttgggatatttacgttttcgggatatttacgttttcgggatatttacgttttcgggatattttcgttttcggaatatttatattttcgggatattttcgttttcggaatatttatattttcgggatatttattttttcgggatatttatattttcgggatatttacgttttcgggatatttatatttttgggatatttatattttcgggatattttcgtttttggaatatttatattttcgggatatttacgattttcgggatatttatattttcgggatatttatatttttgggatattttcgtttttggaatatttatattttcgggatatttacgttttcgggatatttatatttttgggatattttcgttttcgggatatttatattttcgggatatttattttttcgggatatttatattttcgggatatttacgttttcgggatatttacgttttcgggatattttcgttttcgggatatttacgtttttgggatattttcgttttcggaatatttatattttcgggatatttattttttcgggatatttatattttcgggatatttatattttcgggatatttatattttcgggatatttatattttcgggatattttcgttttcggaatatttatattttcgggatattttcgttttcggaatatttatattttcgggatatttataattttcgggatatttacgttttcgggatatttatattttcgggatattttcgttttcggaatatttatattttcgggatattttcgttttcggaatatttatattttcgggatatttacgtttttgggatatttatattttcgggatattttcgttttcggaatatttatattttcgggatatttttattttcggaatatttatattttcgggatatttacgttttcgggatatttatattttcgggatattttcgttttcggaatatttatattttcgggatatttttattttcggaatatttatattttcgggatatttacgttttcgggatatttatattttcgggatatttacgtttttgggatatttatatttttgggatattttcgttttcggaatatttacgttttcgggatatttacgttttcgggatatttacgttttcgggatacgtatattttcgggatattttcgttttcggaatatttatattttcgggatatttatattttcgggatatttacgttttcgggatatttatattttcgggatatttacgttttcgggatatttatattttcgggatatttacgttttcgggatatttacgttttcgggatatttacgttttcgggatatttatattttcgggatattttcgttttcgggatatttatattttcgggatatttattttttcgggatatttatattttcgggatattttcgttttcgggatatttatattttcgggatatttattttttcgggatatttatattttcgggatatttacgttttcgggatatttatattttcgggatattttcgttttcgggatatttatattttcgggatatttattttttcgggatatttatattttcgggatattttcgttttcgggatatttatattttcgggatatttacgttttcgggatatttatattttcgggatatttacgttttcgggatatttatatttttgggatatttacgttttcgggatatttatattttcgg

SEQ ID NO: 7303 - DNA, 2490 bp, synthetic construct
  misc_feature 1..2490: note = Description of Artificial Sequence: Synthetic polynucleotide
  source 1..2490: mol_type = other DNA
cgtgaattcgagtttcggttacggtcgttattcgtttttatttatttttacgttgtagtgcgattagttattcgcgtggtattcgttacgatttagttgggtttatagataggagttgtttttttttattgtaggcgggtgatttaaggtttttattgttttatatttgtttagatcgcggggtattcgggtttcgtagttttttggtcgcgttcggggttcggggagtcgggttgcggttggggggtttggaggatgagggcgaagattcgagttggattgcggagagggtgtcggcgcgggtcgggtttggggggaggatacgatcgggttttcgttttcggatatcgtacgcgtcgatatagaggggtcggttttcggttttggcgcggcgggttggcgtagggcggggtggcggttgaggggttcgggttttaggtgcgtttcggagcggtttcggcggcggtgcgggggggaatagggaggtaggatggggggcggggaggcgggaggggggagtcgaggttttcgcgtcgttagtttcgcgttttcgttttttcgttttcggttcgagcggtcgttatcgcgggcgggcggcgttgcgttcgggtgcggtttttcgtcggcggcggcggcgcggtcgagaggtgcgggtttcgcgcgggcgggacgcggggcgttgttcgtaggagcgattaggtgggcgtcgggtcgatcgtagtcgtcgtcgcgttttttttcgcgtttcgggttttggtttttcgcgtttttttttttcggatttcgttttttcgttcgaggtcgttttttcgtttcgggttcggtttttcggagttcgtcgattttcgttcgaggttttttcgttcgacgtttcggtggtagcggcggttcgggttgcgtttttcgttgtcgtcgttgttgcggttttgtttttttcggggagggggtttcggcggttttgcgttttcgggttttcggtttcggcgtcgtcgtttttcgttttttgcggttcgggttttcgtttgggttcgattttgcggggtttcgttttggcgtttgggtttttgttcggtaggttttcgcgcgttttttgttttcgattttcgggttgggcgttttcgtttttaggtttttttttcgtgtttttgtagtttttcggtttcgttttttcggggtttttttcgtttcggcgtttttgtttgtcgtttatcgttgtgtttttggttttgcgttagttttttttgggtttttttttcgggttttcgttgttttttcgagtttttgatttaattttttatttttcgtttttttttttttttttttttttcgtttttttttttttttttttttttttttgtttttttgtttttttttatttttttttgtgtttcgttttcgtcgggttttttttagttgggcgttttagtgtttgtgtttttggtattttcggattggtttcgtgtttgcgttcggtggcgtcggtcgttgtttttcgttagagtttttttttatttttggttttttcggattttgtttttgtttttttcgtttttgtcgggtttttagaatattcgggtcgggcgttttagcgtttttgggttttttggcgtttttttcgcggttgagtttattttttttttttagaatcggggttttgtttttagataaacgaattttaatcgaagcgtatcgaattcgagggttttagatcgggcgcgacggggttcgcgcgggaggagtttttcggacggggcgggagcgtggggtttggtaggggaaggtcgggcgcggggattgtatcggatttatttcgggacgttgcgcggggcgttcggtgggtgtcggcggtagcgtttgggtatagagaggggattacgcgacgggtcggcgatagcggttggggcggcggtcgcggggattttaggttgtcggttttcgtcggttttttttgattcgttgttttttcgtaggcggacgtcgcgggtatggattattcgtacgacgaggatttggacgagttgtgtttcgtgtgcggggataaggtgttcggttattattacggattgtttacgtgtgagagttgtaaggtgagcggcgagcgcgcggtaggggtgcggtagacgggcgttgcggggtttcgttgatttttagttttcgtagggtttttttaagcgtacggtgtagaataataagtattatacgtgtatcgagagttagagttgtaagatcgataagacgtagcgtaagcgttgttttttttgtcgtttttagaaatgtttgacggtggggatgcgtttggaaggtgcgcgtcgcgcgggtttcgatttttgattttttatagtttgagggggtagggggtgggggtgggagaggggttgaggggatagtattattggttttcgcgaaggtttttcgtgcgatattagggtttagtcgttgtaagagaatcgggcgttggcgttgggtgggtttcgggcggggaagggacgt

SEQ ID NO: 7304 - DNA, 5370 bp, synthetic construct
  misc_feature 1..5370: note = Description of Artificial Sequence: Synthetic polynucleotide
  source 1..5370: mol_type = other DNA
cggtcggtttagcgtaggatttcgggataacggatggtaattgggggtcgttcggaggtttttaggattttattagtgttcgttgggttgggttggttcgttttagttttaagacgcgtagttttcggaatttttggagttgttcggtttagtcgcgtatagagtcggcggtagagcgggcgcgggtcgggttcggtagggggttgatcgggttcgagtgtcgggcggtggcggggaaggaggacgagaagcgtttattgttggtagttttgtttgtagtatagttttcgatttcggaagtagtagttggtggtgagggtttgttgatacgtcgcgtattgtaaatatttttcgtgttaggacgattcgttgattcgtattaggaagcggtcggagatgggtcgttggtagttttcgtagacggcgggatgcgggtagtcggagtttgtagcgtatagggcgaaagttcggtcgttagcgtcgttcggtttagtttcggcgtttcggtcgtatcgggtttatagttttcggtttcgagggttcgggtcgttcgggattatcgtttgtcgtttgcgtttttcggatcgtcgcgttaggggtcgggcggtttcggttagttcgttttagttttcgggtttcggcgtggagaggtcgcgggtttcgagttttggttcggcgttgtgtttttttttttttcggagaattcgcgtttcgtgttaagataaatgataacgagtacggcgtagggtggtcggttgggattaagataggcgaggtgaggttggggcgttcgttggttgatacgttttacggtggcgttcgtggttttttattttcgatttttttaaaatttgtggtttgagtgattagggagacgttttttttttagaattttttttattttaggtgattttgcgttttttttaagttcgttaaggtgattgttaggttttttattatttttgttattcgttatttattatatcggagtggtagttttagaatttaagtttggaaaggatggtgggtggcgattggagttgttttgtttttttaggacgtttgtcggaggcgtatttgcggttttttggcgattattttaggagttttgtttttgttttttttttatgttttgtaaatttattttttttattcgttggttttaacgttcgtgtttatagtcggacgacgttttattttacgttcgagattattcgggcgtttcgatttcgtatttatttagtagtatttttagagtggcgggttcggggcgtagggcgtgtttttttattttgatgtcgtttaatattttggcgtagttcgtttgttcgcgagggaagtatttttttagcgattcgggatttgttgttatatttatgggacgcggggcgcgttgcggatttcgtcggtcgggttgttcgttcgtcggttcgtttattcgtttttcgttgtcgcggttttggaatcggggaggcgcggttttcgtagggtaggggttgcgtcggttttcggcgatcgtggagcggcgacgcgttggtttcgggtttcggcgtcgtgcgggcgggtcggggcggttgtagttcgcgtcgcgttttttcggatatttgtagttacgcgcgtcggtttttttgttatttgtttgttagtttcggaattcggcggcggcggttgttgtagacggagtcgcggggaggaggcggcggcggcggtggcggtggcggcggcggtaggcgggggagggggtgggggtgtaggggcggtttcgcgggtcgcggggggggcgcgcggcgtagcggggtttcgggcggggcgtagcgggtcgcggggtttcgggcgcgtttttcgcgttattttagtgttatggtgcgttcgttgagtcgtcgggtttagagttggggttggcggcggagggatacgggtcgttttatttttcgaaattttttgatatttgaatttcgcggtcggtatttttgcgtcgggatgcgtcgtcggttttacgttaaatagtgtcgtttcgttttttcgcgcgtttcggggtttcgcgtttttggttcgcgtttcgcgtcgcgtttggtttcgagtttaggtttcggtttttcggttcggtcgtttcgcgggtttttcgtagaagttttgatcgttttcgaaataaatttttttgttttatttttttgaaaaattgatttgggagttggggagcgaaggttttttttttttttttttgttttttttattattaatattttgtaaagttttagcgttacgaggagtggtttcgagcgaggttagattgcgcggacggtagggagcgcggcggtttcgttaggggacggcgtcggtcgggagtggtcgtttgggaattttcgattgtcggtcgaggtaggtcgcgggggttgagtcggagtttttcgggcggcggcgtttgttcggggtcgtttggttcgcggagagggtcggtttttaggaacgaaggacgggggcgggtagaaggcgaggacggttggttttggattcgtgtaaggggggtttaggtttaggaacggggagtgagtttggagtgtgggtgaggggtttgggaaagtttcgggtttggtagagattgggcgggggattgagtcgatgggaggttggggtttcgggatcgagaatgggggatattgggacgataaggaaggttaggtttgggtttaggcgatcgagagtttagaggataattaaggttggaaaaggggttttcgggtaggggtaggagtagtgggtaagattcgggttttttagggtttgtagtgaggggcgttaggagggagtggtggttttagggtagcggttttgaagaaattaggttggttgttaagatcggggttttttggcgggtcgggtgttcggttaggggtcgttgggacgcgcggattaaggatagtgttttagttagtttgggtaaagtggatttcggtaacgggacgcgaaagttggcgagatggagttgtcgattttcgcgttagtcgggtttggtattcgcgttcggtgcgagaggttatagcgtcggatcggttgtttgcggttcgtggtttttatcgacgcgcggtttatcggggagtaggggggcggttgcggttcggggtagcggcgggttgatttttcgcgattcgttgcggggcggtttcggtttttttcggagcgaggtagcggcgcggagtcgggcgggggcggagggtatggggggcgggttttttgatttcgttggaggcgaaagggcggatcggatttggaatttgcgggaggtttggttagaagtggttttttgcgtcgcggggtttcgcggaggggttcggttttgtggaggattagaggttttcgttttattttatttgcgtgtgtgtcggtgggtatttgtgtgtgtttgtgcgtgtcgggttttcgtttttgcggtttttgttttcgtgtgttttttggttttgtatatacggtatgtgtgtttttgtaattttttagatttttaggggtgaatttgtggatttgtgtttgagttttttgtattcgtgtgtatgtgaatgtgtgggtttttcgtgtttgtgtttggggtgtgtgttcgtattattttatgcgggggtttaagtttttgtgcgtgttttagtttttgtgttgtgtttgcgatttttttttgtatgggtgtttttgttagttttgcgtatttgtgtttattttcggggttttgaatgtttttgtgtgttcgcgtgttttttagtgtgtgtgtgtgtgtgtgtgtttgtgtgtggtggggggttttgtgttttcgtgtatttttaggcgtttttgtgtggttaggtcggggagagtggatagttaatgtggagttttttttttatatttcggttttttttttgtttgatttggaaattttaggtttggattcgcgaagttgggttgggtttgagtcgtttttttcgggtatttggggcgggggcgcggttgttgtagggagaagtcgggcgggtaaggtttcggcgtatagagttagagtttcgaggcgcggagcgcggttcggggtcggcgggcggattaggtattttttgttttttgttggtcgcggtttatttttgtaatcggggttgggcgattgtttgtaggcgagagttttcgttttaggtttagatttttttttttttttttagggtgtatatggtaatattttttcgttataggttttgtatttttaatttttggcgtaaggttttattttttttttattttttttgtgtttggttttttttattttatagtttttttttttttttttttggttgaatgagggtttttgcgatttagttttttaggtttttttaattcgggttggcgtttagtgtcgatttggggtcgttggttgtgtttagaggcgtatttttcggattattcgaaggtttggttttaaggtaggaggatttgtgggaagtatttttttcgtgtcgcgtttggtttgttcgggtgcgtatgtatttttagcgtttttttcgcgtttttgttagttatattttacgttattaaggcggatatagggtggtttgtcgttatgcggttcgcgtttagataggggcgttggttcggtggacgttagagtttggttgttttttttggtttggggtggggttgttgagtttatattttttgggtttttttgtatgtttttttcgttgtttatttattttttttatatatatatatatatatatatatatatatatatatatatatatatatatatatatatatattttttttataggtttcgttttttgttttttgtttttatttttcgtgtttcgtgtttttagttgagttggtcggtttcgggtttttcgtacgtagacgcgtaggggttttagatttttttagtataatcggggttttcgcgtttttttatcgttttttttgtcgaagaagcgaagaagcggtcgattggacggtatagtaggggtcgaggtttagagtcggtttttgttcgtaggcggcgaacggtattttgtttcgttaggtttttgcgggtgtgattcgtgattcgtagattttttcgggcgtttttggtttatgacgcgggggttgttcgttttacgtaggcggtttcgggatgttttttcgtttagattttagcggtagaaatagtttcggattttttttatttgggggaaagattgagtcgggggttcggaattattggaagaagcgagaatggaaagggaggttttggagcgggggtttcggttttttttagtttgcggacgttttagttttattgagtttcgttttagttttttcgtttttttttttagggttttgtatttttttttttgcgttattcgtttttttcgagtacgg

SEQ ID NO: 7305 - DNA, 3120 bp, synthetic construct
  misc_feature 1..3120: note = Description of Artificial Sequence: Synthetic polynucleotide
  source 1..3120: mol_type = other DNA
cggacggatcggcggacgttgcgggttcggtcgggttgataggaattatttgcgttgttttaggtcgtttttcggtttattgtttttttgaattcggtcggttttcgcgggtcgtttgatgtttgtagggttatagattttcgtatataaattatcgtcgcggggttgggggtggggcggaggcgttgaaatttaattcgtagagtttgtttcgtcgtcgtttttttgttttttttttcgttcgttcgacgttttttatttatttttttttaaataaggtttattttttttgttaaaaaaataaagttggtattaagtgtttcgagggagaaagttttttttttatttttgatttggaaggaagggtcggttgtcgattgagtcgggattgtagagggggttttaggagaggacgggcgggaggtgagtttagggtttttggttttatcggttttttttttcgttttcgtttgttcgttttatatttaatggtagcgaattttatggttttcggttatgttttgtttttttattcgttttgttcggaaagggttttttttatcggagttttcggtttttatgttgttagagatggaagtattattttttgttttttttttttttttataaaatagtttttgtttgtcgtttttacgaggtgatattttgtttttagttcgattttttttgcgttcggagtttgggttcggcgcgtaggagattgcgtgtattttggcgttttcgatttttgttagggcgtacggggattttagagcggattttttacgagttttaataggaggttagggagtcgggatattagagataaattttttcgaagttttttttcggttttattgattggagtttttgggttgaaattttacgagttttttatttttatgtttatgaggggagtaaaacggagttttcgggggtacgtaggtttcgtttttgggtgttggttttgtttttggtttttttagtcggtgtagtgattcggaatagcgcggtcgttttttcgacgttcgcggttttttattgcgtcgaggcgagcgttacggttaaagtttaagtttcggcgttcgttgcgtttgtcggagttttgtttgttcgagtaggtagcggggtttaggtacggcggcgacgtcgaagggttagtcggtagatagggttgggtttttgcggttagagcgtcgtaggaaagttttgtaaacggtgggacgagggtggcggcggcggcggcggaggtggcgagaaaggcgttacgggtttggcggagaagagggttttcgtgggggtggaataaaggaatttattttcggaagaaaggggtcgagtatgtagtcgggaatggttaattttggagatttgtaggagtgcgagcgttgcgatattagttttagggatttaacgaaatttgtttcgtcgagggttttagtttggtatttttattcggttttttttttttggttaatttcgttttaatgggggtggtgggtgtgtattcggagtgttattttttttgggaagaggggatagagtaggattcgtgttttcggttagaggaggtaaatatattttattaattttttttttatttattttttagtcgtggggttattgtttttattttttagacgttgttaattaaggtattcgtaaaattattttttttttcgtttttacggtaacgtttcggtttttgaggtttaagcgcgttcggaaacgaaaagcgttagggggttatagggtcggagtttttttttttcgtcgttttcggaaggggtggaggggatacggttgtaaggtgttcggttttttttttgtgtttgatatgaataaggggattaggatggtaagttttcgtcgtttatttcgtgggataaagggtttcgcggtttgagcggtatagtttttgattaaacgatagagttttgttatttagtattattttaggtatttgtgttcgtgatataattttattagaagataaaatcggcgaaattttttttataatgaaaagttatatttaatggtcggattttttttttattttttttttcggagtttgttcgttttttttcgttgttgttggatatggttcgtttataattggtatttaaagtattaagttcgggagaaaaacggggtttagggtttttgtaatttttttaaattgtttttgttcgaaatttttatagatataagtttgttaagagtaaatatttgtggattgatataattatattttttttttgtaaattaaatttaaaaaaaaaaaaataagataaaaaaaaatttgttattcgtcgttttcgggttggggcgtaggagggagggggttggggtcggttttagtattcgcgtcgggaattcggttttcgggtcgtttggttgtttttaggagttgagggatttcgtacgttttttaggcgggaaaagggttttagattttttttcgtaatttttaattttttgtttttttaataaataaatttttcgaatttgttgtttttggttagttcgagggggtcggtaggagggtttggggaggggcgagggttgtgtttaataaggaatgaaaatgttagtttttttcgttagttttattttttttagcgggagtttgtagtggttttaaggagaattattggttttttttggatcgcgtaaggttttatttggcggggtatttcgattttagtttaagagagttttcgagttattaagggttttcgaaacgttgagaagttcgaaagttgttgtagggttttggatttcgggttttagtttagcgcgttttaggatcgaatttttttataaattagttgttgggtgaaagggttgcgttttagaaagggtaggatcgtgtgcgcgtattagagcgcgcggtttttaaattcgggttaaatttttggtgatatcgaaatttattaatcgtcgttggtgttcgcggttcggttgcggagtttaggagtttatgtatggtgttattttatttttagtaaagaatatgttgtacgaatcgtcgagaggtgggtttggaggggtgcgcgggtggaggtcgttgaaagtcgttttattcgcgtgttcggacgtcgaaggaagttttttcgt

SEQ ID NO: 7306 - DNA, 3120 bp, synthetic construct; identical to SEQ ID NO: 7305
  misc_feature 1..3120: note = Description of Artificial Sequence: Synthetic polynucleotide
  source 1..3120: mol_type = other DNA

SEQ ID NO: 7307 - DNA, 7861 bp, synthetic construct
  misc_feature 1..7861: note = Description of Artificial Sequence: Synthetic polynucleotide
  source 1..7861: mol_type = other DNA
cggattttcggtacgggttgggaggagtttagaggcggggtgagttttaggttcgggcggtttagagtttcggtttagggggcgtttaggttaggagtgttcgtcgtttttagttcgggtggaagcggcgacggtcggacgttcgagttttattcgcgattagcgtttttcgtcggtttttgcgtttttttgttttagttcgcgcgtattttttatatgaggttgttgtttttgtagatgtttacgtgtttcggggcgattacgcggtcggtgaaggggtttatttcggttttcgttttgatttacgttttggagaagatgtcgaggttttcgttagggatggagttttgagcgatgattattttcgtaggtagtattaggttggatagtttttgtatttttgcggcggcggggttaggaaaatcggttagagttcgaggtagtcgaggttcggttttttttttttcgtcgggatttcggtttcggttttgtttagattagttaaatttaagtcggttttaaatttagagaagttattcgggtgtggaggaagtcggatgtgcggaggtttaacgattttttttttgtttgtaatttggagatttttcgtgttttggaaagcgagtggtgcgttggggattatttttagaagtgggtttttagttttttcgcgaatttttaaagtattcgtaattttttttattttttgtttcggataagtttaagaattaatgagttaacggtagcgagcggttttatgtatagggaaattgaggttaggttttgtaaggaggtgaaggttaatcggagattttttcgtttagtcggttttcgggagtttattgtgtgtttaggttttgggtattggtagaggagtcgggtcgtgattagcgttggggatagatttcgggttggtaggtgttggaggtgttaaagaagtatcggtagtagttggttaggttttgcgttcgttgtgtgatttcgggcgcgttcgagtttttttttgtttttaggttttggggtgttagggagggcggcgttcgggtttagataaatttcgatgttatttttttgggcggggaggagtcgcggcggtttttagtttttcgagggtttttttgtcgggtatttgcggtagggttggaagcggcgaggcgtataagggcggtttttatgttttataaggtttttttttaagttatttgggaaaatattcggcgagcgggtcggttgaaaggggggggttaaacggtgtttattgcggcgcggcgggtaatttgttacgttgttaaagtgatcgtatttattcggttttattcgaaagaaattgttaattttaaatttattagttttggaagaatgttgtagtagtaaattgtagtttaatgcggaggggatttgtttaaaaggggtcgaggaattttttttataaaaaagggggattagatggttgatatagcgtgaatggaagtggaattagtttttacggtaaattaagagaggaatagaaatcgtaaagggggaaaagagggcgacgcgtagagatgttagagttagggaaagatattgtttgcgggttgatgaatgaggaataagaatttgagatattttaaagaaaagaaatttttttcgttttttttttttttttttcgtttttttcgcggtttttttttttcgttcgttttttttttattttttttttagtttcggttgttttttaaagtttttggtttaagtgggaattttcgtgggttaagtttaagttaattaaatgaatttaaaattttttttttttgagttaattgttattatacgtttagtaaggttgtaaatgtcgggaattcgttagtttaagcgtaggaggggaagggaggggtcggcgggggcgtcggggtcgagcgacggggtcgtcggggtcggtttttgagtcgggtgggttgcggagttgtttggtggttcgcgttttggtttggtttatggggaaattgaggtgtatcgagcgtcgggagagtttaggttggcgcgagtagtagcgaggtcgggtattttagtcgcgtttcgcgtatcgttaggacgggaatgggggtcgtcgggaggagggattgcgtcgggtttcgacggttggatttatcgtcggagaaggattgcgttagtatttcggcggtgaaggttgttttggggttggcgtggtggtttttgttttcgaagagttgtttttcgagtacgttgcgttagcggtcgtataggaagttgtgtaggatgtcggaggtgataatttcggttagcgttagtttcggcgtttttagttcggttttgagtattagggttttagtcgggagtacggagtttattatgggcggttcggagtttttcggcgtcgggggacggtcgggtcgacgggggaggtgggcgggcgagaggggagtttaaggggcgagaggagagcgttgcgatggagaaggaattagagtagggggaggacggagaggaggaggacgtaggagggagcgggaggtgagggggcgattgggaggaaagcgaacgagggggagaggggaagagagatggtgaaatttgtagagatggtaaaggcggcgcggagggtggagagacgcgggtggaggcggaggcgggtgcggggggtgtagggtgggtgagaggcgggtggttgtagggaagcggtagtaaggggtttaggcgcgcgttagtttttcgtatattcggtcggggtcgttttttttttggtaaaattttagcgtttttataggagtcgtagtgatttttttaattggttattaatgattttttgacgtcggaggatagatttgttgtattcggttgggttcgaggagttttcgtcgcgagagcgcgaggggcgggggcgcgcggatcgttttaaatagtatttttttattttttttttttttttttggttttttttttttttttttgttttttttttttttttcgtgggaagcgtagggtagggagggaggtttagtcggttttgaggagaggaggggacggagaaggggagggggtgcggcgaggttttttaggattttagggattaggttagataagaggggacgtttggtttcgggtttcgcgttttttttaggtttgatttatgtttatcggtttggtttagttcggcgtttatttttattttgttgtttcggttggtcggtttagttttgtatcgtttttttttttcggttagagttcgcgttttttttttttttcggttttgtatttttcgggtcgttatagtcgtttcgagttcgcgcgtagttttagttgttacgcggattttttgtttagattgcgttgttgaagtcggcgtttcgttttatacgggtcgcgttaattcggtcgttgtgtacggtcgggtgcgaaattttttcgcgggtttacggggttgtcgaggcggggtcgtagcggtcgtcggggttggggttggtttcggtttgagatagttttatggaaggttaggttttcggtttttgcggggttaggtcgggggtcgagatgggcggataggaatcgttttggtagtttgtttttgggaaaagaattttttacgggatatagggggattgaaaggggtttcgagattttttttaggtgggagtaggcgtgtttgagagcgaagttttttagaaattgtaggtagtttcgcgagaggttttagtgcgggttcggtttgcggttcggtttttcggttttttgttgagttgtaatttcgggaagtcggtggcgttgcggcgtttttttttttttgttttttagtttttttttttttttttgtttttttttttttttttttttttttttttattttttttgtttattattttaggagtagatttgttttgcggcggtttcgaggtatttcggagtttagcgattttttttttcgaagtaggtagttgttgagtttagcggaaggtttcgttttttgtaggtttcgcggttttttagtgttagttttaagtttcggattttaggttttgatatgttgggtgagggagtttattttatttgtcgtatttttggtttttattattagtttataattttagatgtcgttaatagaggtgtttggattttttcggcgtgggttaggtttacggattagttttcgttggattgtgtggattttttagattttttttttagcgcggaggatttgggtggaagaatagcgagttgattttttatgagcgagattttgtttaaacgtttgttggtatagacgtttttttattattcggacgcgttttggttaagagggttttatatttggcgtttagattttagatttttggtttttagtttttgttagtagttttcggtatttttcgttttcgttgggacgtaaagggaggaaggcggcggtagttggtttttagattttgcgttcgggttcgttcgaggttggagtttaaggaagggtatatttggtagaaggtaggatcgttgggtagggcgttagtagagggtagcgttgttgaggagggaggtgggttagggtcgtcgaattttttatttatttttcgacgtagtttgtgggtcgtatcggttttttggttagagttcgagtttgagggggcgtatggagttcgatggtttttgtaggggagttttatcggggtttattttttggtttttgggaagatttaggtggagaggataaagtgttaggagcgagggagacgacgtcggggagcgttgttaggagttaagcgttgcggtagtttttaagtttcgaaagcgattttagtttttttaggatattaaagggggataaggattgttgtgtgttttgtggattgttttttttttttttgggtttcggtgtttttgtttgtgtaatggtttgagttggattttgtgaattgaggtttttttgtttggtttttttttgggtaagattattttattttacgataatttcgaggattttgttttttttagggttacgttttattgcgggaagtttttaggtttgtgtatttttcgtgttggggtgtagcgtttgggttttgaatttcggtttagagttagaggtttggatttcgttggcgtagtgattacgggttcggattgcggttagggagttttatttttttttttcggattcgtaagttcggagagtagtattgggagtcgggtagaagcggagcgtagaacgtttttttagttggtgcgtttaaatttttatcgcgtttatattttgtgtttttagtttagcggtaaaatttatttggattttcgttcggggaaaaaggagttcgtaggtagcgtttagttttaaggtgtattgaaatagggagtaagattttgtgtttatattttttcgggaggagatttcgaggggaaatatttcgggtttttttagcggatgattcgtgttattttgttatttttcgcggggtttaggcgcggaatgtgttcgcgtaaaagtttttttttttcggtcgggtcggagtttttaggtttcgtcgtttttttcgttcgttggtcgttatttggcgatttttttaatatttatgggcgttaatagagaggtttttagtatatcggtttattgtgggcggttcgtaggatttgaataggtttcggtttttttttttcggcgcggtttttcgaggggtcgggttaggagtgaatggtttcgtttttcgtttcgcgtttttttttttttttagggagaatatttttattttttttttcgttgtcgtcgtcgttcgggtttttatttacgcggtttcggtttcgggcggaacgaattaatttgtcgcggtttttcggaggttattttcgtcgttcgggtgttttttttttttgagtttacgggagtggagagagggtcgtcgcggtaggtcgacggttttacggagggatattgaaggggaagtggaggagaagagtaggggcgattcggaggggtggttgggtcggggcgggtaagatagttttagggttcggtagtcgttcggggttggttaatttttagttgttgtttcgtttagggcggagcgtcgaggggaaggaggtcgcggtttaagttcggaggttcgttcgttttttttttgaggtattagcgcgcgttttttcggttcggttgaggtatttatgagaacgggggcgtgtgggatagtttagggtttcgtacgacgttttcgttttcgtcggtgcgtcggggtttagtttcgggagagttaggtttcgatagtgcgttttagggggacgttcggaagggcggtcggtttcgcggtttttgcgttttcgttttggggttcgggtttgggtgcgggggaggggggtgcgagtcggttaggcggggttaaagcgtacgggttttcgttttgttcgtttcgtcggtttttagaggcgtagaaagaagtttattgttcgtcgagaaatatatttttgggggtcgagtgaaagttcgttttttttttgaattttagaagaaagttttttgttttcgtttttcggagggagagatttgttttttttttcgggagtttcgcgcgtttttttttttcgaaatatttgtcgggggaaaatttattttggagggtagatcgcgttcgttttaagtttggcgaatttattaaaaagatattagcggcgggggtaggtttcgcgtaggtatcgatcggtcggaatgagttcgaggaagaaaaggcgaagaatgcgttcgcgtcgcgtttagacgtttattcgtttcgtttagtttttgcgttttagtttcgtatagggagaggggttttcgcgtcgtttcgtattgtttgtgagtttcgcggttcgcggtttagtcgtttttattcgggtttttcggtatagtttttcggtaatttttttttgtcggtgttgcgtttcgttttggttttttttgcgcgtaggttttcggtcgtttttttttttcgttcgttgtcgtcgcgcgtttagtattcgcgttttttttttttttttttttttttttttttttttttttagcgtttttttttttcgttggcgtttcgattttttttttagtttcgtatatttttttcgtttttttttcgtacgtttttttttggttttttgagttttaatttttcgtagtggtttaggaaatttttttttcgcgtggggttcgcgtcgtttttttttttttattttcgtttttcgtaagacggtttagggttttagggcgttttcgtcggcgcgtataaaggcgcggttggttgttaaggcgggtgggggcgaggtcgaaaaaaacggttttaatagacgtgattcggggttaggtttgcgcggggttgtcggcggagtggcggtttcggtttagtgaatggggatagcggtttttttttttattttatttttgtttttttttaatgtaattagtttttaaggttcgggagagataaaggcgcgtttcggggcgtttacgtggagtgcgtaggcgcgaagtcggcgtttcgatcggtaggtgattggtacgcgagtttttttaggcgtttaggggcggaggaggggaagttttttttttgcgtttttcgaatttttttttatcgtttatatttcggtttttaggttagcgatgttagcgttatagtttaggttgattaaggcggcgggaacgacgggagagacgtcggggatattaggagatcgggcggtgggagagatagaggcgtaggtttttggaagtagagggggcgagataggggtcgggggagattgaggtaaggcgatgtcgaggtggagggagtagatgaaaggtcgagtcggagacgtaggggtataaagattcggagatgaaggaagtagagggggagaggtacggttttcgaaagagcgg

SEQ ID NO: 7308 - DNA, 1434 bp, synthetic construct
  misc_feature 1..1434: note = Description of Artificial Sequence: Synthetic polynucleotide
  source 1..1434: mol_type = other DNA
cggtttcgcggcgaggggtttagacgaaggaaacgtcgttttaggggcgcgcgggcggagatggagtggtttaggttgggggagcggggagtagggtcgttatcgttgcgtcggttcgcgacgtttgtttttgttcgttttgtttttcgtcgtttttttgggcgattcgggtttcgcgcggcgttcgtttagttcggggtttcggattgaggagggggaggaggaggaggaggaggagtcgcgttaaggcggtcggcgggcgtatttacgtcggtgttgcggtttagcgtttcgtcgtcggtcgtcgagagtttggtggtgttgaggtttattagcgagggtagcgtttgggatatttagttagtgattatggttatggtgtttagtacgatttcgattttgagtagcggtatcgatatcgcgtttcgagttgtttttagcgttcgtttcgagttggtatcggttttcgcgtttaggcggtttttaggcggcgggtatcgcggcgggtaggggcgtttggttgtgttttcgcgttttttcggttcgtcgtcgttcgttcgtcgtcgtcgtcgtttcgcgcgtttcggttatcgtcgtgtttttttcgggcgttagggaaggtggttaggtggtttttgttcgtcgcgttttgcgtttcgcgtcgttcgttttgcgttttgttttgttcggttgcgttttttcgggttttttcgtcgttatcgggaagcgtcgttcggttttgagcgttgcgcgggttgcgcgcgggggtcgcggtcgggaggcggggttcggtcgggcgggatcgacgtaattcgtttaggaaatgggtggattttttttttcgttcggtttttcgtcgttttttggttgttggtagcgaggtttgtaaattttagttcgtttaggagttgggattagggtgatatgaggagacggatatattattatttttagattataaaatattcggcggcggcgcggggattttagttgggggtacggttcgcggttttttcgtttcggggttttttttatttttacgtcggggtattttttttcgattttcgtagagggttcgttttggggtaaaggttgtcggtagagagacggcgtcgttttgtttattggagttttttttcgcggtgattcgagggttttagttagtttgggtcgtcgtttgaaatttagtaggtagggtaggtttcgaaaagtagttagattcgcgagggtttttagcgttaggggggcgtcggggtatcggtggagagttaaaggcgtttttgcgattttagggtagtcgcggtgttttaaggttttgtttgggaggaagggagttaatcggtatttttgatatttgtatagtaaggcgggggttggggtggtttgtcgtggttcgcggtgcgtagtgagggttttgggagggcgtatattcgg

SEQ ID NO: 7309 - DNA, 5053 bp, synthetic construct
  misc_feature 1..5053: note = Description of Artificial Sequence: Synthetic polynucleotide
  source 1..5053: mol_type = other DNA
cggttcggtattttgcggtttcggtacgtagttttcggcgttatatttattttttttgcgtttcgggttgagttttcgtcgattatttgttgttttcgaggttaaattttagcggcgggaggattttgttgttttttcgatttttttttcgggaattttagtttttttggcgtgtgttttagtttaggtttttgtttttgggtcgtttcggcgtaggaagttgcggggtcgggacgaacgttggcgggaagttttgatttgggtttttttttatcggtgttcgttttcgggtcgggtacgcggggcggtttttgggtatcgtaggtttcggcgtaaaggcgtttagagttcgtagtggttcgggttggttttcgcgattttcggtttcgtttcgtttcgcggtttcgtttttcggtcgtttcgtttttcgttcggttagaggtttcgggttttagggcggttcgcgggcgtagcgtttagtagtattcggagtcgtttggacgtcggttcggggttattgcggggtggcgtcgttgggttcgggaaagttcgggattggagagtggcgacgtcgggcggcgggatttatggaggcgcgcggggagttgggttcggttcgggagtcggcgggaggcgatttgttgttagtattgttggcgcggagggcggatttgcgtcgaggtgggtgttcgggtcgagtggttgtatcggggagattaggagatttttaggttttttcgggtttggtcgcggaggttggtaggagttagaggatttgggcgggagtgggcgcgaggatttcggaacgttcgcgtttgggcgttttagtttgtatttgttgtagggtttttggtttgggttgttagggagtgagtgaggttgtggtattgcgttgtttcggttagggagttttcgggggtttagggtgggtttaggagatttttgtagttcggagttagttttttgggttggaggaggcgtagggagtagtggcggggtagtgattacgggataggagggtttttaagaaggtcgttttagtcggattttttttacgttttagcggaatagagttagatgtaggggttaaggtcgagttgaatttcgatcgtcggttttttcgaagttaggttttagcgtttgcgtttatagatattcgttcggtttattttcgtttagggttcgtttgtaggaaaaagttttttttttttaggttttttagttttttggtggtattattttagtttttagtattttggtttttagggaatttgggtagtttttttcgattttcgggttagttggagtcgtaggatggggaaggaggtttcggagttagtggggagtgagagggatcggtcggcgggaagggggttatatttaggttgtgggggttcgcggttttttatttatttatttatttttcgacggtttttgggaggggttggtcgcgggggttggggggcggagagagggagggaggaaggaggattgcgcgttcgcgttcgggagagttggtcggagcgggcgggttggcgtttaggtttcgtcgatttcgttatttttgatataggagttttcgttagggttggagtcgttatgtagcgtaaggttggggtcgcgggcgcggcgcggggtgggttggggcggtttttgttcgacgcgggcgtcggcggcgagttgcggtcgaggcgttgttcggttcgcggtgttgaattcgcgttgtgtcggtttgtcgggtcgtttcgtttcgagtcgggttttcgtttgcgatcgttgtttacgatggggatttcgggcgcgtagcgggttttcgacgtttcgtattcggagttgcggttttgtcggatgcggggcgtatttatcgtcggtttttcgttattgcgtggggaggcgtagtttagtttttttcgtcggaggtcgagggagtttttttttggtgttttttatttattgggagatgggttggagtcggcggggtttatagttagggaggcgggtgtaatatgttagtaaatttcggtttttttagcgggtattttttttttttagagattttttttaagtgaagagggagtttttagtttttgatatttggaaaattcgtttatagattcgaggtttttatagggtatttttggatttttttagtgtggtttttttagggggtttgtagtatcgaagtggggtgtggggggtagaagtagcgggaagttagacgtttgagtaattttgacggtgttgggggtatttacgtttgatataaaggtagtggatcggtttgtttagtttatttataagtaattttgcggttgtttaatgatggggaaggtattgatatttatttcggaggtttgtagatagggttattaggtagggtagttatatttgcgaggagtttttagaaagagtggttatgacgtttaatatgaaggagattcgatggggtgttttagttttaggtgatggtgaagattcgtttttttatgttttttgtcgggttttagagagtagatttttttggggtggggtttttatttgagttttatatgtattttttttggtattggtaatattttgtaattgagtatttagtttcgtgaaatggtttgggttgtttttttgtttatatatatttttagatcgatgttagtttttttttagtttttgatataggatgcggtgtttgtatattttcggaatttgcggggttatttaagttggttggggaagagggtgtgtagggaaaggaggatttttcggtagttttgagttttgtgggtcggaggggagattggttcgcgttggggtgggaaggtggttttattgttttttggtttacgaggtgatttagaattttttcgtgtttatagagatttcgttgtgcgttggttgtgattagtatattttggatcgttttatttttaaggttttggatcgttattggtatagtaagtgttttaagtgtagcgattgttatacgttattggtcgagcgttgttttagtcgaggggagagcgtttattgtaaggacgatttttttaagtgagtttcgaaattttattttagtgtgggagcggagggtacgtttgttttagggatttttttttttataattattaaggttaggttttcgaagtttgcgtttttcgtaattttagtttatttttgttatttaggtagggtattttgtggtttggttaaattaagggtggggtttttttatgggtgttttttgggtggttgggtttggttgggatattagtaagtattatttggaaaaaaaagtaatttattatttaaattatagaagtagttattagagaagatatatttttatttgtaggattttattggatttagttttttcgaaattggtgatgttttagtttttaatgttggtatttagcggttttggtttagtggtttttatggttttagttgtggggtgtgagggattggttttagatgggtttttttttttcggatttatttttttagatttagtatgggttttgtaggtaatggcggttgggtttttcgaggtttttttgagattgaggttttttttttagtgggagtgggtagttttgtttcggcggttaggttggcgattattttgtagggtcggatagagttttttttcggggtcgtttttttaggtagtcgtttgtttttttttaattcgttcggggcgaaatgagtttcgcgttttcgcgttgagttcggttttgtgcgtttcgtaggcgtttcgggattaagtgcgtcgcgtgttagttgggtatttcgtttacgtaggtggtgcgtcgcgtttaggatttcgtgtattatttgtattgttttgtttgcgtcgtgtgtaagcggtagttggttacgggcgacgagttttattttatggaggatagtcggttcgtgtgtaaggcggattacgaaatcgttaagtagcgaggttagtcgaggggacgacgtttttattttttttggtttgaaaaaaatggggttgaggttacgtttaggggggcgttcggggaaattttttttttaagcgtttattaagggggtttgggttagggcggtgtaggtagtaggaagtcgaggtcgggaacggcggagttacggatagattcgcgtttcgaatcgtttcgttcggttcgaagtgtgcggtttttcgtttttggtcggaattatcgttttaaatttttggtcgcgaaggttgggttatatttatatttttagaataaaggggagttcgcggggaaattagggtgtttggagaagggagttaaggttgaaggcgggggcgtcgtggaggtgcgattttagggaaggcgtcgttttcgttttcgcggtagaattcgtttttcgtcggcgttttttttattttagttcgggtgttgttcgtttttgttaatcgtttttagcgttcgcgtttttcgagaagtttgtggggcgggatgggggtgggtatttgaggtttcgacgttttcgcgtcggtcggggtgggagggttgggggttcggtcggggtcggaggggttgtcgcgttttatcgttcgttcgtcgcgtagaggtcgaggttacggttaagcggtcgcgtacgattattatcgttaagtagttggagacgttgaagagcgtttataatatttcgtttaagtcggcgcgttacgtgcgcgagtagttttcgttcgagacgggtttggatatgcgcgtggtgtaggttagcgttcgtttttgtttttttttcgttcgcggttttgggggttttcgtagagtcgggcggtcgtttatttcgtttcgtttttaggtttggttttagaatcgtcgggttaaggagaagaggttgaagaaggacgtcggtcggtagcgttgggggtagtattttcgtaatatgaagcgttttcgcggcggttttaagtcggataaggatagcgtttaggaggggtaggatagcgacgttgaggttttttttttcggtaggcggagggatcgcggagttcggggggggacgagcgcgcgtcggcggggtcgtaggggttttagggagttcgcgg

SEQ ID NO: 7310 - DNA, 6343 bp, synthetic construct
  misc_feature 1..6343: note = Description of Artificial Sequence: Synthetic polynucleotide
  source 1..6343: mol_type = other DNA
cggtagggcgggacggggttgcggtttattatggaatagtcgtatacgtgaatttttttgttttgattttggtgggagatgcgttcgtcgtttagatatttatagtcgtagttttgtttttgtatgtcgttcgatattttgtcgtagatgttcgttgggatgggagggcggttttaggacgtgttttggtcgtttttggaggtcgcgggaggaatttttagtcgaaggggtttgaaattttagttttgaatagttttttttttaggagagacgaagttttttgaggttgggatagggatgaatgagcgaaggagggtggaatcggggagggcgcgggaattgggagattgttggggagggtgttaggtcgtgttacgtttttttcgtttaggattttagtttgggttaaatttagtaggggtaggattcggagtagagcgtagttcgttacggttcgtagtttcgttttcgtttcgttagtttcgtttttgtttcgttagtttcgttttcgtttcgttagtttcgttttcgtttcgttaggcgtgtttttggtatgttcgtaggtttcgtttttattatggtatttagtttatttgtagtcgcgtacgatttttttgttttttgtagtcggagtttcggagcggggagtcgagtggattcggattagtatatatttgaagacgtcgtcggagtcgatgtttatattaggaatgagagcgaggttcgttatcgttatgttttttttttcggagttttttttttttattcgattcgggggtcgtttgtattgcgggaggcgggttttgcgagagcgacgattaatttcgtcggggaatgttttttaaggtttagcgttttagttaattgtatcgtcgatcgaggtacgtgttgattaatcgtaatttagttttttgtcgttttgcggtttcgttagtttcgtttaaaggaaacgtggaatcgggaatgggtggtgatgaaatttagttaacggagaagtttttttttagcggggttcggtggtatttttggaacggggtagttaggcggttcgcgaggttggggtaacgagggaggtttgagggatttgttagttttgattttttgtttcgtacgtagttcgaagattatttttttcgtggtttttatcgtttaaaggttttttttttttttttttttatcgttcgaaggtttttttttttttcgttttttatcgttcgaaggtttcgttttttattttttttatcgttcgaaggattttttttttttttcgtttatcgttcgaaggttttttttttttttttttttatcgatcgaaggttttcgtttttaatttcgttatcggtataaggaggtaacggtagtcgttatatttaagttttattttatttggttcgaaagtttttgttttttggaaattatttcggtttaggggcgttttcggtcggtttttaggggtggggtcgaatgtagaggttttggggtagggggcgcggggcgcggcggcgggtgggtaagcgggacgtttggtcggtgtagacgcgcggggacgagatgggcgtgtcgggtgcgaaagtaggagcggaggcgggggtgtttaattttttttatttggtgtttttttttttggtttcgaagtagggttggggattttaggagggtttttgcgtttggtttttatttttttttcgtatattttattttttagagagttttgggcgcggattagggtgtatttgggggataggtggaggtcgggtcgtcgggtttgcgtttttacgttcgtagtacggcgtgcggttagagcgggtgtgcggggatttttcgggataggttaagttttttcgggtgggtttttacgtttattaattagtttttttttttatttgttcgtattacgttttgttttttaggtttttatttgggaacgtttcgttttttggtttttttttttttagttaggtgttagttttggttaggtttaggtgttttgttttttttgtttaggttttttgttttttcggttgggagatttgtatatcggtttgaagatttttttgcggttttttttagtttttgtagggtttagattgtagcggttggaggcgaagggacggtagggcgcgtggcgtggttagtgtgttggtttcgattagcgggaacgtattgcgtatcgttcgttttgtttatcgtttcggcgggacgcgttcgcgtatacggacgtatagaggtcgattagggtgttttttagcgaggaggtaatatagtcgcgggaggcggggcggggcgtgtttaaagtgatagattgggttttggttacgtcgggtttttggacgaggggaaatcggagtcggggaggttttagcgagagtttcgcggatcgacggggatcggatttttacgggtggggtttgtgtagtagtgattttttcgagtgaaggtagagttcggcggtttttaggtttatttcgttttttagcggggagtatcgagggcgaggatcgattttttttggggattttcgagggcgagttgggagagggaggaggttcggaggagggagaggggttgttgggggtgggaaggcgaagggtttgtgaggaatattacggggacgaagggtcggggggtgggggtttgggcggagttggaggtcgaattgagcggagtttggaaggttggggaattagaggcggggtttagaagaagtcggggtggggttttggcggggttcgggggcggttttgggtgggtcgggcggggtttgagtgggtagggtagggttcgggttagcgtttgggttaggtttggtgggttcggcgttttatatgatgtcgtttagtaggttggcgttggttatttagtcgagcgcgcgcggttcggaggcggttatgattatgtatatgaaggggcggtcggtgcgtcggttcgtggggtagatggtggtgggcgtgaagcgtttgttggtttcgacgaattcgtaaagttgttcgtagacgcgcgggaattcgtggcgtaggaagacgtcgcgtagtcgtagttcgcgttggatgtggatgaaggttatttcgcgcgcgcgtcggttcgtttcgtcgttttgatttaggttcgtcgtgttcggcggtggcgttaggattagcgtttttatgtcgggttcgcggtttcgcgtcgggggcggtcgcgcggggttgtcggtcgttagcgttattttggcgaatttgcgtattgttggttcgtggttgcgtggcgcgggcgcgggtagggtcggtgttttcggtggcgcggtgtcgggttttacggttacggatacgttgagtaggaagtattttgtcggttcgtagaggcgtttagcggtcgttagttcgcgcgcgtagttgtttaggggcgtcgcgtgtgtggttagtttacgtagcgataggtaggtgggggatagtagtagtttttttaggttaaagcgtaggaagttgtcggtcgagtttggatttgggaagtttaggaagagtacgtcgcggtcgcgcgataggaagtcgatacgcgcgatgcgcgagaaagcgcggtgtatcgggtcgttgtcgcggtaaaattgtagtacgtggcggtatacgttgtttacgcggtcgtatacgtagcgcgttttgtgggcgttttagttttcgcggcggtataggcgcgagtagtagtaggtgtagtagttgtggtaggatttgaagtagaggtaggcgttgaatatggtttcggtgcgtcggtagcgcgtattggagtaggttattaggtcgttttcgtcggcgttgggttcgggggacgcgtcggtcgtttttttcggggtcgcgggtttttcggcgttgtcggtcgaggcggggggcgagcgtggcggcgttagcgcgggggtttcggagttcgcgggtcgcgagtttagtagtcggcgtagttgggggtttaggtagtcggtcgcgggttttgaggtttggtcggcggtgggtcgcgagtcgatgattaggttcgtgatgagttcgtttagttgttttaggtttcgttggcggttagaggtggggtcgtcgggggtcgcgtggggaggtggtcgcgtgcggttttcgggtaatttttaggttttggcgttcgggcgttcggtggcgcgtaggttattgttagtgatggtgatttcgggcgttacgtattagttgcggtttaggttttcgttcgcgcggttttttttcgttagcgacgtttcggatagggatagtgcggcgtagcgtttgggagaggtggataggtttacgacgacgggcgggcgtcggttttcgggggatacgtttcgcggttttcgtatttcgcgttttagtaggttttcgtagttgcggtcgcggtttaacgggttttttcggcgcggtttcggggttagaatgttgttttaggagcgcgagtagtggcggttgtcggtggttagtcggggcggattggtgtcggtgtcgtcgtgttaggaggcgagtaacgggtcggggttagagggcggtattatttgtagggtgcggtacggtcgcgggttttagttcgtttaggtcgggttgttgcgcgggtgcgggtacgttcgagttaggacgttacgttcgcggtatttttcgaagtttttcgtgtaaaaggggcgggcggtggagtgggttcggggtttttcggggatatagcggggttcgtagggtaggtcgtaggttcgtggagtttttttatagtaggagcgggagggcggtttttggattgggaaggtgcgtattttttttgcgtagtagtcgtttatgcgttttggattgggtttcgagagtttttcggacggatagggtttggggtagtaggcgtcgaaggttgggtcgggattggttgtaaagttgtttcggaagttttggggtttttttgtatagaagaattgggtggggttcggcggggtggtgaagggtagattgcggcgttcggcgtagtttcggggtttaggtaggggttcgtcgtagtagaacgttcggggattcgtatagtatgagtcgttgggcgtcggggtgcgcgatagcgttatgtggcggggttcgggtatcgtgaggtcgtggaattgcggggcggggcgggtttagtgcgcggtttcggtgggttcgtaggatcgcgagtttcgggtggcgtgttggagtattgcgtcgtttggtttgatgtttaggcggtagcgtacgtggggggcgggattcgcgggtggttcgggcggtgcgtagcggttcgcggcggcgtataggggcgcgacgcggtcggggtcgtttcgttgcggttgtaatttgatgggatgtagttcgttggtaagggcgcggagcgtcgggtacgcgggttttcggcgcggcgatgtttcggttcgcgtcgtacgttgggtttttcgttttcggcggggtaatatcggcggcgaggcgggcgcgggcgttaggttcgggggcgcgcggggcgtatttttggagcgggcgcggcggcgtggttcggtttcgcgggttcgggcgcgcggtatagcggatttcggcggcggtggtttcggtagggtttttatggtcggttcgtttagcgtttttaggaagtcgaagttgcggtagtggcgtttgttgaaaggcgcgggtttagtaggtcgggttacggatcgtttatatggcgagtatttggacgcgggtttcggggtcgttattttgatgttttggtatacggtcgatattagtaggttcggagggttcgtacgggttattttaaaagaggtttttaggttggcggttttagtttatattgttttgcggggtttttgttttggggggagacgcgggttagggcggtttttttcgtagtttaggtttcgttatttttttacgttggttcggtttatttggggcgtagcgggcggagtagttttggttgcgggtttgggtcgagaacgcgggcgttttttttatgtcggggttagaagtatttgcgggaggaatttagttgtttaggcgttcgttttgttcgttttttcgttttttttttgcgatggggcgggcgggttagaaaggtttagtcgtggttgtggttttcgcggcgggagttttcgcgtgaagttttagggttttttttttttcgattagtgacggcggggtcggttcgggtggattttttttcgggtggggtaggggagtgggggcgtggttttggggttgcgttttttggtgttcgtagttggaaggacgggtcgtatttgggttttatttataggtgttgttttaggagacgttagtgattgcgttttcgttatagcgtttattgtagagcgattttttcgatcgcgtatagtggaaggcga

SEQ ID NO: 7311 - DNA, 1089 bp, synthetic construct
  misc_feature 1..1089: note = Description of Artificial Sequence: Synthetic polynucleotide
  source 1..1089: mol_type = other DNA
cgttgaggggtcgtatttattcgcgtaggtattagtaggtagttttggcgttcgcgggaggcggtcgggggcgggggtttttcggtgtttatcgtcgtttttgcggttgggttcgcgtttcgggtcggtcgagtttaacgttaggatttcgttcgagttttttagggtttcgttaggcgtcgcgttcgcgttcgcgtttttttgtcggtttcggttcgggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggttggaggaggggagcgcgcgtttttattcgggttgggtcgtcgaggttcgcggcgtatcgtggcggcggtgggcggaggggggcggggggtatttttttttttttgtggcgtaggtgggcgcgttttggatcggtttgacgattttttttcgtcgttttatttttttggttaaaggtttttagtttttaattagggatatttttagtttatagtttcgaagttatgggtttttttcggttttttgaagtcgttatatttgtgttagtcggtcgcgtttttagattttttttcgcggagtttttttagtatttggagacgtagcgtagggtttcgaggacggtttggttcggagaaaagatatcgaagttttaattttttttaatttcgttttttttttttttttatttttttttttcgtttttaaagttcgggggttttatttttttttcggttcgcggagtttttcgaattttgcggggattcggcgttcggcggtgtttttttggggcgtacggggttggggcgggagcgaggagattaggtggggaggggattttagattttagacgttaggggagacggcgtttttcgt

SEQ ID NO: 7312 - DNA, 1020 bp, synthetic construct
  misc_feature 1..1020: note = Description of Artificial Sequence: Synthetic polynucleotide
  source 1..1020: mol_type = other DNA
cgtagagatcgtagagattaaggaggcgttcgcggttgtagagttgtagagcgggattttttcgagttgtttgtgttcgggtagtcggcgcgtaattgagttagaggatagcgtattttttcggcgcgggtcggtagggtttttgcggtcggtaagttggtttttcgggtggttatcgggattttcgagtttaatggcgggggcggcggtaaaatcgataatattgtagagattatttttatttttaacggagtaagtgttcgagttttaggtggcgacgttatttttttttagtattttcgttttcgcggagcgtttggtattttttttttgcgtatttttcgtttttgattgtttttttagtttttttttttatttgttttttgtttttgttttgcggtttttttcgttttattttttttttgttattttttgttttttaatagtaggtcgggattttcggagatgcggtgtttacggagtagttgtagggtgagcgggagcgcgagcgggagggggagggagacgcgggcggcgacggattgggtagtagtttgtcgttggtcgtgtttttaggtttttttagttttgaggcgttgttcgtttaggtgggggcgttgggcggcggttagtagttgtagttcggtttttgttgtttgtcggtgtttttcgtggttttgggtatggtttcggattttatttttacgttggcgttttcgttgtattgttattacggggtttttttttttaatgtttttggttgggagtagttttttaatgttagcggcgttagcgtcgttagcgttgttttagtagttagcgtcgttagtcgtgtcgttattagtatcgatttttcgtgtagcggtttcgtttcgtcggattttaattattgttttaaggattgggattataatggtttttttgtgtttattattaacgttatcggttaggtgaggcggttaggcgggtcgcgggtttgggggcgggtagagagcggcgagggcggggttttacgttcgt

SEQ ID NO: 7313 - DNA, 6343 bp, synthetic construct; identical to SEQ ID NO: 7310
  misc_feature 1..6343: note = Description of Artificial Sequence: Synthetic polynucleotide
  source 1..6343: mol_type = other DNA

SEQ ID NO: 7314 - DNA, 1109 bp, synthetic construct
  misc_feature 1..1109: note = Description of Artificial Sequence: Synthetic polynucleotide
  source 1..1109: mol_type = other DNA
cgatatagggtggcgtgtagggagcgtgttttggtattaggcgggcgcgagggggtagggcgtacgttcgggatacgttttagggaaatcgtttttgggtttggtagttgaatttagacgtcgagtgtagttcgttcggtgcgcgcggcgttttattgttagatttcggaaattagttgttagggtggggtcgcgttttggcgacggttattcggttatttttgtcgttttcgttttttttaagagatttttttagcgggttaattttttgttcgggtaaattttttggtgagtttttcgttttttttttttcgttttttttttttttatttttgttgtttcggttttttagttcgttcgcgtcgcgttttatcgttttcgtacgttcgggcgtacgtttttttcgttcgggtcgttttttggtttttcgcgttcggtagttagtgttttatcgcgtcgtttcgcgttagggttcgtttcgagagtcgtttttttttcgtcgcggtcggcgcgggtttttcggttatgcgttttcgagttttagtttgcgtcgtcgcggcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagtttagtttggttaataataatttggtgggcgtgtacgaggacgttttcgagattttggagtcgttgtaggtgttggagtttaacgataataatttgcgtagttttagcgtggtcgttttggtcgcgttgttcgcgttgcgttttttgcgtttggacgggaatttttggttgtgcgattgtgatttcgt

SEQ ID NO: 7315 - DNA, 1109 bp, synthetic construct; identical to SEQ ID NO: 7314
  misc_feature 1..1109: note = Description of Artificial Sequence: Synthetic polynucleotide
  source 1..1109: mol_type = other DNA

SEQ ID NO: 7316 - DNA, 1384 bp, synthetic construct
  misc_feature 1..1384: note = Description of Artificial Sequence: Synthetic polynucleotide
  source 1..1384: mol_type = other DNA
cggaagggattcgtcggttgcgtttcgtttaggttggtcggggtcggtgtgatcgtgtgatttcgtgtatattgcgttcgggttttcgtgaatgatagtagtttgtaatttttagtcggagagtagcggtggttatcgtcgggcggaaagggttataagttagaatgtaaagcgatttcgtttcgggtgtgggggatttcgggttttcggttattttcgaggtcgggcgtgttttgttcgttttttttcgttttgggcgtcggggcgattttattttgcgttttaagttgggggttttttatgttcgtcgtcgtcgagtttttcgtcgtcgaggcgttggtcgcggttttcgggttcgggtcggggtcgtcgtcgtcgtttagtttcgttagttttcggttggtggtcgtgagttcggttcgtaggttggttattttttggttggtcgattggatcgttttatcgatgcggagcgcgagttgtttattgttttttattatgtttaggattttggtttgggggcgagagaggtgataaagagttgtatgatgcgcggggggcgcgcggtcgggtattttcggttttatttgttgtgtttttcgcggttcggtttcgttcgcgtttcgatttttaggtatcggtagcgtcggttttttcggtataggaatgatagcggcgtttttagttttagtcgcggcggtggcgaggcggcggggggaggaggcggaggagaaaaaagaggaggagaaggaggaggaggagtagcgatcgtcgagatttcggcgggcgggcgtcgagagttgttttaagaaggatatcgcgcgttattaggtattttttaaatggagtttattattcgtcgtcggttcgggagggggtttcggtcggaggttgggggtatttttggtttttcgcgttttcgtatttcggagatatatttttcgggggggcggaggcggcggacggtagtcgggagggggttaaggtggcgtttttggcgaggggtaggggtcgtttggatcgaggtcggttttttgtttttttttttgagcggtggggtagttttcgttttggagaattggtgtttcgagtcgtgttaaggttggggaggtgttgggtgttcggaagagagggtgtttggaaagggggttttagaggggagtcggggtggatttttatggaagggagacgtttgcgttagtttaggagtggagttcgtgttttatcggttttttaaattgcgagtacgaaatttttagaggggagttgagttggtgtttcgcgtgttttttattttttattttttattcgtaggttagatttgcgttgtttattttaggagggagcgtttatttttttcggcgtgggtcgttggtgttttcgt

SEQ ID NO: 7317 - DNA, 1384 bp, synthetic construct; identical to SEQ ID NO: 7316
  misc_feature 1..1384: note = Description of Artificial Sequence: Synthetic polynucleotide
  source 1..1384: mol_type = other DNA

SEQ ID NO: 7318 - DNA, 835 bp, synthetic construct
  misc_feature 1..835: note = Description of Artificial Sequence: Synthetic polynucleotide
  source 1..835: mol_type = other DNA
cgtgaagtcggcgttatttagtttttttcgttaattgtttatttttttcggttattgtttttcgagtgtttatcgagtgttcgtgggttagcgagcggggtcgttggaggaaggggcgggtgtgtttagggttggcggcgggttcggggtttttgggaggaaagggtcgttcgtttagttttttttcggagtttagagacggtttcggcggcgcgggtatataggggtatatagcgcggggcggagggagggggtggcggtatcgttcgtggagggcgcgggttcgtttagtttttcgtatcggcgttttttcgcgcggtgtttttttcgtatatttatacgtatttatttttatagttatatattttagtatttgtaggtataaacgtttgtagggatatattacgatatagatatttaagtatatataggtatcggtttatagattcgtttttgagttatatataggtatcggtttaaaggtataggtaggtttatagattggtttttgagttatatatagtttagatttagatgtatatatatagatgggaacgttcgtttgtacgtgtatagatatacggatatattcgtatattatcgcggggtttcgagtatatacgcgtttcggtagacgtttatagatatacgtagggtcgggagcgtatatatatagatataggtttatatagatagattcggttttaaaaatacgtattcgtagaggtaaaggttagcgtataagtacgtatagatatatcgataggcggttttcggatatcgcgttttttgtcgtatttacggtttacgtaagggtttatatacggttttacgg

SEQ ID NO: 7319 - DNA, 2248 bp, synthetic construct
  misc_feature 1..2248: note = Description of Artificial Sequence: Synthetic polynucleotide
  source 1..2248: mol_type = other DNA
cggttttcgggttagtttttcgttgttatcgtcgtttagttagcgttcgtcgcgtgggagtcgcgaggttaggtttcgtagacggcgggttttcggtttcgttgttttcggcgggcgcgttttttttagttggttcggtcgttgggttgtcgtcgttttttagttcgcggtgttagttttcgcgttttacgtttggttttcgggtttcgtgttttcgtagtagaagggattggggtcggcggggcgggtggggacgtttgggaagcgaggagagttttcgtttttcgggcgtttttttataatggggttagggttttttttttcgtttttcgcgtaggtgtgagcgcgcgagtgtgcgtttcggtaagtgtgagtgtgaagtgtgtgtgtgcgggggagtgcgcggagggagcgcgggcggcgggcggcgcgggaggcgggaggtagggcgtaggggagggggttgggagggagagtgtgcgcgcgtgtaattttatttcggggttttgtgcgagttcgggcgatagtatcggcggcggttggaggaggagcggtcggagacgcgtgtagttcgttcgttagagttcggtagtcggggtaggtgggagttcgcgcgggagtcgagtcgacgcgagtcggagtcggagtcgagttcgagcggagttcgggcggagtttaggagtttcgttcgcgggtagttcgtgggcggtagttaggcggggcgggcgtcggcggggcggttttttagtaagatgtgcgcggcgtcgcggggcgttttttatttgtagcggcgttcgggagtcgggcggttgggttaggcggcgttttcggggttgttgcgcgttcgcgtttagagttgtcgttttagggagttcgttacggtcgcgtttcgggtacgttcggcggcgtttaacgatgatcgttttttggcggcgttttcggagtttggtttgggaatattgggtcgggtttttcgtgtgcgttttttggatttcggattcgcgcgggatgttttacgttattcggatcggtaagcgttttttggagtcgggggttttcgtgcgttcgggagggggcgggaatgagggggttttttaacgcgtttcggagagatttttttaattttttttcgagttgttgagtcgatcggtgattattaggagtttttttttgtgaggataaagttttagagtcggggttacgggttttatttattggggaggaggtcgtcgggtcgtagtgggcgaggggtttttggcgcgtttttgggaggttagatttggtatagtgtggcgaaggtttttagtgcgatttcgagtcgagggcgtatttcgcggtgattgttagtatgaatcgtagtcgatcgagttttgcgatcgggttttttcgtagagtggggattttggggaaggcgttaattttttttttttgtttattttatttttcgcgggtttttcgtttttatttttggtatagttcgagtagtcgtagcgaggtcgtagggtatagattcgtatgacgagggtagtcggtttttttttttggtggtcgtttttggtttcggtggtatcggtttagtttcgtgttatggggcgggggttgggggagtaggatttcgttgttcgttgtagttggtttttcggggttaaggtttttttttcgtttggggtagtgtaggtagagggaagggacgatggaggtcgtttagtgcggttcgggtaggcggtttagggacgttagcggtttttaaagttagttcgaattttttcgtagttggcggcggttggcggggttgcgcgcggtttttcggggtttcggttttttcgcgttttttttcgtcggagatttttatttcggtttttaattttgttgtggtcgtttaaggtattttgtaggtttgagcgtcgcgtatgtttcgggtcgacgatcggtagggttgggtttggtcgggttaagacggagtttttattatcgtaggttttgcgttcgttattaggtcggatatttgggtcgtttgggtttattcggcgttagtattagcgtttggtattaggcgagtcggatttcgtcgagttagggttattttttttttttatagtttttttttagggcggattttgggttgttagcggcgtgaaagaggtgtcggaatcggtgtcgggtttggttttcgtatttgagatttttttaggaggcggttagaaatttagcgggtgggtttttttttgggcggtcgttcgggagtcgg

SEQ ID NO: 7320 - DNA, 3541 bp, synthetic construct
  misc_feature 1..3541: note = Description of Artificial Sequence: Synthetic polynucleotide
  source 1..3541: mol_type = other DNA
cgaggttggatagttttcggtttgtacgtcggatttttggagagttcgagttttttttttgagtttattttttttttttttcggggcgtgattttattacgattatagtcgatgagtcgtttaagttgggagaaggagcgagaaggttgtagcggcgtaggttagatatttttgggtttaacgtttatttttaattagcgtttttgttagtagcgtttttttcggagttatagtttttatttcgagattttttttttttggaatttcggagcgcggtcgggtattaggggttcgcgtaggattgtagaatcgttgtcgttcgtcgttttagttttagttgttcgcgcggtatttatttgggttttagtgttcgggagaaggtgtgttcgcgcgaggcgtgaagttagagttcgttcgatttcgttcgtatcggacgcgtttttagggtagaggaggtcggcggagttgtgacgttgggattagaggaaggagaaggaaagtcgagacgggtcgggtagacgcgtcgaggagcgtttagtgtacgttggtagtcgcgggaggcgaggcgggcgcggtgagtagtcgcgtcggaatcgagtcgcgaattcgcgtcgtttcgcgttcgtagtcgttaggattcgcgggaattttggttcgtcggtagcggtattgaggagggaggggcgcggggttgagtcgtttttcggagttcgagcgtttttcggagtcggtaatttttgttgttcgggcgggatgcgggcgggaatttagttcgcgtggaatgtgggatcggtcgggttcggagtttttagcgttgggggaaagcggggtttatatagttaggacgagagggggtgcggttttagggttattttcgcgttattttttacgtggcggtcgcgttttcggggcgtgagtgtgtacgcggacggtaggggggtcgtgaatgaagttttagcggttaattagtacggtcggcgcgcgggatttcgggagcgacgtttaatggagagttttgggtggtcgggtagggtggcgggcgggcgcgcggggcgggggtcgggtaggggaggcgggaggtagtttcgcgggtagttaatgggcggcgggcggggtggggtttcggagcgtcgagcgggtcggggttttaagtcggcggagcgaggcggcggggttcgtagacggagcggagcggcggcggcggcgcggcgtagggcgcggggcggtatggttattatcgcgtagtatttgtcgcggggtttcggtggcggagtcgggggtatcgggtcgtttatgtattcggacgttgcggcggcggcggcggcggcggcggtcgcggagcgattgtatgtaggggtcgcgtatcgcgaagtgtagaagttgatgtattacgagtggttgggcgcgggcgcgggttatttcgtgggtttagcgtatttttagtggttatttacgggaggaggcggcggcggcgattgggtcggcggttcgtatttagaatacggtaaggtaggcggcggcggtatcggtcgagtcgacgacggcggcggcggcggaggtttttacgcgcgtttggtgtattagggggcggtttacgcgggcgcggtatgggcgtagggtagtatagcgtattatttgggttcggttatgtcgttttcgttcggggttagcgggggttattagttttagtcgttcgggttgtacgcgtaggcggtttattcggggggcggcggcggcggtttggtcgggatgttggcggcgggcggtggcggcgcggggtcgggtttgtattacgcgttgtacgaggatggttacgaggcgtagttggagtcgtcgtcgtcgtcgtatttgggcgtttacggatacgtatacggatatgtatacgcgggcggtttgtacgcggcggcggcgtatttgtattcgggcgcgggcggcggcggtttatcggtgggcgagtattcggacgaggatgcgtttagttcggacgatttggagtagttcgttaagtagtttaagtagcggcgtattaagttgggttttacgtaggtcgacgtggggttggcgttgggtacgttttacggtaacgtgttttcgtagattattatttgtcgtttcgaggttttgtagttgagttttaagaatatgtgtaagtttaagtcgttgtttaataagtggttggaggagatcgattcgtttagcggtagttttattaatttggataagatcgcggcgtagggtcgtaagcgtaagaagcgtacgtttatcgaggtgggggttaaaggcgcgttcgagagttatttttttaagtgttttaagttttcggcgtacgagattatcggtttggtagatagtttgtagttggagaaggaggtggtgcgcgtttggttttgtaatcggcggtagaaggagaagcgtatgatttttgcggtcggcgcgggttattcgtttatggacgatgtatacgcgtttggggagttagggtttggcgggggcggcgtatcgttatttttcgcgtttttatcgttttcgtcggcggcgttgtattattattattattatatattgttcggtttagtgtagtgatttcgcgggtcgggttttcgtcggcgcgttgtagggcgcgggcgcgtagttcgttcgcgcggtttggattttttttgttcggttgttttggattttataaaaaaaaaaaaaagtttagaaattttcgaataaaattaaatattcggacgatttttttcggtgagcggcgaagatagttcggtaggttgcgtcgttcgagtttcgggagagaggagcgaagattcggaattcgttaatttatttcgggtattttgttcgtcgtttgttttttgtttttattttttcgacgattttcgtttttgttttttcgggttgttcggggtcggatttcggtagcggtttttttaaagcgataggtaacgtagtgcggggttagggatttttcgggagagaggacgaagcgaggagagttttttatttttttttttcgcgtggatttttgagtttgcgggtttagggtggggggttgttattttattcgttatacgtttttttttttttataaggatgcgttttatttcgttttttttttttttcgggtttggttttttacggtttttatttattcgtggagtttttcggtttttggggtttttttaatttcgttcgcgtttttaatttaaatcgtagtatattgtatttatcggggtttcggaggggaggtcgcgagagtcgcgtttgtgtataaaagtaggaaatagttaaagttttaatttagtttaatttatttttttttttatatttttttattttattttttttttaaaaaaaagtaaaaaaaaaaaaaaaaaattaataaaaaaaattcgagtgtttatttttcgtttcgttttattcgagtttcggtttggttttcggttacgtcggaggggtttgcgtttttatatatttagacgggaaggggtttttgttttgttgtagatcgatcgtcgtatagcgcggtttttgtttttcgcgg

SEQ ID NO: 7321 - DNA, 1513 bp, synthetic construct
  misc_feature 1..1513: note = Description of Artificial Sequence: Synthetic polynucleotide
  source 1..1513: mol_type = other DNA
cgtaagaacggtttagcgaattttgtgtaggggaggcgtcgaggattggagaggttttgttaagggtttcgttgggcggaaggcgcgcgtttttttttatgggaaagatagatgtggggttaatgaaagggaggtcgagaggcgcggggacggtcggggagacgggggcgtggcggggagaggaaagttttcggagaaagtcgatcggattatcgtaagcgaggtatgtagcggagttcggaggaggaaggcgtcggggattggggtagggttagggcgggacgggggtggggggtgtggggggtattataggtagttggattcgagggttttgagttgaaatttaatattcgtttttggaaggatcgtttttttttttttttcgttttttttttttttttttttttttttttttttttttttttttaatttttaggacggagttttgcgcgggagaggagagggtttgaggggaggagaaaggaatagtattgagaggggttaggagtttaggaaggggagggaagggtagtcgcgggttaggggtgagtttgcgggttacgcgcgattttcggagttttcgtagtttttttagtgtttttatttttagtttaggcgagtttataggattcgggtttttgtttttttttcgttttttttttgtttttttttttgttttgtggtttttttttttttttttagagatatttgggagttgtttttaagttttggggcgtttcgcggggttttgttaagggtgcgtgtgagagagggcggcggagtcggcgtcgggtgttaggggtcgagggtgggagcgggagttcgtggttttgcgttttggagtcgaggattggaagggggttgggttttttcgtcgtttgggcgtaggtcgcgcgtcgggaaggtagtttcgtttgttttaggggtgtttgcgtgttggttgttgttgttcggggcgaggcgtcgtagcggcgattttagattttcgggcgcgttgagtgagtgcgcgcgtgaaaatcgtcgtatcgtcgggggtgcgagtgtttgggtcgaagcggttattttagcgatttagttttacggttacgttttcgggggtttttggttttaggtaatttggggtaagcgttttagttttcgtttttttttttttttagcggggtcgtcgtagattttagttttgggagtatcgttttgtagcgcggtcggcgggtggagacggttggtttttaaattcgttcgtttagtttaatcgtttcggcggttttttttagttttcgaggtttttttgagcggtttggagaggcgtcgagcgtagtttagcgttcgtttgtttattcgtttcggttcgggaagggaattttcggattttgcgagttcggggcgttttcgcggtttagggcgggtagttttcggggtttggtcgagtcggtggcgttcgggaggtcgcggggatagtacgtagcgcgcgtttttggatgtcgtttcgtagcgacgtttcggttcgtttcgt

SEQ ID NO: 7322 - DNA, 3541 bp, synthetic construct; identical to SEQ ID NO: 7320
  misc_feature 1..3541: note = Description of Artificial Sequence: Synthetic polynucleotide
  source 1..3541: mol_type = other DNA

SEQ ID NO: 7323 - DNA, 558 bp, synthetic construct
  misc_feature 1..558: note = Description of Artificial Sequence: Synthetic polynucleotide
  source 1..558: mol_type = other DNA
cgtgtttggttttcggaaagtgcggacgagacggtgtgggtgggttaggagttatttgtaagggtgtttgtaaatcgtgaagtttagaggagaacgggagaaggatggaatcgagcggagaggggaggtgtatggtaagaatttcgttcgtttcgggttgaaggggagttgtgggtcggcggttaacgtttgaaggagaggggtttcgggtggcgggaggcggttggggattcgcgtaggttagcgtgtcggttttttttagtttatcgttgtcgtcgtcggggttgttttaagggagttaagcggagtgggagcgggtttgcgcgtttttgttttgcgcgtaggggcgggggggtttaggacggggcgtttttttttatttatatgttgatttaggatttttaagcggttcggtttaggatatcgtttggaaatttagtcgcgtgggagagggcgattttatttttaatttttttgttgtgcgtcggtttagtttttagaagttagcggacggcggaggaggtggttcggttttttttggtggttttgcgttttcgg

SEQ ID NO: 7324 - DNA, 7244 bp, synthetic construct
  misc_feature 1..7244: note = Description of Artificial Sequence: Synthetic polynucleotide
  source 1..7244: mol_type = other DNA
cgtatttgttgggtcgtttcgggttttcgagttttcgtggttatatttttggtttttgcgggattttcggttcggagtggggaaattttacggtgatttggttttaagcgagaaggatatttgggttatcgtttttttaaaagttaggtagatttgtatagtttatttcgttttcggtttaatagaatttttcgaaaattttgtttaaaggagttttgggagtaggcgtttggcggtttttgcgcggaattcggcggttgtcggcgtttttttttcgattttatggtttatttatttaggtgtagtcggggttagatatatttggtttcggaatttttaggtgttggaaggtggggtttgggttttgcgtttttagaggatatattatttttgaagtatttttttatttttattttacgcgggagattttcgcgggggttgatattttttttttttttaaatttatttatagattttagtaagtggtattttttgggagcgagtaattagttttttatcgttattatagattttgttcgtgtcggagcgttttcgcgtcggggtttggtgaattttttggaagtttttcgttcggttttttagcgaattatttttatttatttttttttttagttttagtttttcggtgggtattttttagggttttttcggggcgttaggttttgcggttttcgggtgggggttcgttagtcgtatcgttttttttttatttttatttttgggtttagaagttgatagattgataagacgcggtttagtagtcgtgttaggcggaatgggttgcgttttgaggtcgcgacgattcgggtcgagtttgcgcgtttagattttcgtcggtttggaggttcgaaagagtaacgtagagacgtacggttaagagtggagggagaacgataggaacgtttattttttttattatttaaacgaattttttttattttgaaggagagagagaaaagtagagaataaaaacgagagtgatagaatattagaaattagagggaaaaatagaattagagggaaaaatagaattttagaaattagaggggaaaagatatagagataaaattagagttatagaaatcgagggcgattcgttcgagggtcgcggtattaattttagatgtttgaaaggtaatagttttttaaaaaggaaataaaatttgaaatttgttattttttttgtagaacgagttgttttttagggtcgtgatattaagataagacgagaataaggcgaaagttaaaattgaaaattgttcgagggggttttttagtagtgattttgttttttgtcgggaaggtcggatagatcgatgcgcgttttgagtttaagagaatttgcggagatatagaggttattttttattttcgtttagaaaagaaaaaaaaaggggggggggttatttgtttatttgtaataacgataaaaagaattttattattacggaaaagaaatcgagatgttgaaaagtgaggaaaagagagtttaaaaggggttgagggacgcgaaaagaggggcggggagaggaaaggtttagggcgcgagggacgtggcgggtatcgataggaagtgtaattttattttttttcgttgagtttttttttaaatacgaaaatttttataaattatatttattttttaggatgattatcgtattaggatttttaaaataaagtaattgagttttaaggagataggaggaaaaaattaaagtagtttttaattattttaaattcgtcggatttgggagcgcgtcgaaatatagtaggaagaaggtaggaaaaatcgttttggtatttatgttttgaatatttttttttttttattttcgtatttttgtttcgtttttatttcgatcgtagtaattgaattgttatttgttttttatttcgttttagggttttagagttatttgggaagttcggttttgttaagcgttttaggttagtaagagcggtgtagtcgagtcggcgttttagaagtcgagaggttatataagtttacgtagagaggcgtatcggatacggtaattaggagtaatttatacgttttcgggcgtacggaaattatttgttaggaaatttttaacgttttttttcgtttatttttttttattttttttttggcgcgttttttttttttttagaggtacgtagtggagtttttggagtttcgaatttttcggatattgtagaatgcggggtttttcgggcgcgggttcggttaattagagcgtcgtttgttttttttggttaatggtaggcgttatattgttgtttaattttgtttaatggagttttaaggattaataatagagcgggcgagcggtttattgagagtttggtagcgtcgggtaattgggtttcggttgcgcgtagcgttcggcgcgtatcgcgaggggattcggtacggcgagagttaggtcgcgggttttaattacgcggttcgtagacgagttttcgattcggatttttgaagggagggttggattgcgttgcgttttgaggggttcggaagttcggatatggtgattgaaggagggtgacgtggttagataaggggtcgggggtaaagggaagcggttaagagttttagcgtcgttagtggagtcgggaggcgcgtgtagcgttagcggaggaggaggatttcggagtttaaggtaggtagttgagggtcgtagggagagtagtgggtggagatttggtttgcggtttttgttgaggaggtttgggtttcgtgggttttagggacgttcgaagggtttgggagaggaggtaacgtttatagagaggaggtttgggattttcggacggagatataaggattttgtcgcgggttttggtagggacggggaacgcgggaagtagaggagatcgcggtagaagcggggagttgggtttgtttgggttttatggggttgcggcgtgggagggattttggtgttcgtttatggttagttgcgaaggcgatttttttggtttggtgcggtttgttgggttattcgtgttttaggattttaattttgagattagaacgtaggagtttgcgttcgagaggggttttttgggattttaagacggggagggcgtgtttgacgattttgtttttaaattcggaggggaggggagggtagtgtgaggtggttttcgagaaagatttttttttcgaaatgtttaatttttcgtaggatacgtttttcgtttcgattattattttagattgcgaagttaaaaaattgtattataggttttatttaatttttttttttagtatttgtttgtggggtttttttttatatattttttttttttaggcgcggtttttggatttcggatatttagattagttgttttttattgttttttttgtttatgaagtttatttttgggttgggtttgtttatatagaaagtttttttggtcgaatttttttttttaatattttttagttttaagttaaattttatatatattttgttttttattttttggaggtttttatcgtggaatttttggcgtttatatttttacgggttttagagttattgggtttaattttgtttaagttgttttttcgtttttattttgttttttaaagttattttttttgttgttgatttttttttttaaagtttttgttttaaattgtattaaaaataaataaataaaaagaaataaaatttcggtttaatcggtttttatatttgcgtttttatattttttttttttttatttttttattaaattgatcgttttgtttcgggtttttttgttttgtttttggtattagtttaatttttgggttaaaattgtcgttttaattttagtttcgttaaacgagtattttttttattcgttttattttaattaggttaagttttggggtattattttaatttttttaaatttttattatagttatttgaattagtgatttttatattttatatgtttttttattttttttagcggaattattaatttagataaaattttatttttagcgtgtatattaggtttaagagtagttatggttagattggggtgaaggtgttagggtttataaggaggtttcgattgtatttttttttagtaattttggtttttttagtttagttttcgcggtttaaatttttttttttagtttgggttttttaaggcggcgttttggtttagcgcgcggtgtgttttttattaggtttttttttttttttattttttttttcgttaggttttgttatggagttgcgttcggagttgtttagcgtgttcggtgcggcgacggcggcggcggtaatagcgacggggtcgtttgtggcgtcggtggcgtcggtggcggtagtcgcggcggtcgttgtatcgttatcggtgagcgtggtaggcggtttgttgcgggggtcgttattgttgttgcgggtagtcgagaagtattcgcggatttttaagtgcgcgcgttgtcgtaattatggcgtggtgtcggtttttaagggttataaacgttattgtcgttggaaggattgtttgtgcgttaagtgtacgtttatcgcggagcgttagcgtgttatggcggcgtaggtggcgttgcgtaggtagtaggcgtaggaggagaacgaggcgcgcgagttgtagttgttttacggtattgtcgaggggttggcgttggtcgtcgttaacggtattattttttcgaggttcgtttacgaggttttcggtttagtgtgcgtcgtcgacggcgggggatttggagcgggagcgttcgcggggatcggaggcggagtagttggcgtagggggtttaggtgagagcgcggttaggtcgtaggtaggggtagtaggatcgtagttttggggtacggggtttaggggtttgtttcggtttagaaagagtagaattttcgtgtttagtcgtcgcgattgttagggtttatcgttcgtttagtttcgggtatggagcgtgggtatagaaatttttttttttttcgtttttggagtatttgtattttattttttttttttgtatcgggtcgaaatgtatacgttttaatttttttattcgtttttatttaaacgtaggtaggtttttgtttttttgtttcgttttttttttaggtggaaatttgcgtattttcgttcgttttgcgtttttttataggttttttttttttgtttttttttaatttttttaaggaatttttttttttttaattgatattttaggttttgagacgttttaggttttgagacgttttagttttttttttttttttcgcgtttttaacgttttttggataatcgtttgttgcgttttttttttttttagtttttttcgtattttttttggttttttaggtttgtttttttatgttttttttttttcgttttttattgtttgtttagtattattttttttttttggattttcgtggttttttgtggggagggaagaaattaggttagagtcgttgagggaaaggagggattcgttttaaatttgggagggaagaattttttaggttttaattttggaaagggtggattagaaataggggttgtatttttgtttgtagagaagtttgggattttttagataattaaggcgtttttttttataggttgtattgttagggtaggtattttttatatagtgggtttttttgtatagcgtggttaggtagaagttatgttgttttttgtttgaattttggatttggttatttttttacggtagggtaggattggaagggtagttaagggtggaggtgttggggtatagacgtggggaaagtagtattgaatatcgagtttatagggtataggtagttggggttttgaggagtatagaaagagagggagttttggggttagggttgtaggggtttagagcggaaggaatgttagagtaaaaagaaagaggggtattggagtttagtgaataagggttgtggggttgagggagaggaaattgagatttaaagggtcgaggtgttgtgattgttgttttttagttaatcgttttttacgatacgttttttttttttttagaggttaagttgtagaagtttgatttgttttttaagacgttgttgtaggtaggtcgttcgggtagttcgttgtcgtcgtcggtgaagtttttattattcgacggcgtagattcggggttcgggacgtcgtttttagaggtgcggttcggtttaggttcggagaacggcgatggcgagtttttttttggttcgtttttagttcgggtttttaaagaggtaggtggtagttgtttaggtagcgttggttttggcggcggcggcgaggaggatagttcgggtttcgttagttttttgggttttgaattcggtttagaggttgataaagaagagggtgaggtcgcgtcggcgttagggttgggcggaggttcgggtttacggtagcggacgtcgttggatattttgatacgcgtgtttttaggttatcggcgaggcgttttggagttggtgttgtagggttgcggcggcgacgtggtgtaggttatcgagtaggtgttgaattattatcgtgggggtttggcggtcggtttgggttttgcggcgtttttagataaggtcgtcgtgggtgttgtagtagttgtagacgacgcgtggtttagtcgcgtcgacgtcgtcgtcgtcgtcgtcgtcgtcgtcggggggtttgggttgtttgcgtcgttgtaggcggggttcgtcgtattttcgtattatagatttttgttggtcggcgttatggcgtttggggcgttgggttcgttgagtagtcgttcggttttttcgtcgttgtagtttaacgttagttatttcggtgtcgacgcgggcgtttattcgttgggcgcgtcgttcggttttagttttttgcgtttggtttatttcgcggcggcggcgtatagtcgcggtttggtttttatggcgttttattttattgtcggtttggtgtttacgttcggttttcgtttatttatggattacgtttttagcgattttatgcgtgatcgttcggtcgtcgttgttgcggcggtgtataaggagtcgatttacggcggcggtttgtacgggtttatggttaacggcgtttcggagaagtagtagggcgaggggtttggtagtcggtcggtttttaaataggaattttagttttgttttcgcgggttatcgattttttttcgtttagcgttttttttgcgttttggttgggcgt

SEQ ID NO: 7325 - DNA, 824 bp, synthetic construct
  misc_feature 1..824: note = Description of Artificial Sequence: Synthetic polynucleotide
  source 1..824: mol_type = other DNA
cggagtcgttaggagtgagtatttttttttcgggatatttagtttcgcggcgtttttcgcgcgttttggttttatacggatttgttagttttagggaataaaagcggagttcgttcgttttttattgtagtcggaggatgagtcgagagggttgagcggagagtgtggttttcggcggttggaggtaggagaatatgttgcgttcgttcgtcgcggcgtgagaggttcgaggtgggcgcgtcggggtaggggcggtcgcgggcgtttgttcgtttagtgggcgttgttcggatttggcgaggtggtggtttgtaatattgtgttcgtattgtttattgtgggtcgggcgtcgagttttcgcggtcgcgagggagttttttgggtgggaattggaggtagtgggggaaaagtttggagttagaagttaggtagcggttgtcgcggcggttgtggagggttgtttgcggtatttggcggcgcgcgttttatcgcgaagagcgggaaggcggcggttgtagtgtgcgtaaagttttgggtggcgcgtaaaggcgtaggcgagggtcgtcgtatagagtcgtttaagttgtggtcggagcgttagggcgatttttgggaattttttaagcggaatttttcgagataagcggtttttgttttttgatattttagtcgaggtcgagttgacgcgtagttatttaattttttttgtttcggggaaataattttattcgcgtcgacgattggattttggttggttgggtagcgtcgagattttcggggggtttagttttgtggttttgagtattttttcgtttagttcgcgt

SEQ ID NO: 7326 - DNA, 824 bp, synthetic construct; identical to SEQ ID NO: 7325
  misc_feature 1..824: note = Description of Artificial Sequence: Synthetic polynucleotide
  source 1..824: mol_type = other DNA

SEQ ID NO: 7327 - DNA, 1415 bp, synthetic construct
  misc_feature 1..1415: note = Description of Artificial Sequence: Synthetic polynucleotide
  source 1..1415: mol_type = other DNA
cgtttaaaatgatttcgggcgttttatttaaagagacgttttggtttaggtagttcgttggggtcgaaggttttattttttttcgatttatcgggtttcgcggcggaagttttcgtttaggtaggggatgttttaggagggaaggaggcgacggtgtttaaggacgtcggaagtcggggattttcgtttttttcgggtttcggttaggttattagtgttggttcgcggcgcgggtgtttagttgcgtttgggatattgcgggtacggttgtggcggtaacggtagcggtcgtcgcgtcgtcgacgttcggtaggattgagcgtacggagcggcggaatttttcgtttttttacgtgtagagtagcggattgagcgcggatagggcgtagtataggagttagttggtcgtttgtattttttagggtatcggtagcgagaagtcgttggttaggtttatttatattagtggttgcgtggttagtaggaagacgtagtagagtagtagtatcgataggtcgttgagacgtcgttgtgttcgtcgcgggtgtagcgcgggcggtaggggttgggtttgcgtcgggtgcgcggcgttatcggggttcggcgcgtgttgggcgttcgggaaggcggcggcggcggcggcgtagtcgggtaattggtgtagtaggtggaagttgagtacgttgattcgtttgacgttgatacgtacgcggcgtacgatgtttaggtagtagtgtagtagtagagttgtttgcgttagtagcgtcgcggcggttagtagcgtcgggtagtggattcgcggtggcgcggcgtcgggtcgcggtgtttagggcgggagtagtagtacgaggtttagggcgagcgtttaggatagcgttagtatgttcgtcgtgtggcgtttttggtatagcgtttggtaggtggcgggcgttcgggtgatgagtaggtagcggtttagggttacgaggtagtgggagaggagggatatcgtgagttcgaggtttagtagtttatttcgtagtaggcggtagttgtttttagcgtcgttttagtttgcggggggtttcgtagagtcggtgggtaggagttcgagtatcgttttttgcggtatttagagggcgtagacgttgaggtcggcggcgtagtcgtttacgatgaaggcgttgttggtggtttgtagttttcggaaggacgatacgagatagatgattatgtcgttggttagcgtgttttcgatggttaggttcgaatataggagtgatatcgggatgcgtcggttcgtttacgatttttttttttcgtagagtagtagtagcgagttatcggtggtggaggaggtggatgtggaggaggagttggttattttggttaattttttatatttttttcgttagcgtcggtttttggtagcgcgg

SEQ ID NO: 7328 - DNA, 1415 bp, synthetic construct; identical to SEQ ID NO: 7327
  misc_feature 1..1415: note = Description of Artificial Sequence: Synthetic polynucleotide
  source 1..1415: mol_type = other DNA

SEQ ID NO: 7329 - DNA, 3039 bp, synthetic construct
  misc_feature 1..3039: note = Description of Artificial Sequence: Synthetic polynucleotide
  source 1..3039: mol_type = other DNA
cgggcgtttataggcggcgcgggtagcgcgagtttcggagtttcggaggtttgtgcgttttgagtcggtatggatttcgagtattgcgcgttttttcgcgtggggtttgtattcggtttttatgtggtttcgggggacgagttttcgggttcgtagggaattttcgtcgttgcgttttatttgtatttcgcgtcgtttcgcggttcgcggttgattcgtttttcggtttgcgggtttttggagttttattttttagagtcggttaagtcgttcgttaagtatttgtaggatttcgggttcggttcggtttttaacggcggttatttttacgagggtttcgcggaaggtaacgcgcggcgcggggcgtagcgcgtagttcgatttttttttttttttttttattcgggtttattcgggtttttttgtttatttttttcgttcgtttattttttaattttttgtttttttcgtttttcgttacggtttttacggaagtcgggttggcgttggttcgggttaggtaaaggttagtgtggggcgggagggtgaattatcgtttttcggcggcgggaatggaaggcgggaggtcgagggaaggtgtagtggcgacggttcggagtttagtcggggttcgaaagtagttggatttgggaaggagagagtatgttttgtcgaagttggattggaattgttatttattttgaagtttagattcggtcgagggttgtggagttatattgagatttgacgaagaagcgcggtttttgtgtttggcgttttttgagggttttgaggttgggttttaatttagagtggttaaatcggggtcggttggggattgcggtttggttttggttcgtttttttttttcgggtttagtttttataggaagggtgttgtttgtgcggtagattggtatagtttggtcgcgattggtcgtgtaatgttagggttgtttttaagacggaataattgtatttttattttttatattaagttggtttttttgtcgttatgtattatgatagtcgtttttttggtagttttggttttttcgcgttggattattatcgttgggtagttaggagtagttttgggtagtttaattttttggcgtcgcgggtttacgggtcggtgttttgtgttaaggtcggttggatcgcgtcggtattcgagaatgcgtttgaaggtaggggtttggtaggttgatcggtagttttgcggtcgttcgtcgtattttatgatttgtaaggcgtttcggttttcgtattgtatttattttatttgcgttgttatatttcgtagtttaggtttagaattggattttttaagattcgttttaattttttgtcgtcgttcggttggcgtttcgcgggtttttacggagtggtcgggtattttcggttttcgtttagtcggggcggtgggaatgtgtaggggagggcggggaggtgtgtgtgggttaacggaggaaatgaacgagttcgcggagtttcgtgtttgtgttttttgaaagaggtttttttgataaaaattatagttgggatttaatgagaagtagttggtttggtttttttgattttagttagacggtagaggtcgcgtagtgcggtgagtatcgttagagataggtattcggtttggtttagcgtttcgcgtcgggtaggagttatttttttaggttcgcgtttttgttaggcgcgtcgtattcggtatcgatagttcgggttttcggattatatcggtgtcgcgcgaattgtagagagcgttggtgcggaacgagcggtcgggagaaatttagtatttcgggattcgacggtaagggtggttttgataacgaaatatcgagaaagaaaattaaagaaagcgagcgataattaagaaaaggggaagggaaattgaataaaataacggagagcgcggcgagaacgagagggtaaatggtagtcggcgagttgggatgaattaaaatgaataaatgaggaacgaacgaataaaaaaagtaggagtaagatcgaacgaaacggataattagagaagggggaaaggataaagagggagggagtagattaaataaaagaaaacggagtatgtttaaagcgtagaatatattaaaatgagaataagggggtaagaaaattaacgattttagttgaacggaggataggttaaacgaaagggaggtaggcgggtgcgagtagagtttggtagagattttggcggtcgttagtttttggcgtttttgtcggtgtttaacgggttgttagcgtttttgcggtagagcggatttcggcgtagcgcggcgcgcggtggagtttggttgtttgaggatagttagtttttagggtcgtatagtttatttggtgggaagtggcgggcgaagagggaattcgttttatttttcggtttttaaaataatcggttcggagcgtttttagtttatacgagtgagcgcgtagttgcgttttatttgcggcgcgattttttacgaggttgggtagttgcgcgttttagagtttggcgtatttcgtttttttttcgtttgtagttcgtcgttcgcgtagttttaggtcgttttttgttgagagcgtttagttttgttttgaatttaggttgcgtgttggcgttgttagttattttcgcgtcgttcgcgtttggttagtttgtttcgagtttggttttgacgtcgaaatacgttttcggtaagagatttttattagagttttgttcgttgtcgttgaggttttgagtcggatgattcggtcgatcgttaaagtcgaggagagttttaagtttttagattcgggttgaggtttttgggttaacgttgagaatttttaagaagggtatcgaggttttatcggggttttgtttacggcgtttatgtttattttggttttgagttttcggcgggagttgtaggagtttgggttttagcgagttttgtaggtcgtttagtgattttatagtggtcggaggaaatagtgcggcgcgggataaggttgtagcgaaatgtgaaagttaaggttggtttcgcgg

SEQ ID NO: 7330 - DNA, 1277 bp, synthetic construct
  misc_feature 1..1277: note = Description of Artificial Sequence: Synthetic polynucleotide
  source 1..1277: mol_type = other DNA
cgcgtttttggggagcggtttatttatagtattgcgagtatttagtatcgttttagagtacggcgtatataggtataaatgtagtagaggtttttcgattcgttaggacggcgttttttttagatgggtattatacgtacgttttttgttttagttatttcgttttttagatgcgttttttacgagggaggaagggttttttgttagtttcgaatttagcgaggattagttttaggattgagaattaaatatttatttcgggcgtgatagttttgtttcgtttgttaatgttattgttaaggttataggtttgaggtcgagcggttggggttggggtttttagttgcgtaagaggtttttagtggaattgcgttttgggcgcgtagttttaagtcgcggatgggtcggataggtttttttcggtttttcgcgggcgtttgttttcgtagttaagtttaatttttttcggagtttttgggtttttttgagtattagaagttgaagttcggtgtttaattcgtgcgtacgtcgttggggatttcgatgcgcgaaggagagcgggtttcggggtttcgtcgttaggtaacggcggttggagcggcgagaggagttcgggacgagcgtagggtcgggcggatgcgggggtagcgtcgttttatattttggtttttagttttttttggttggggcggggttagaatagggaaagttgtagtggtcggttcggtaaagttaggcggggcgcggttagcgatttatttgttacgcgtgggtagtcgcgtagattcggttcgtgtatttcggtcgagtagttgcgattttcgacgggtcgcggacgtatagtttttttttcgggttataggttttcggttggggttggggcgattcggagttgcgcgtcggcgtacgcgatttcgttcgttttttattttttgttttattattagttttaatttggttttcgttcgtcgcgcgttcggggtttaggggagcggcgcggggatttaggttttacggcggagagagcgcgcgggattgcgaagattggggtcgagtgtcgttttttttgcgttttggtagcgtcggttttgcggagtagaacggagttgggcggagcgttgcgcgtattgttttttcgtttttcgaaaggttattttggcggcggggcgtcgtgacgtaggtttgatttacgcgcgggtcggcgttaatgcgaggttttcgggtagcgagcgaggttttgatggtcgacgtaggcggagagggtgggcgtggggcgg

SEQ ID NO: 7331 - DNA, 2394 bp, synthetic construct
  misc_feature 1..2394: note = Description of Artificial Sequence: Synthetic polynucleotide
  source 1..2394: mol_type = other DNA
cgttgtaaatgcgttaatatttcggttgttagcgtatggcgagcgttttttacgtttattcgtaggagcggcgtttcggtcgttttttcgtttttagtttgttttgttttcgtttttttttttttttcggttatggttatttttggacgtttgagttttatcgtgcgtagttttttagatttattcgagtaggacgcgtaatatttgtcgaggcgggagttagaattacgcgttttttagttcgatttttgcgtcgtttggttggattcggagcgcggttattatttttgtaagtgcgtggtggattgcggtgcggggtgggaggtaggaggcgtggggtagtagaattaagggtttagtttacgaggggtcggaaagtcgaaattttagtttagagtttagatttttttagttttggaaacgggagttttgttttcgaatttttaacgtatttatttcggtcggtatattttaagagtagatttttgtttggtattggtgtttcgagatttggggtttttgtgtttgacgatttttagaggtcggaataattgaaatttaaaacgcgtcgttatttgtcgtttttattttatttttcgttttttttttatgtttgaaaatacggttacgatttttaggttttcgtttgggatggttagtgttggcgagtttatttttatttcgtttttatttagggtttcgtaaatttcggtatattgtagtgtagtcgatttggaggaggtcggcgttggtgatttagtttgtgataaattggtcggttagcgtaattatcggtgcggatatgttaagagggtttcggggtgggttttttcggggtacgattttaggttcgttgatgatcgttgtggtatgaatgaggttatcgtattcggagaggtggatgtttagatgtggatttaggaaatggttttatttcgaaagtttcgggttagtgggcgtgttttttggttagtgtttttacgttcgcgttagaagggtagtaggttttcgtagggttcggcgttttatttattcgtgttttttttgttgtttttagtttcggacgagagtagtttggagattagttcgttagattcgtcgtagcggtcgttcgttaggttcgcgttttcgggttcggacgtcgagaaaaggaagaagcggcgggtgttattttttaaggcgtagacgttggagttggagcggcgttttcggtagtagcggtatttgtttgcgttcgagcgcgagtagttggcgagtttgtttcgttttacgtttacgtaggttaagatttggttttagaattatcgttataagttgaagcgcgttcgcgttttaggggcggcggagtcgtttgatttggtagtattcgtcgagttgtacgtcgcgttcggtttgttgcgtcgcgtggtggtgtcggtgtttgttcgcgacgggtagtcgtgcggcggcggcggcggtggcgaggtgggaatcgtcgcggtttaggagaagtgcggcgtttttttagtcgtcgtttgttttttgtcgggttattttgttttcggtttcggttcggcgtttggtttttttttcgtttattagtatttagtatttttcgttttggttttttggaattggtgaggtcgtagggcggtatttggggttattttcgattttggagcgcgttttgcgattggagtagggtcggagtcgaacgtttggaacgtttttcgttcgtttttttgtagttttatttttttgggcgttagggtttttggcgcgtttttattagtcgtcgcgtaagtatatacgagggacgtgtgttagagtttttttttttattttttttttatcgttagttttagagttagattttatgtttgggttttatttgtatatttttaaatagcgatttgtataggaagtaagttatttttttaaaaaatagagtattttttttcgtagttcgagaataaaatgtgtggggttgggttttttgcgcgtttgcggggaacgtaggcgggagtcgtgttttttagatcggtgttcgtatcgttggttcgttttttgattggttaagtggggttcggttttagttggatcgaagggcgggttgtagtttcgatacggttttaggaagatatttgggggatggaggggtggtgatgttagggttgggcgcgggaagaaaaggagaggaggaagttgaggtaattttgggatttttgttagcgggaggcgttattggttttagagtgatttcgatttttcgttgggtttttagagttgttggcgtttcgaatatcgaaaagttaattttgtggattacgatagggtagaaggagttttttcggagatgagtcggcgaggttaggtgcggggcgcgttgtatcggagtagtttaggtcgggtcgt

SEQ ID NO: 7332 - DNA, 1627 bp, synthetic construct
  misc_feature 1..1627: note = Description of Artificial Sequence: Synthetic polynucleotide
  source 1..1627: mol_type = other DNA
cgtttcgggtttggagggaggggaggtttttcggaaaggggtggcgagagattttcgttacgatttttaagttttttcgcgcgcgttggaggggatacggtgggcgtttaattttcggcgtagtagtaggttttataggttgtttgttggggtttggggaagtcgaaattgcgtatttcgggattcgggagtttttcgtagcgcggtttcggcgtggtgattgggaagcgtatattgtcgttagttagttagtcgtcgtcgtattggtttagtttcgaaaatttttaggcggcgtagaggtgtttaattttggttattacggcgtcgcgtcgtcggtacgtcgcgtgggttttagatagcgttagtcgttcgggtacgaagaatatttggtttggggattatagcgggttatcgatcgagggtagggtgggcggagaggggcggttgatatttaggaggcggagttggggtgcgggatcgtagaggtgttggatcgagtttgggtaagaggagttgggggatcgaggtaaaagtgtagggagggtttggagaggtgagttggagtttgggcgggcgggcgggttgatgggggggcggtgttttggagggattcggagattttgttttgattttaagttgaggtttatttttcgttttttatattttttagatttttttttaagattttgttttcgtttcgcgttttattcgttagcgcggaggtgaagtagaaggcgtcgtagcggtcgcgtattcggtcgcggggttcgtagttgcggatttcgggtcggtttcggtcgtcgtacggggcgcgtgcggtgagtatagggtagcgtacggagttttcgagtagttagttcgcgttatattagtttagattttcggtttaagttggcgggagacggcggaggtcggggataagaggcgttataggtaggagttagattgagttcgtttggcgttttttttcgggtttttgagatagtttcgcggggtttgggaagtgttgggttcggtcgtttattttggtagagttgggagtaggtggttaggcgttcgttttgtttttcgtacgtttgtttcgtttcgtagtaattgaattggtatcggtttcggttgggttggtacggaaatattatatttagggggtggcggggattttggggagggttagcggatgggagcggagggggaggaagggcggcgcggtttgggagagggagttggggtttttaggggtgcggaggagatattgggaaggagttttgggagatttaggcgaggcggattcgttgttatataggaatggggcgggagcggaagggttttattttttaagtttaaggttagcgttacgttttcgttttcgatgtcgttgatgagttcgtagcggtatcggttttcgttttttaggcgtacgttcgcgatgattagggaggcgtttagtcgatgtttttttcgtattttggcgcgtttttttaggggtttatattttcgggcgtgtagttcgttggtgatgaggattagcgtttttcggagttttttaggttttattttgttttagcgtattttgtagttgggaggcgtggtgtttaggacgtagggtagcgtggtcgtggttttacga

SEQ ID NO: 7333 - DNA, 271 bp, synthetic construct
  misc_feature 1..271: note = Description of Artificial Sequence: Synthetic polynucleotide
  source 1..271: mol_type = other DNA
cggttcgcggagttagcgtttttttcgcgtcgatttcgggtttcgggcggtcgtcggggggcgtcgggcgtatttttcgttgttaatttttcgttcgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgg

SEQ ID NO: 7334 - DNA, 884 bp, synthetic construct
  misc_feature 1..884: note = Description of Artificial Sequence: Synthetic polynucleotide
  source 1..884: mol_type = other DNA
cgtagtattttggcgaatttttttacgtttttggtgaagttgtttcgataaattcgaaatatatgttgtagcgttttttattgttggtcgttgaacgtgttttgggattaaggttttagagagcggacggtgttcgagtcgttgttttagttgtgcgtttgtagtttttttagttacgttaagtcgtcggtgcgcgtttagttgttattggcgaaggacgagatttggaggtagcggagggggaaaagtttttgcgggattgggagagaatgaagattggaggcgtgtagtaagtggtcgggagagtagttagtataaagagaaggaagaaagaaataagaggagatgagttttaggaggcggttgatgttagcgaattttgtgtcgcgttgttttttttcggagttagggagtagcgagttttttatttagatcgcgttagtgcgtttcgggttttattagtttttattaggcgttgtttttttcgtttttatttagtttttttttttcgttttttcgcgagtgtatttaagcgttttcgttttatttatttttagcgtttttttaagtttggaggagcgtttagagtagtagaaatagtaggtattttatatcgttcggcgtggggatttcgcggagcgtcgttgcgcgtcgttttttgatttgcgtatttttttttttcgtcgtttagtttacgttttttttcgttgggtgttagttaatttttaagtttagatttcggtagtttttttcgttgggtttgtcggcggtttgttgtttttgtcgaagggcgttttcgtttttagttgtgcgagttgtaaagaggtcggggttttaggaattttggcgtcgtcgtttattttagtaggttttataatcggcgt

SEQ ID NO: 7335 - DNA, 1007 bp, synthetic construct
  misc_feature 1..1007: note = Description of Artificial Sequence: Synthetic polynucleotide
  source 1..1007: mol_type = other DNA
cgcgggtttggttttaatttagtacgcggaggtttttttttttttagttttagcgaaagggcggcgggtgggaattattcgttattttggtaatttttttttgtcgtttgtttataatagtttgaattatatttttgttaggtagttattagttcgattttttttttttttagttttcgtttttttttttagcgtttaggttgggggcggcgtcggtgttagtttagtttagggcgaagtttttagggtcggttcgggtcgggttgcgggattcgtcgtggagcgtaaagtgtttgaagttttcgcgcgtattcggttttgtttttaaaggttttttagaaatgtaagaggttaggcgtagaaatatatacggacggtagttttatgagaaaatgtagataaagagttcggcggtagggttatatgttttttataatttttaaagtcgttattttaattagagttttttttgagttttaatgtttaattttgagtaaataagtcgttttgaaagaagaattcggtttttaattaaaagtgtattaatattttttttttttttaattttcgcggagtaaagtttcgcgcgggcggaggcgaggttaggtcgcggcgaggtcgtttcgggttcgcgtcgtttcgcgtcgtcgcgcgtttttaggtgacgttaggcgggttcgggattagggtttattttgcgtttttcgcgtcgcgtcgtagagttaattaaaagtaatgttacggtaaatttaaaggtttttcgttggcggagtcgcgttttcgggttagtttgcgagagagggtttttcgaggtaggtgttggggatttatttgtgtgtgagtgtgagtgtgtgtgtgtgtgttcgcgcgagcgtacgtgtgagcgtttgtgttgaaagggagagttttttggattttttggagatcgagattgttttttttttttcgtttatgtttttagtttttttcgtatatgtattagtgaagaaacgtacggatatcgtcgt

SEQ ID NO: 7336 - DNA, 2191 bp, synthetic construct
  misc_feature 1..2191: note = Description of Artificial Sequence: Synthetic polynucleotide
  source 1..2191: mol_type = other DNA
cgtcgcgttttgttcggttttatttattcggtggcgtttgggttcgttttagttttttatttttattttagggtattatttattagggtttcgtttcgttttagttttacgtgcggggttttatttcggcgttagcggttttttaaatatttttatttttatatattattttttttttattcggacggtagtcgaatagggataaaatttatggcgtatagttagtttttttcgcggagtacgttttgtgttgttttagtcgttggggttttttatttcgggttatagttttttggcgtttttcgggtcgaggtagtcgggtcgaggagtgtcggtgtggttcggttacggggcggggtcggcgggagtttcggtcgtcgtcgtcgtcgttgttgttttcgtttgttttttgggtcgttcgttcgttcgtcgttgggtgcgttgtacgcggggggtagtcgtggtgtagaggtttatgtagcggcggcggcggcggcggttgttgttgttgtcgtcgcggaggtagatagatcgggcgttgttatcgtcgttttttttcggttttatgtcgtcgtcgttgtcgttttttttttttcggcgaggggcggggggtttcggttcggggtgggtattatttttcgtagcgtcgtttttttttttgtttttcgttcgggcgttggagtcggcgagggtattcgtcgttttttaggagtgtatttttcgcgcgttttgtcggagcgagggggcgggcgtgggcggacgtcggggtagcggggatttcgcgcggttgtaagaggagggggtttttttaaggatgttcggcggtttttcgtttttaggtgcgagttgagtttgatcgggagcgagcggcgcgtcgttatgtcggcgtgacgggcgttttcggttgttcgcgcgggttttcgcgttgttttacgtcgcgtcgtgtcggtatcgggttgtaggatgggttgtatttaaagtattatttgtaaggcgcggattcggcgcgagaatatcgtggtgtacgatgtgtgcgttattatcgattagtgttttacgcgtatcgaggagatttcgtttatcgttttgcgttataagattttttattttaaagttttcgttcgcgtggttatgttttttatttttcgttacgagatttgggtggtgggttggatttaggcgtgtaattagatggagttttttaatatttatagcgatttgggtatgtaagcgattcgtcgcgcggtacgggagcggattttgggtttttagttttgtttgttattttgatttttttttttagtttttttttattgttgtttttatcgtttttttaaatttttttttcgtttttttttttattttttttttttttacgtttttgttttagtgatagggcgggtgtagggaggttttttgcgaaggtattttttcgtggtttgtttttgattttttagaaacgcgaggagaaaggtgcggggcgggaagaacgcgataaggagggttcgagaggcggaggtggggatggttggcgagtgtttggcgagttttagggcgtcgtttgtgttttgtggggtttttcgggaagagtttgggggaaattatagaggagtggagtggagtgtcgggggcgtatgggttgtgtcgcgcgttttttggagaaatcggagcgggtttggaagagtaggtttcgggtattcgagcgggagttggtagttttgtttttgttttcgcgattgttgaagtttcgaatttttgtttttcgggttagggagttcggaggcgttttcgtttggaattataagtcggatatagttgtttttttgttttcgcgttttttggattagttttggtggggagttggaaggtatcgagtgcgtttcggttaagaagggcggatagttttgtgcgagtagcgttcggttggcgcggcgcggggtgttttttatgttaaaggaaaggatggattttttgtttgtttagggtttttattttttaaaatttttttaattgcggtattggaagggatttttttggcgtttatcgtcgaattttatcggcgagttgggagttttttaatttttagtagcgtcggttggtgcgcgtcgggtttggttgttgcggtgaagattaaggatcgtcgcggttttttaatcgttaggggtcgtaggttacgggcggtcgcgttcgg

SEQ ID NO: 7337 - DNA, 859 bp, synthetic construct
  misc_feature 1..859: note = Description of Artificial Sequence: Synthetic polynucleotide
  source 1..859: mol_type = other DNA
cggcgcgttacgtagggaggttgttcggggttggcgcgtatcgagggggtgggggtcgagttcggggcggatttttttttcgatttttcgattggaggatagggaggaaatggttttgtatcgtacgatgaaaggtaggtaggagggttattaggcggggggtggtaggggacggaggatgtttagagttggaggatttcgttcgttttacggatatcgttattttgttttttattttattttgttttttattttatcgtagcgtttggtttatttattttttggttttcgttgttcgtttacgttttaacggttcgtagcggggtcgttttattgtcgtatttttatttcgcgttttgcgcgtttatttgtttacgaagttttcgagtatcgagtttttgtcggcgttttggtcgtttattacggcgatttgcggtagttttagtaggtagttttgttttagcgtcgaaaacgcgttttgtagacggtttattagcgggattagtttttttatttttcggttttttattttgttcgaggggtcggcgattagttggtttttgttcgtttttacgatttgatagggagtaggggtcgcgttgttttggttgttgttgttgcgtcgggtttagttagttaggttttggcgtagacgtcggagttcgtcgttagttcgtcgtttggttttgatagttaacgattcgtagcgcgtttgcgcgggcgggtaggggcgtggtttattttcgcgacgtttcgttttcgtttcgcggttgtttcgtttcgggttttttatcggattattaggttaggcgcgtacgtattgtagtttagttgcggttagatgttacggtttttgcgt

SEQ ID NO: 7338 - DNA, 791 bp, synthetic construct
  misc_feature 1..791: note = Description of Artificial Sequence: Synthetic polynucleotide
  source 1..791: mol_type = other DNA
cgcgcgattgtagttttggggggcgcgttcggaatcgaaatggtttaagagatttgaggatcggcgcgtttttttttttcggttttagtttttaattttcgttatagcgtagagggggtagtgcggtgggagggggggagttgtggggttggggtttcggtttggtcggtgaagttttaggattcgttcgtttggggttaaggtaaggggtgcggtacgaggagcgtagggagtttcgagttttaggcgtagatttagttgcggattcgtcgtatagttttggtgttgtaagcgtggatcgtgggcgtaaggtttcggcgggaggtattcggttcggtcgcggtcgggtttgtagggttttggcgtagcggatttcggcgcgttttggttcgcggttcgtagggtttagacggggtcgagatagttaagttcggttcgttcgcgttaggcgttggagttaaggttgacgggcggttttgaattatgtttggaggagcggcgcggtttttagggtttcgttgagacgcgttgtagggttgttcgggttttttttcggcgacgcggttagtagttcgcgtcgcgtttttagcggcggtaaaaattaggagtttcggggttttgtcgggcgtcggtattggagggtaagagatgttggtttttttcggggtttattatttcggggttttatagtatttacgtgggatggggatttcggagtagattacggacggaaaggaacggtggttttattttttgtaaaagaaattttcgcgcgtatacgggtgtttcgg

SEQ ID NO: 7339 - DNA, 586 bp, synthetic construct
  misc_feature 1..586: note = Description of Artificial Sequence: Synthetic polynucleotide
  source 1..586: mol_type = other DNA
cgggttgcgcgtttcgagttgtacgggtaggtatttttttcggttttgttttataaggtggggagagcggggttggacgcgggagggggcgggggggggagcgtgagaagaaacgaaatcgcgggaaggaggggatatcggcgggttgggtagagggcgaggcggaggttaagttgggtttgggcgtcgtcgttttcgcgcgcgtttgttgtcgggttcgggttattcggagagcgcgggcgattcgggtttcgcgtttgttcgtcgtcgtcgtcgtcgtcgtcgtcgttacgcgtttagtttcgggttgttcgttggttcggtttcggtacggcgcggcgcgggggcggtgggtgtagttttagttgtcgtgcgtttcggcgtttttgtgcgcgagtttcgtttagttttttttcgtatgtttttgtgtgttttttttcgtaatgtttttcgtgtttcgcggggggtgtgtggtacggttcgggcgttcgtagttttgtagtttttcgttgtttttttttttcggttcgtttttgtcgttttttgtcggttcgttttttttttttcggaattttttttttttcgt

SEQ ID NO: 7340 - DNA, 1678 bp, synthetic construct
  misc_feature 1..1678: note = Description of Artificial Sequence: Synthetic polynucleotide
  source 1..1678: mol_type = other DNA
cgggatcgacggcggcgtttttttttcgtttttcgtcggtaggagaggacggggcgggagaggaaggggttagttgtggttgtagtcgttatttttcggcgttcgggattcgggacgtttagtcgggttttgtagagggtgttttatttgggtattagcggtttttcgtttttagttagggtatcgaaggcgcgttcggcgggatgtagcgaattgttttttgtttcgggatagtggagcggtagaaggtttaatttttcggttcgtttacgttcgtaaggtggaaaaagtggggtgaaatcggggaaatttagcgaaattggggcgaaagaagagagattaaagcgtgttatttacgtgttagatggcgaagaagatgagcgtagcgtatagtattagagatagtatgtagtagaacgtagcgaaagtgaaggttatggtcggcggattttaattttattatatacgttaagaagtttttaggagttcgatgtttttttagaggatcgtattttttttaaggagtcgcgtttgtacgtttttttttaggttagtgtttaggagggcgtatagttagcgaagcgattcgagggttagcgaataagcgttggattttcgtaggtttcggcgattttagattcggtttttcggcgaagataggaaaacgtgtgtcgagagtcgttggagggaatcgttcgtaaatcgaagaagaaattaaattagtagcgaatatttgtaaattagtgttaagttgtgagtttttcgagattaatacgataagcgatgcgacgattttacggaggatcgagggaggaggttttattcgttttaggaagagttttttgtttttttttattaaatcgttgaggagagacgagcgtttcgtttcggattttttcgcgttatcggggcgtaaacggatagtgtttagcgaggtgttcgagcggttttcgagttttttttaaattttagagtcgggtagcgttttttttcgagagaaggagtttttaggtagtcgggaggaggtaggtttcgttggttttgcgttttagacgcggtttttagcgtagtcgtgcgtttcgaggcgcgttcgtttttaatcgtgatttcggttagtcggttttcgtaatttaagtgtttcggaaatcgggggtcggatcggggcgagtattggttttatttaacgggttaattttagttcgggtggttgtagtagtgggttttaggttaaacgttgtagttcgttttatttgttgttgtcgttgtcgtcgtcgtcgtcgtcgtttttgttattgcgagaattgtagcggtgcgattcgggatttttttttttcggcgttttattttcgatttttgtttcgttgagcgcgtttttttcggcgggcggagattgtagcgtcgggggttgaggaaaggtgggtggcgaagcgtcgtcgggcgtttggtggtcgttgtcgtcgttattgtagttgtgtacgttcgtttttcggaggaaatttgaagttagtagtataagtagggttggaggtcgagcggaggtggggcgggatcggttggagtagggattttttaaatacgtgcgtttggaggaggtgggaagttgcggaagggtatggtgtgtgtttcgcgtttaaacgtcgtagtcgtttttttcggtttttgtagtttcgtttatcgg

SEQ ID NO: 7341 - DNA, 1600 bp, synthetic construct
  misc_feature 1..1600: note = Description of Artificial Sequence: Synthetic polynucleotide
  source 1..1600: mol_type = other DNA
cgagacggagttagtatttgattagcgattaatagtggatcggcgaggcgggtttttaattagagcgagatttttagaagttggatagtttttgtatttatgggagtatgcggcgtagttggtagtgatttttaggaaatttcggtagtagtcgtcgtcgcgggtgtggtgatttcgggttcgtcgtttatttggagcgtttcggcggcgtttggtttagaattatcggggcggatagttttttggagttgtacgcggattgcggaaggggatagtgagcgggatcggttcgtatttcgttcgcgggttcggatcgttggaagtattcgggtttttttttttttttgtttttcggtttcgttttttttttttcgcgttgcgcgtggcggtttcgggttgcgcgtttttgtaggaggagatcggtattgtcgtcggcggttttttttttaatcgttagtttcggtcgcgcgtttcgtttcgtttcgcggaggagggtgggggcgtttttcgcgtcgggttcgtttagttttttcgcggttgttcgggtcgggttttttattggtcggcgggcgggaggtgaggggcggtagggttcgtttttggcggttcgcgttcgggaaggtcggtagtcgagcgtcggaggtcgtggagagggcgggtagggaggcggcgggcgtcgaggagatgtagcggcggcggtggtggcggtggtggcggcggtggcggcggcggcgtttggtttcggtcgtagtttttgcgtttcgttcgttttgggtcgtttttgttagtttcgcgcgcggttcgtttttcgtcgcggttcgtagtttgcggcgttcgagtttcgagggcgttttttcgggcgttgggttcgaggcggttaagacggcgggtcggtcgggtacggggcggcgggcgttgtgttgcgggttgcgttggtggggggcggcgggtcgcggcgcgggtttagggttcggcgtgtgcggttgggaggtattgtgggggcgggcgcgcgggcggcggtcggggttatggtcgagggcggcgggggcgcgcggaggagggcgtcggcgttgttcgaggttgttcgcgcgcgttacgagagtttgtatatttcggacgacgtgttcggcgagttcggttcggatagcggcgggaattttttttatagtatttcggtcgtttcgcgttttttttcggtcgttttttcggacgacgagcgcgagttttcgggatttttaggggtcgtttcgttatcgtttcgcgtttcggacgtataggagtcggaggaggacgaggtcggcgcgggttggagcgtagcgttgcgggatcgttcgttttcgcgtttcgaggatatcggcggtaaggggttgttcgcgggtggatgtcgggggcggcgttggaatcgggcgcgggggaggcgtgggtgttggggcgggcgagtttagatttttcgtgggttggtttgtgggtgttttttcggaaataaatgaggttgtaggagcggtgatcggtttgattgtttttgggggtttcgaattcgtgggtggagagggtaaggcggaggtcgtggttagtatttttttagtgataatgtcgtcgg

SEQ ID NO: 7342 - DNA, 2394 bp, synthetic construct; identical to SEQ ID NO: 7331
  misc_feature 1..2394: note = Description of Artificial Sequence: Synthetic polynucleotide
  source 1..2394: mol_type = other DNA

SEQ ID NO: 7343 - DNA, 1160 bp, synthetic construct
  misc_feature 1..1160: note = Description of Artificial Sequence: Synthetic polynucleotide
  source 1..1160: mol_type = other DNA
cgtaggattcgtttttcgatggacgtgagttttatcggttcgttggtgagattttttacggagcgcgattattttagattttttttaatcgtttcgtttattattaagtatttgagttgtcggagttgggggttgatgtcggatagttttcgggggttgacgttcggtgatttttttatgttattgcggtcgtaggcgttacgggtaggtgggtgggtagggggagtatggatagagaggaggggattcgtgaggagtagattttagggcgagagtaagagcgcggtcggggtttttcgggggcgagcgtcgcggtagagttcgcgttttttttttttcgtcgttatttatttattttttcgggtagttgtttttagtgttttattttgggcgtttcggggtagtgcgggttggggcgagtggcgagggaaagaatgattgaaatttttcgagtagttttatcgcgcgcgtcgttttttttcgagttttagattgtttagtgttttagttgtaaagggttatttcggcgtttcggtttttcgttcgtcggttcgtttatttacgttcggggcgttatttatacggtaatgtttttgtttttgggtgcgtcgttgggaaattttcgaatttttataggtaaagatagagtgggatcggtagtttttagatttgaggcggaggggtcgcgggtcggagttttttgtagtcgttagtttgggaagattggagtgcgttgtttatcgagggtttgcgtcgcgtcggtcgtttcgggtcgttttgtgcgcgttcgcgcggtttgtattcgagcgttttcgcggcgtgcggtacgatgtaggcgcggcggtttagttcggtgattttaggtcggttcgcgcgttcgtcgtaacgattcggtagtcgaggtagcgtcgcgttttacgttcgttatcgtcgtcgtcgttttagtatatcgtaggcgtgagtttcgtcgcgatcgggagagtttttttagttgtgcgttttcgaggtatttggtcgggcggggaggcgtcgggtcggggcgtataggggttaggcgggggcgttgttgtttatttttcgtttttcgggcgtgcgtttcgtttcggagttcgtatttcgcgttcgcgtttcgtttggaagttttggggtatcggacgcgt

SEQ ID NO: 7344 - DNA, 588 bp, synthetic construct
  misc_feature 1..588: note = Description of Artificial Sequence: Synthetic polynucleotide
  source 1..588: mol_type = other DNA
cgtaggcggcggcgttttgtattgcggagtcgcgttttgggggagtagtatttttagtttcggcgtttcgtagttagatagttttttttagggtggtagtatttttcggttagggtgtagggattttcggggcgaggcggtcgcgtattattttttattttggtaagggttaggatcggattgttgtaggcgttgagcggggttattcgggtcgagtgtttttttatgatgagtcggtcgtttgtaggagcgttgtcgtcgatcgtttatattttggggtcggttggagcgcgtttttttcgggttcgtggtcgacgcggttttttgtcgtcggggagtattagcggttcgttttttttagtttcggttttttcggttgttcgtcgggtttcggttgtcgcgttgtttattgcggcggtcgttttgtagcgtatatttttttcggtcgcgtagttattttatatatacgcgcgtatagttttttatttggaggttgttgtaaattttaacgttacgtataagtgtattttttgtttttatttcgtagtttatttgtttcgttttttttttcgggacgtttagtttcgt

SEQ ID NO: 7345 - DNA, 878 bp, synthetic construct
  misc_feature 1..878: note = Description of Artificial Sequence: Synthetic polynucleotide
  source 1..878: mol_type = other DNA
cgggaggcgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcgttcgcggggttggattgggagtttcgtgcgatttcgggtttggcgtttgggtcgggggtggttttcgggtttttttcgggggtcgtcgaggttcggtttcgatagttttgcggttgttgcgagcgtttttcgagttttcgtttcgcggtgttcgttttaggagcgggcgcggcgttgtgtttttttatttgcgcgtagagggtcgttcggtgaagttatggcggcgggttaggggtaaacgagcgttcgagcggggttggtaggttttcggggcgcgggaggatcgtgggattacggggatgaaaagttttgcggtttcgacgcgtttggagtaaatcgtggttttgcgcgtttttgttttttttcgtttttttttttttttttttttttttttttcgttttttttacgagtttattttttgttttggtaattagtaaagttttttcgttgcgcgtttttcggtatttttttttagaggcgcggggcgggagtcggggtgtcgcgattcggggttgggacgtaaggcggggtttcgagtgtttcgggcgtttttagcgtttagagcgcgcgttttgttcggtatttacgtttttttgggcgggttttagcggggggttgatacgattgtcgttcgggatagattgcgagcgaaggattggttttaagaaacggttgtagtcgcgggtcgt

SEQ ID NO: 7346 - DNA, 561 bp, synthetic construct
  misc_feature 1..561: note = Description of Artificial Sequence: Synthetic polynucleotide
  source 1..561: mol_type = other DNA
cgagtgggcgcgaatttttatagtagcgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcggattcgggggtttttttgtttgtagttttttgttttaatgatcgggttgcggggaggggagggtaggtttttttttaggtttttggtttttgtcgattcgatttgtttatttgcgtttttcggtagggtttatttgtacggggttttggaggtgtttgtgtagagtgagtacgaaggggaagtgttattagcgtggtttcgagtaatttggcgttgtatggtagtgggttttagagcggcgtttgttcgcgtttttgggggttgttttatttagtttaaaaattagtaaattaacgaatgagtaaagttggcgtcgttagcgattagcgtggattcgcgt

SEQ ID NO: 7347 - DNA, 1235 bp, synthetic construct
  misc_feature 1..1235: note = Description of Artificial Sequence: Synthetic polynucleotide
  source 1..1235: mol_type = other DNA
cgagttgagttgttcgcgaggttgcggtaggaggtttcgttttttcgggtagggttttttttggaggttttttcggttttttttagacgtattcgcgtcgcgtttttgtttttcgggagtagtttttttttagtcgtcggttttgggagttttatcgtttaaacgggagttgagtttgtaagcggttaggcggcggtgcggttggtgttgttgttgatgttagagttagaaagtagttgtgattggatttaattagacgttgttgtagtaaatagataagttttttgcgtgattggttttaaagtggttggtgttaaataattagtagaggcgtaaaagtagtttttttgcgttgggagtttagagtaggaggtagagttcgcgggaagttcggagtatttaggacgtcgcgcgttttttttcgttttttttgattagggagtagttcgttttaggcgtttagtcgaggtttttagtttagtgggagtaagttatagagaataattcgagagatagagagacggagcgcgtttttttgtttagttttgaaaagtgagtcgttttcgggtttgtaattttaagtttcgtagtagcggcggcggcggttgtcgggaaggaggtaggtgtaggtgtaggagggaggcggttttgggtttcgcgtttgggtttcggttatggtttcggttttggggagcggtagagggtttggagggttgagtagttaatttaaatgtaagtttaagaggaggaggaggcggaggtttaagcggaaaggtaaggatcgcgtggcgcgtcggtttttgtttttttttattttcggtttttttatttcggttttttatggggttttcgggtttgttcgttgtgagtagttttattttggggtgttggcgggatggttgtttcgtgtagggcgttcgggagtttagatttcgtggaaatgtttggggtttttttttgtttagaggggatagtgagtagttacgttgcgatatgtttgagggattcggacgaagtggggcgagggcggcgaggagtttttcggggatttcgcgcgttttcgggtttcgtagtttttagtggtcggtcgggttggtattgttttttatttttcggaggttatttcgttttttagtgttaaaggaattatttaaaaacgggggaacgagttttcgcgttagttatttttatttaaattgtttcggaggaagggataggcgaagttttgcgatcgt

SEQ ID NO: 7348 - DNA, 5964 bp, synthetic construct
  misc_feature 1..5964: note = Description of Artificial Sequence: Synthetic polynucleotide
  source 1..5964: mol_type = other DNA
cgcggtggttggttgtagtttacgtttttacgatttttgtagaaggaaattacgttttttttttttttttcgtatttttatttttattttaagttttcgggaagttttgcgttggtattagggtaagcgtttgtcggttttcgggagttaagcgaggtcgcgcggtttgggacgtaaatgggagggagtagtcgttgtcgttttgcggggttagggttattgggtaggcgtagcgcgggttaagagtgggaggtttagggtaggggattcgtattcggggttatttttgtcgcggcgcgttttgcgttttagtagtgtatagggtggggatttttcgaggatagtggtgcgtcgacgggtttttcggtttttttttttttataggtttcgttgtgtggtgaaggagttagaagaggcgatttgggtgttgagattcggggttaaatcgtggagagtgtttggagtttatattttagatttttggacgtcgtagttagtttagtaggttttatttggagtcgtttcggggtttaatcgggaggtagcggggtgtaggcgagagggttaatgcgttcggttcggttggtttgaggagtttttgtttttagcgatttatagggtagagagtttagggtttcggtttgatgtttttaatagttggggattggagagttggaggggtcgtagatttaggttagagtttaaagtgcgtcgcgcggcgagtcgttggatttttttgggttttacgtggtttttgtgttatatggagtgataggtcggcggaaggcgttttagtcgtcgtttagcgttttttaaggtgtaaggaggtaggatttttttatattggcggcgtagggggttttacggttgcggacgttcgttttggattttttagttcggtagattttttgggtggagaggcgttttttagggtcgcggcgaaggagagcggtttttcggtacgttttttcgtattttttttagattagtttcggttttatcgtttaggagagggttcgtttgaggatttttgtttgtgtcgcgcgtggttagtttcggtttttttattttatggttggtttttagttttttagagcggatatttttttttagggatgtagggcgaggaagggcgggtggagttgcgaatttacggggatttggaggattttttggttttttggagaggggtattatgagagggatttatgggatatagatttgggggattgggtaattttattttttttggtaattataaaaattttgagtaaacgtgtttattcgttatttcgtagaaatatataatgtaggtttatataggtatttttgcgaggttttttagttaagggcgtagcgtttttcggaagtttttggttttgttattagggcgttatcggttttttcgtattggggatatttcgtttgggttttgcgtagtcgttgtatttaaggttttgggagtttcgcgtttttttttaggcgttcgggataaagtgttcgagggtttcgtagacgtttagttttgttcggggtttacggtcgtcggggttttttaacggatcgtcgagggttacgttttgttggggtgtgagcgacgatttttttttcgttttatgaggttcgttattagttaggtgttttatgagacgtcgtggcgagtacggttatttggtagttcgttcgggtagttttaatttaattttttgtttttcggggtatttttttttcgaatagtttttttcggtttttttagttttgtttaaggggtttggaaatgttcgtagttttaagaaaggttttatttaagtataggatggggtggggcgggcggggttaagattgttttggggattgaatttattttcgtttttagcgattttcggcggataaagcgtaagtttgtgtatacggtcgattgagttattggaaatttagtttacgaatcgtagttagggaaacgggagtttgtttagttgtttttgcggaggggtgtgcggaaacgttcgcgatgggaattttttgtagattatgtatggagggagtttataaaaaggaggaaggggagcgcggtggggaggaggtcgcgtgggcgtggaaggttttagggttttgggggtgttcgtttgtttaggcgtagggaatggcgcggagttggttggggaaggagtcgattacgtttcgtaggttaattggtttaagaaattttgtaagcgttggaaaaggtcgttgaaggagttcgttgtacgcgtacgtatatatatatatatatatataaaattttaaaaaaaaaaaaaaaaaaaaaaaaaaaagagcgtcgagtatgcgtatagagaggatgttatattggaatgagttgtagtgggagtcggaggatcggagcgggcgcgcgagggaggcggcgggcggggagcgagcgggtaagggcgggcgagcgagtaagcgagcgaggtcggtgttttttcgggcggcgatcggggtttgggtttacgtcgagggtaggacgaattttattaggtaggacgtcgcgtcggttgttgttttcggcgtttaggttggtcggagagtagtttttcggttcgtaggttgagtgcgttggttaggggttttttttagtttaggaaaaaaaaggaaaaaaaaaaaaaggaaggaagtttgagggagttggggttggaggtggcgggtgggggaaggttggggagggtgtaggggagcgaaagagaagggtaggagaagaaagcgattgtatttgagcgaagttttaaatttttttgtgcgttttaggttgttatttttgtttttcgggtttttttcgtttgcgttttcgggttcggaaaagtcgagtcgtgcgggagttcgttcggagttgtaaagtgtttttttttttcgggcgtagtttgttttttttcgtcgtttatttttttcgtttttgtatttattttagcgacgtagtcgtcgttgttatttatttcgcgttttcgcgtttttttcgcgttggggtttttttttttttttggtttgggtgggagaaaaagatggtgaggacggggaatcggagatcggtatgggggtaaaaatcgtgtagatattcggaatcgtttttttggaaatatttgtttgagtaattgaaataaaattggtagtagtagttttggagcgtgttttagcgaggatggtttttttgtttattattttttttttaaagtaatattttgttatttaggggtttttcggttgtttttttttattcgatttttttttaaaattgttgatttgagttggttttggagtttattttttaatatgcgtgcgtgggtatgtgtatgtgtgtgtatgttttgtagaaattcgttaaaatgtaattgtaggaattgcgagatgtatttattgattttgattaggggcggtgggaaggggttggagggagttgggggattttggagggtgggaagtggttgattttcggtggtcggatatttatttagagtttgattcgtattcgtgtttttttggaagcgttataattgcggggaaggagtttttagaaatcgtgttagttttaatatggcgggttaaggtggtttttaaaaattgaaaataaaggttttgaggtgggaaaaaatttagttgaagtttttattttttagtttcgattttttttggttattttaggaagcgttttagcgaattaagtggggaaaaaaagaaggaatgggttgttcggtttttttttttcgtggttagagtttgtgtgttaagtttattgttaggggggaaagggatggagaagtgtttttggttcggattagggtatcgaaacgtaattgtcgtgtgtgtttgtggattagtgtgtaggtttgcgtgtgcgtagtttttttgggtgtgtgtgttaaagagaattatttcgaatgtgtgtgtgcgttttggaattagattttgttatgatttgacgtgataaattgcggatacgtggtgtaaagtatatgagggtagagggagtgatttattttgtttttttaggagacgagttagttttcgttttgtgtgtgttggattttgcgcgggtagattttcgagtaggtggggcgaggaggtgtttattaaaaggattaattgtttcgggtattgggtgtaatcgggttgtagacgttagtcggatttcgtgtgtgtagggggcgcgttgtatttaatagtgggtttttgtttttttttacgtcgttttggggtgggaggtgggggatcgggatcgaagtttggagaagattaaagtggtggtggtggtggtggggtggggtagaagggcgggagcgcgcggttttgggagataagtacgtagggtcgaggcgaggggttgttttttttatttttgggtttcgcgttttagggaaggtgggggatggggatagcgtttggggaagaaattgttttttgttcggtttaggaattttttcggcgtatcggagaggggtatttttttgttttggcgggtatggaggtcgggtagtcgtcgggggatgtgagtgggcggcgaagtgcgggggaaaggtcggcgttttagggcggggaggatttgggagtggagttcggagataaaatcggggttaggtagaggagttagagggaaagttagtaaacgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcgtgttgttagtgggtgggggtcgggagtaagcggtattggtttggagatttcgcggtaggtgattttttttatttgggtagcgaggttgaacgatggcgatacgtcggttaggacgcgttcgtggtttttttagtttgcgtttgggcgcgttttttcggggtcggtttttttatgggtttcgcgaggtggggagtagtttaaaatggttttgtgttgcgaagttgtagttttagtcgcgaatttttttttttgtttttttgacgtcgtcgttgataagcgtaatttgttttaaggtttcgaaattcgcgattttgtacgaggtcgtgtcgtggaagcggatgtatagttgattataaagaatattttatagggttttcgaagggtttaagtttttttttttggtggggaggagggaggagtcgagattgggtaggagttcggtcgattatcgttttggtatttaggggttcggggcgtattagtagttggggttggggatttggatgcgcgaaaagtcgagggagttttcggggacgcggatggggattattcggggtaatagttacggatatcggtgttcgtggttgatggcgtttgtggtgttcgagaatttcgggacgacgttggaaagtttgggagatcgtttttaaatttttggagattagttcgtagtttcgttttcggaatttttaggatttttgggtttttaaagttgggtgggattttaagaaggtaaggcgaggttcgtggttttgacgatcggtcgttcgatttttcgtttattttagttttttttattttgtttttttgaattttgtcgaatcgagtcgggtttggggtttcggggtttcgcgtattaattttagtcgcgttttgagggttttcgtagtatagtcgcggttgattcgaggttattggtgggaaattaatttagacgaggtcgattttttttggatttggttcggttgtcgt

SEQ ID NO: 7349 - DNA, 5964 bp, synthetic construct; identical to SEQ ID NO: 7348
  misc_feature 1..5964: note = Description of Artificial Sequence: Synthetic polynucleotide
  source 1..5964: mol_type = other DNA

SEQ ID NO: 7350 - DNA, 5964 bp, synthetic construct; identical to SEQ ID NO: 7348
  misc_feature 1..5964: note = Description of Artificial Sequence: Synthetic polynucleotide
  source 1..5964: mol_type = other DNA

SEQ ID NO: 7351 - DNA, 703 bp, synthetic construct
  misc_feature 1..703: note = Description of Artificial Sequence: Synthetic polynucleotide
  source 1..703: mol_type = other DNA
cgtttggggattttcgtgttgggtatttcgtacgttttggacgcgcgtagttttatcgggagcgaattttgtttcgtttgcgggtgttacggagaggggttgggaagtcgagttagttttggcggcgattgggggcgtttttggttttttgggggggcgggggcgcgtattgttgtttaggatcgggcggcgggcggtggcggcggcggtggcgcgcggtggtcgtttagtattcgatttagtagcgcgtcggggattggttcggggcgcgttgggcgtattatgcggcgggtcgggcgcgggcgaggggcgggtcggcggcggggtttattggcgtcgggttaggttcggcgcgagaggcgcgagcgggttatgggttgacgtcgagggtttgcggcgggggcggcggcggggacggggcgggggttcgttagttgcgggcgttaaggtcgtttagtaggttaagggttttcgttcgggcgaatgggacgttcgtttcggggtattagtcgtttgtagttagaagtttttcggattttttggaagcgtaaaaaataaaaggtaatgtgtttttgtttttcggtcgcggtggtagggaggcgattgacggtagtttttcgtttttcgtgtttttacgttgggtcggggaaaagggacgcgtcgttgtttttttattgggggtttggagtcgtttatttcgcgt

SEQ ID NO: 7352 - DNA, 1315 bp, synthetic construct
  misc_feature 1..1315: note = Description of Artificial Sequence: Synthetic polynucleotide
  source 1..1315: mol_type = other DNA
cgtgggcgttcgggggattcgcgggtattcgggacgaggcgagggcgtagaaaatttggagtttaattagtacggagttgagttttcgcgttttaatttttaggtgatttcgtgcggcggcggcggtagtagtagtggtagcggcgatcggagttcgtagtagtttcgagcgttttcgggaggataggcggcgagttcggcgaatcgttatttgttagtcgatcgcggcgtttcgcgggtcggggtcgggagttcggggcgagttcgaacgcggtttttttttcgttcgtcgcggagattttgtcgggtgggttgcgggcgtttttcgttgtcgtttgtgaacgttgtgggtgcgcggggttgcggttacggcggcggtggcggcggcggcgggagtcgcgagtcggggtcgttcgggttgtgtttcgtttcggtagtagcggtggcggcggcgtttgtggtttaggatgcggtcggggggcgtattgttcgttttgttcgttagtttgttgttgttgttgttgttgtgtttgttttggtgttcggtagacgcgttcggtcgcgttaggtaatttatttattcgtcggtcgcgtttcgcgtcgcgcgtttcgtttggcgttttcggatttttaagtcgtttatcgttttttttcgggcgcggagatttttggtcgcggcggggagtagtttacgggcggcgacggtttgagagtggagtgggggagggggtcgtagggaggcgatttttcgatcggtggacggcggttggggagtagagggatcggttagggttgcgggggttttagcgcgtatcgttgtgggcgaggtagttgtggagcgggatttgtcgtcgggtttcgtattaggattttatgttttttattttggtttttgttgttttttttttttcgttttaaggtttttttaattttggggttggggatttggtttgggagtcggggagtgcgagatttttttgttaggtaaggagcgcgatttttagttttttagttaatagttttcggcggggtgtagtaatttaagtttttttttcggttgtgtaggattttggtggaggaaagtagggaggttatttacggtattttcgtagcgttgaggacgtttcggagttcggcgatcgcggtatcgcgcgttattaataggtatagcggcgtttagcgcgggcggattggggttcgggagttgcgagtcgggtatggggcgcggttgtatcggtttggattcgttgggagtaggtaggttgggacggcgcgagtgagtgtaagagtgtgcgtgtgtttgaagagggcgcgg

SEQ ID NO: 7353 - DNA, 1316 bp, synthetic construct
  misc_feature 1..1316: note = Description of Artificial Sequence: Synthetic polynucleotide
  source 1..1316: mol_type = other DNA
cggggtttttcgaggtcgtttcgtcgtttaggatggagtaggtttggtttttggaagggcgcgcgggttgtttggggacgggggcgttttttttcgcgtttcgcggtttttttttttttattgtaggtagcgcgcgtttgtagcgttttgggatcgaattgatgtttttgggaaacgaaattaaatttttttgaagtttttagttcgggttttttttgtttttcgttattcggcgtggtttagttcgggcgcggaacgagggcggggtcgtggttatcgcggcggaaacgattcgggtcgggggcgggcggcgaggataagggggttttgtgcggtattcgtttagtttgcgttttggggattgcggtcgggcggcggggttggacgggagtggacggggttgggcgcgggttgggcgcgttgggtcggttaggcggcgcgttgatcgcggttttcgtgcgtttcgtaggcggggagttcgtatcgtcgcgttcgggtcgcgagtgatgataatttaagaggtcggcgcgggcgggcgtgagcggcggaggagtcgggcgcggcgatacgcggttatggagcgggagtcggcggggatcgaggagttcgggttttcgggacggcggaggcgtcgagagggtaggacgcgtacggtgcgttttaatttgttgtcgttttcgggcgtcgaggattttgcggttggcgcggttaagggcgagcggcgacggcggcgcgggtgtgtttagtatttggtcgataatcggtttaagattattaagtatacgttgttgttttttttgtttaagaatttgttcgagtagttttatcgttcggttaacgtgtattttgtttttatcgcgttgtttaatttcgtgtcggcggtgaacgttttttagttcggtttggtattggcgtcggtgttttttattttggttattacggtttttagggatttgtgggaggattatagtcgttatcgtttcgattataagattaattatttgggttgtttggtttttagtaggtgagttgggcgggcgggcgagcgagcgcgcggtggcgtagggtagggcgtttcgggaatttggtgttgggtatagtgattggtaggggttgggtgtttagaaggtagttttatttagggtggagggttcggttgcgcgggattcggtgtcgatcgaagttatagcgtcgttaaggtttttttgtgttttcgtcgtagttaaaggggcgttttggatgcggggacgcgtggggattttttgttatttcgtgtcggggttagaatgattttaaggttagaaatcgacggtcgt

SEQ ID NO: 7354 - DNA, 1110 bp, synthetic construct
  misc_feature 1..1110: note = Description of Artificial Sequence: Synthetic polynucleotide
  source 1..1110: mol_type = other DNA
cgtttatttcggttcggagcgtggttaggagagtcggtatcgtagaaagcgttgcgggaagcgggttttttttcgtttattcggatttacgatttttagtaggtttagtttatttttttgatttatgtttttttatgtgtttttttcgggaaggggcgaggagggttagttggagtaattcgggagaagtttgggaggattggtaggtttttttcgtttttttttattggtttttcggaagtagagaaaaatggaagtcgaggtagagttaggaaaaggcgtaaaggggtagggttttcggcgttaggagaggagtagagggtgggtaggcgacgaggggaggaggtgcgaggttagagatttttgtagtggaggcgtcgggagaattcgaggtcggtgttttgttcggcggtttataaaggaaggagaaggcgtcgcgttttcgttatttgtgcggcggtttcgagcgttttcgcgggagttacgttttttagtagttttatttggattttttgcgttatcgtcgtcgtcgttgtgggaggcgatttggatatgtttttttggattattggcgaaaagtcggttcggagcgaagtagttagttttcggcggcgggttttttttttttcgttttcgttttttcgcgttttgatcggttttgggggtcgtttagggtttaggttcggtcgttttcggcgtagcgtttcgtagcgtttcgggattcggcgttttgttgttaggcgtttagtgcgcgggacggggtcggggtatcgggcgaagcgagtcgttcgggaggcgggacgcgggggcgcggttgcggtgtttgggagaggggagtttttagcggggtagtcggggtcgggagagcgggcgtagcgcggcggggatcggagtcgcgggcgtcgggaaaggttttcgttaggaggggagggaatttcgggagcgcgagttagggggaggcgcgtcggaaagcgagagtgataagtagtttataagtcgaaaagtttttcgcgggaggcgcgcgtcgcgtgggtttcgatttagtcgttgcgcgtcgtcgtggtatataggttgaaaagtttgcgaagttatagaagttaggttcggcgt

SEQ ID NO: 7355 - DNA, 1655 bp, synthetic construct
  misc_feature 1..1655: note = Description of Artificial Sequence: Synthetic polynucleotide
  source 1..1655: mol_type = other DNA
cgggttttttatcggcgaattgaaattggttcgtgaagaagtggtaaagtaatataatttttgtagcggttaggtcggttttcgggaatttcgttatgtcgtcgtcgttatttttttattttattcgttagtttttcgtcggtgttcgggggttttcgatgtaataggtacgatcgggttaaacgttgcggatcggtttcggtaggattcggaggtttttgtaaatgtcgttgcgattttatagtagggaatcgagaagaggaagaagcgaacgcgagtaggagcgtagcgtttttcggatttttgaggttttttttgtaatttgttatattcgtagtttttattcgatattgaataataatcgcggggaggagaggttatttgtagtcgaggttcgtaaattgtcggttttattcgggtagcgttaattcggtgttcgcggacggtgattttcgagttttagcgatgcgttttattgggtttaaaatagatttaattttatagttagcgtcgttgtttgttttagatttattagggttggtcggttttgtaggaatttttttttgtttagggatggtttcggtaggaggtttaggtttgcgggaaggaggttgatgacgaaattttttcgataagttttgtttttttttttcgttcgacgtagggcgcgcgttttttttcgtagtcggaggaatgggtagttttaaagagttgagttttgggaaggttagggttgtagtagtttgaggttcgaagttaggaaaaaaatgtgtttaaaaaaaaaaaaaaaaaagaggaagaagaaaggaaaagggtggagtgggagggagttacgttggaatttatcgggagagggttttttcgggtttaggaggaggtggttttaagttttcgcggagttttaggagtttggtggcggaggaggcgttgtcgtcgttacgttttttcgcgttttttttttatattttgaggagggaaggtagttcgtaatttgttagatttgtcgtcgtatttttttttttttttttttcgttttttttttcgtttttttaggttttttttatttttttttttgaaatcggtagttcgtatagatttgtttaatggttgtatttttttcggggttggttgaggagtcgcggttaatagattaagtcgggggagtttagcgaaggggagggagagggttattttagtttcgtgcgttttaggtagtcggttgttttagagcgcggggagaggggataggtcggggagttatcgggggagcgcggggcggtattttcgcgtcgtcggggcgttattttcgtagtttgttcgtacgttttgggtagtttcgttaattgcgttttatatttatttggttttcgggtcgttttcgcgttcgattgcggggggcgatcgcgtttcgtttcgattttggcggggtttttttgggtacgaaagggttaattatagttcgttttttcgcggaggttggttttggtagtggttagggagtggagaaagtaaattagagtcggttcggttatcgattttgcgaagttttttcgattttagtttagcgcgggagggtggcggaaggtggtgtatcgtagcgtggttttcgtcgttgtcgtcgcggttttgtaaagtgttagcgggggcgaaagcga

SEQ ID NO: 7356 - DNA, 1655 bp, synthetic construct; identical to SEQ ID NO: 7355
  misc_feature 1..1655: note = Description of Artificial Sequence: Synthetic polynucleotide
  source 1..1655: mol_type = other DNA

SEQ ID NO: 7357 - DNA, 304 bp, synthetic construct
  misc_feature 1..304: note = Description of Artificial Sequence: Synthetic polynucleotide
  source 1..304: mol_type = other DNA
cgcggtgggtagggttttaggaggtagttttcgttcggcgatagttttcggggcgtaatttttcgtaggacgcgtatttgttaggatagttattaagaggatgcggaggttgggggttttttcggggataaaattagggtattttaaggaattttttgcgcgtttaggtttgtttgtgaagttggtaggcggaggataatgggagtaggggtaggtttttagaggcgagttcgtttttattttttttatttgttttttatttttgcgtcggtcgtatttatttcgttttttttttagcgttcgt

SEQ ID NO: 7358 - DNA, 1666 bp, synthetic construct
  misc_feature 1..1666: note = Description of Artificial Sequence: Synthetic polynucleotide
  source 1..1666: mol_type = other DNA
cgaaatcgcgcgagtggtaggagtaggttaggtcggaggttttttttcggtttttaattcggcggtttgttttttttttttcggggcgtttgtatagtagatatttgtagtacgggcggtcgttcgggttttcgatataaggcgttggtatttgagtttttgattggtaatgtattataaatcgttttttttaggtttttttagagtaggagtacggaggttatcgtgtttataaatttttttgtgttcgttacgttttttgggttttgggcgttcgggtttttagtcgtagagtacgtttgttcgtgggaattttaatatttgtgtttcgcgaggtcggcggggcgggggcgggggattgggattattttgtttttttttagttcggtttttttcgttttgttcgtcgttggtttatagagcgtagcgagtggaacgaattgggtgcgtcgtttttagacgttggcggaaattaaatgatgaggcgaggtgggatattcgtttttcgtttcgcggtcgacgtttagtttacggtaaaggtattatacggtgtttcgtttcgcggcgacgcgagcggcgggatgattcggtttgggttttggcgtagttaaaggttcggttcgttggggcgcgattttagttcggcgcgtatagtttttcgagttttaggttggattgggtgcggttgtatttgtggagtgggtggttcggtgattgttattcgggttagtgttgttagtagatgtgtatattttgggcgggggttggcggtcgagtgttattagtaggggcggcggttaggtagttattcgtcgttttttaagttcggcgttgcgcgtagggtttggagtattcggtgttgagacgcgaatgcgtataaagagaaaagtgtttttagtgtttttttaaaatggggaatagggaagaaggataagtattatgtaagattgttattgttatttgttttttgcggattatgttgttttttttttcgttggtttggttttgagtattgaaagtcggggagagggcgtcggttttagagttagtcgtattcggggatcgtaggcggcgttggttcgggttatttaagttcggtagatgagtttttggtttgcgggggatcgggtcggaggttagggggacggtagtgtcgtcggagggagcgcgtagtttaaggtcggtgtttcggtttcgcgcgttttttttcgggttcgtagggaattcgggttatttggggagtcgggttttgtcggttacgttggtttttcgcggttttagaattaattaaacgttttttttggttaagggaagttttgcgtcggacgggggtgggggcgtgtgggggcggtatgtgggtatcggaataattagttttatttttgcgtttttatagaattcgcggcgtagcgagaagtgaatagcggtcgtttgaatggcggttttaaaaggcgatatttgtaagcgcggtcggttgtgaattgaattgagttaaatgcggcgttcgttcgtatttgagtcgcgagttattagtgttaggcgcgttcggtcgttcgggcggggaagcgcgcggttaggtcgttcgcgttgaatgcggtaagttgcggcgcggtcgttttatgggaatgtcgttatttgtgttgttagcggtcgggagggggtgcgt

SEQ ID NO: 7359 - DNA, 5030 bp, synthetic construct
  misc_feature 1..5030: note = Description of Artificial Sequence: Synthetic polynucleotide
  source 1..5030: mol_type = other DNA
cgcgttatagtggtttttttcgtttagttacgcgtagtgaaattttcggtaatcgggttagttaagatacgggatttgtatcgtagttttttagtttttggagtcggagtcgagcgttttcggtagtttttttaattttttttttaaagtgcgaagggaaaagtttcgtttgttttacgattgtaaggtcggcggatttgggagtcgcgttcggtttcggaggattcggcgggttcggggtttttcggtagcggtttttttgttaggggttaatagtagttttcgcggtcgggcgggcgcggacgttttttttttattcgttcgggaacgtggatatcgcgttcgtaggatgttcgtcggttgggatcggtagttaggaaatatgagaaggtttcgttatttttgttttcgggcggcgcgcgtcgggttgggtaaataaagtcgagacgacggcggtggcggtggtgagcgcgttggagttcgcgtggagaatatgcggcggggatgggagtgcgtttagtttcgaggcgggagagttagtcgttttgtagtcggtcgtcggtttcgtagttataggtatagttttcgcgtcgtcgagttttagtcggttgcggcggaacgttaggttcgttttggtttttgcgttttgggcgtcggtgttttttcgttttttttttaatttttttttaaggtttggtggagaggcgttcgggtagcggttaaggttggtttaagggtttgcgcggagtttgggagtttatttggtcgcgttttttttgttttaaaattattcgtcggcgttgggggagggggatatttttgtagggagtgattttttcggttatagtttggagtgaatcggggtaagtgatttgagaagaggcgcgggtggtcgcgcgcgggagttttgggagggttagtaagtgtggtttatacgttttcggattttttgcgataggatagcgttcggatttttgttatcgtttgtttttgagtttgttgtttgtagatttatagcgcgtcgggtgtttgtgtttgcgatttttgcgtgggtttggggttgtcggggaagtgttcgaggtggttaatttcgtgatgatttcgttaggaaaaatacgtcgtcgtatttaggaggacgcgttggggtggttcggagaaggtcgggtcggggaagggtgttttgtataaataaagtagtatgaatatatatttttaagggtatgattttaaaagaaaatattaacgcgagttttgattgtagaataggggttgtaagtacgaaaattttttttgatatttattatcgaggttatgtgtatattttaggtacgtatttgtttgcgcgggaggacgtagttttaggggatatacgatatttagtagaggtttgattttatttttttacgaatatagatcgtagtcgtcgtttgatcgcggtggttacgcgtggttttaaatgttacgcgtggtttttgttgcggtggtcgaagggcggggcgggggcgttggcgagtgtgggcgtttggcgaggtaaagggtgtgtgtgtgtgtgtgtgtgtgtgtgtgtgtgtatgcgcgcgcgcgtgtgttagtggagtagtagtttatgtcgcggttggacgggtaaagggggcgttggtagcgaagttgaggtcgttcggaggaaacgggagttgtttcgaggcgcgaggcgaggagatggggcgggcgaagttcgtcgcgcgttttggggttgtaattttgcggtttcgcggtcgcgcggatttgtttttgacgtcggtgcgcggtaggtagaggtttagggttttcgcgattttagaggtgagttgttggtttttttcgatagtggtagtagtggttcgggaggtgcgtcgattaagttgttttttgttttgggtttttgatatttttatagtttttgaaagggttttcggagattttagagagaggcgggtgtcgaggggttacgagttcgcggttgatattcgcgttgcggaagagaatggtattgattgagggttttggggatttgggttttggcgttttggattttaggattatgtatttttcggggcgcgttgggggatgataggaagattttgggagagaagggggagaagtggtgttttcgttttgacgttatttaatttttttttgtttttgaatttaattttatttcgggggattttggcggatagaagatgcgggggttttaattaaattatttacgatttagaaaatacgaaaattttttaaatttcggtatggtttgggatttatgagttggggggttttgtggatacggttggtatattattttaaatttttttttttatttaattttttttgacgtttcgagttggggtttttagaggttttagttttttgttgtgattgaagaattacgcgcggttttacgtcggtcgcgtttcgtagttcggagtatgttttttttagatttaaattgaaatttagaggttcgtttgggaattcgttttttttgtttttgcgggtgaatgattttcggttgtagttttggggagtgaagggattggggggatcgatcgtttaggtaaggaagagggtaggtatttgttcggggaatttgtaggggcgggggcgtgtagttaattggggagagtcgtagggtttttgttagttgcggcggcgtcgttttttttttcggtttcgtagttcggcgattcggttaagtttaaggttttgaatttgtaggggtttgagtatttttagttagtaagtaacgagatgtattttttttttttagaagtcgagtttcgttgcggagttttcggcggtttagtttcgaggttttgcggtcgcgtcgcgcgtttttattaatcgatattatgaatattatcgtttttaataagtttagcggtgcggtgttgtttgaggacggaggcgtttcggagcgggagcggggtggtcggttttatagcggtgttttggatagtttttacgttcgtttcgaggtgggtattttcgacggttcgttttttaaggataatttcggtttgagatatcggaggatcgggtatgcgtatttttttgggggttttgttcgtttgcggttcggaggggtgggggtggtgagttgtgacggggtttcgtggtaacgcgggcgggtggacgggaaagggttcggagttttttgggagtgtaggtttgtttttttagggttcgcgtatttttatgttaaggggtttttattttaaaatatgagggattaattcgtcggggtagttttaaagagtttggtggagattaagggcgttaggagttgtttttcggtttttcgttgtttggatttcggagttgggggttatttgttttttttcggattgtgggtgtcggtgcgcggttgagggcgaggaaaaaggattgagttcggtgtagagaaataggcgaagtcgagtagtcggggagtttaggtttaggtttcgcggattttttttcggttattcgagtttttcgttagagtttcgcggttcgtttggtttaaggagtcgggaaggtcgtttttcgttagggagtttcgggcgtgagcgcggttcggttgggttcgcggcgaattcggagggggaggtttcgggtttgcggggtcgggtttgagtttagcggggtgaggggtatgttggggggggcggtagtttgcgggtgggttagttgtttagattgtcggtgagtggagggtaggttttgtttggttcgattcggcggtttttcgggcgtttcgtcggggaggggcggtcgttttagtcgtttttatttgaacgattgtattagttgtttgttttgcggcgtcgttgtttagtaaaatagagattcggtttcgttaaaatgttattattagtcgtttcgggtggaattgtattttaaagtgtttaaagaggtagaaatttaggaggtttcggcgtaggcgcgtaagtttcggggagcggttgggttcgttggcggtcgcgcgcgatatttttcggattcgtgagggagcgtagcgttttaggttacgttttaggtttttggttgtttttgttttttttttttttgaatgtgttttttttgaggtttttttattttatatgatgggatagagtttgtcgtatttttaatttttttttagtcgggaaacggttcgacggtgtttttgggttttgtagtttttttttataaattattaatttttttagaaagtttttttttttttttaaaagattaaaggaaatagtttaaagagagtcggggcggtaatgtttttttgttttattttttatgtttagtcggcgattttttttttgattataagcgacggaaagtttttgggagtagataagagattttcgagggaagtttcgagagttagtcgtatattttgttaggtttgttaggttagggttattcgagggtgcggcgttagcgggtgagggaagggtagtagttagtttcgttgtttagatacgcgattggaatagtagtattttttaaattatttgattttcgttttttaaatttttaattttggggtattgggtttaaggtatttttttatttaagataaatttatcgaaatgatttttttatttagaaattgtgtggtttttattttttgttttttttaaatattttgggcgcgcgtaaagtaggggcgtaaggtaggaatgcgtagtttggatgcggggttcgggtttggtcggggcgtggagcgttcgggcgggtaaacgcgtcgtttattagggtcgttttttttttttatgttttagcgttcggtagaatggcgggaaggtgaggtataagcggtaggttttgtaagatatggcgcgattttttaagtagtggttttataagtatcgtgataattcgtattttattaagatcgagaagatatttttggttttcggttcgtagatgacgttagtgtaggtaattaggatttattaatattttgattcgttttttcgcgaggggttgaagagcgggaacgtttagagttcgtgtggttttttacgtggcgt

SEQ ID NO: 7360 - DNA, 2868 bp, synthetic construct
  misc_feature 1..2868: note = Description of Artificial Sequence: Synthetic polynucleotide
  source 1..2868: mol_type = other DNA
cgcgtttcgtattttagaggggagggagaaagggagtttaggcgcggggggtggggttgggggagtacgagagagtttttttttaaatacgtattttttcgttttttcgacgttgtagcggttttattatagacgtatttattgttttttttttaaaagtcgttttaaaaataacgtaggaattaaagcgagtttttcggttcgaaatgtacgtgtaattttttatatagtttgggttgcggtcggcggtagggtcgttgtcgtttattattatataaataggtatcggggcggcgtaggcgggggttgttttttttgcgttttcgtcgttttcgggcggataagtttcgtttttttcgttataggaattgtttagataataataattagtagatatttcgttgttgtacgagagggagagaaagtatagtatcgtttcgagataattagaaatataattaatttataacgtttttttaaattggaaaaggcgattgtgtaattattattatatgtttaggtttcgatttttcgggttgtttttttttttttttaatttttacgttaggtagaggggtgtgtgttttttttggtatagtagtataaattaataaatattgtagttgcggtgtaagtagtagtttcgcgcgttcgtcggttcgttcgtttttttttttattttttttttattcgagatttagagcgttatttaagttttattattcggttttagcgtttcgtgcgttcggtttaggtaataatttttttaaaaatcgaaagagaaaagcgcgaggcgtacgtatatcggtttatttcggcgtagagatttcgtttgtttcgggagggggatttgtttgtggtgtttttcggtttttaagtttaggtaataatttcgtaaatatattcgtcgtttagttcgtttttattcgcgcggttttcggcggcgttaagtgggtattttttttgttttgtttttcgcgtcgtttcgtcgcgtttcgttaaacgtggattttattcgcggggttcgtcgcggagtttttaggtcggggttttgggtcgggtagcgggaggcgttagggaggaggggcgtttagggattcgcgttttcgcgtttttaattttcgttacgcgagcgcgttcggttcgcgggttttaattttatcgtcgtcggtcgaattttgttcgttcgcggcgcgtatagtcggcgttcgcgtatacgcgcgtataaattttacgtaattcgcggtcgtttcgtttcgtcgtcgtcgtagttcgtttgtcgcgcgtttatagttcggttcgagtcgcggggttcgagcgatagcgacggcgtcggtcggggtcgcggcgcgcggaagttattttgtacggttagcgtcgggtataagtttgtttcgcggttttcgggggtttgggcgttgagggagaatcgcgttgagggggttaggaggagggggagagggaggcgtcgaagggtataagagtggggaaaagtgcggaaagaagtaatagtcgttttattcgggattagaaaagtggttagtgcgtttcggtcgttcgttttgcgtcggggatgcggcggcgtcggcgtcggttaacggtttagggaggcggtaggggcggcgggagtcgttaggcggagagagattaggtaagagatataacggtttagggagagcgagcggtcgcggcgcggtttcggtagcggcggtagcggaggggggtagagagtattattttttatttttttattttattttgtcgtttttgtttcggttgtttttagttcggttcgttttttttattttcgggggcgtttcggttgtttagttttttttgatttcgtcgtttttcggtttttttcgttatttatcgttattgcgtcgcgggttcgtttgttttttgcgtttatatttggggttattcgttatgattttttcgtttgtgtttaaatgttcgagttattttttttttttttttttttttttttttttattttttcgtttttattttttttttttttttatcgtatttggtttacgatattttcggttttacgatattattttttttatatttagaggttttcgttttacggtcggaattttgttgttagggatcgggcggtttgcggtaatcgtgggtattgttgaatttgaattgaggggcgagggaaaagttttttttaggtgtggtggggagagggaggcggatgtcgggaaatcgtagggacgcggttagaaaggcgacgggttgtcggagttggaaaggtaaagttggaggttcggcggcgttttgttttcgcgttggttatattcgtcgcggttgttcggggtagggagggatttggttgattttttttgtattttgtgttttcggagttgttttttcgagcgtttagaggttttcgtttgtttgttttttggaggtagggttattattagttttacgtttcgcgtgttcgtttttcgtatttcggggttaaggaaagggatcgcggtttggatttttcggggagtttttttgatgaggggaagggtaggtttggggacggcgaggatacgcggcgatcggagagaggttatttgattcgcgtagttcggatttttttttttttttttttagggacgtttggtttttttttaagcgaatcgggatgggaagtgattttaatgagattgaattttagttggattgaaagagaggttagaagtttcgtttgttagtagtttttttagtagagcggaatgagtaatatttatacggtgtttgttttatttttttattcgtattcggtttttatttgttgttatttcggttttttatattcggttcgcgtttttcgttttttttttcgcgtagaatcgt

SEQ ID NO: 7361 - DNA, 2678 bp, synthetic construct
  misc_feature 1..2678: note = Description of Artificial Sequence: Synthetic polynucleotide
  source 1..2678: mol_type = other DNA
cgagaggcgatggcgtttgttttggttagatttaagggtaagcgaggttgcgcgcggttttcgtagggtcggattttcgagttttagggcgtttttttattcgggtgtagatttttcgcggattttttcgttttttcgggttttattagttgcgtaggaatggagttggttagagttttgggagcggggagggaggcgtcgttattagagggcgtcggagttttagcgttgcggtcggtgagcggttaggtttttcggtttagtttagtaaaggtttggggacgttcgacggttgttttttttattggattttattgtttttagttttttaagagtagggttaagttagtggggttttcggttttaagtttagtgtttagggtgggtgggtgggtgggtgggtgggtggatggatggatggatggatggatggagtgtcggtttatagttatttaacggttaaagtggttttggaaaaaaaatgtatagaagatatttatttttattagcggagtttcggagttttcgtagttttttgttgatcgttttcgtttaatgtagtcgttgatcgtttatttttcgacggttaggattttttagggatagggacgtgtttttagggtaggtttttggatggacgcggcgattgattttatttcgttggacgttgtgttgggaaggatatagagaggtggttggggtagtttgcggttataaagcgaggtttaaaggggcgttttttttatttttacgttttttgggtgtcgatttgtatttttttttcgttatcggattggggttatttgggatgtttcgggggtattcggagggttaagtatcgtcgagggacggtttcgtgggaagagttttttggatttagaaggtagacgttagtagtattgttttaggagtcggaggtcggggtgggggagtttttagttttttgggtcgtacggagttttttttgggtaaggtagtaagtatttaggtttaaaggatttatttatagttattatttattgagtattgtttgtttgttagatacgatgtagagaatttcgcggcgtggggcgggttttattgaatttttcgttttatttcgcggggtgggtttgtgattagtttattttattattgagaggtcggaagtataaaggttatattcgtttttattgagagtcgtcggcgttttttgttttgtttgtataggcgaggaaattgaggttcggttggtggcgtcgtgggtttggagttcgagttacgttgattgtaaagacgggttttattttcgtagatcgagttttgtcggcggttgcgtcgtaagtcgggtaggtggcgagtttgagtttttacgtatagaaagtaggattttttcggttgttttgggtcgttatcgttagtaggtttttcgttcgggattaatttgtttgttttttattggtttttatttagttttcgttatcgaaaggtttcgtttcgtagttttttacgcgcgttttattttacgtttaaggtttttagtttttttagtggggttttgttatagggataataagcggttttttagtcggcgtcgtttaggttgcggattttattgtagatcgggttagcggtgcggggtttagcggagtttgagaaggttaaaggtcggagcgtattgcgtttcgggagtatagagggagcggaggaggggcgaaggggatgggtggggggtgtcgtcgagggagtcgcgcgttagagatttcggttacggttagtattcggtttcgggttcgttttttatcgcgcgtttcgtttcgtttcgtttggtttttttttttaaagcgttcggcgcgcgttttttatcgtcgtatttttatttttcgttagtcgtattgttcgttcggcgttcggttttcgattcgcgttcgttcgttcgttcgttcgttcgttcgtgttatgaacgttaaggtcgtggtcgtgttggttttcgtgttgatcgcgttttgttttagcgacggtaagtgcgttcggcggggaggttttggcgaggttttgggtttcggttttcgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggataattgggtaggaacgttttaagagagcgttcgggattggcgcgggaaggcgcgagggtggggagtcgcggattttagatttttgtttgtttattttttatttattgttttttcgttgcgggttcggtttttataggcgaatgggtttcgaggttttgttgcgtatagtgttggaggtcgggcggtgtatggcgagagcgcgttttgtaaagttcgttttatgtcgcgatttgaggttgtgaggttcgatgtagtcgcgtagttttcgttttttgcgaagtcgattttttttttatattttcgcggggtttttggttaggcgcgggcgggttgcgcggcgtagttgtcgggtttgtgttattcgttaggtcgcgtttttgtatagtttcgcggttcgtagcgacgcggatttgggcgcgcgtttagtcgt

SEQ ID NO: 7362 - DNA, 2756 bp, synthetic construct
  misc_feature 1..2756: note = Description of Artificial Sequence: Synthetic polynucleotide
  source 1..2756: mol_type = other DNA
cgttttcgtacgtattaaaagggttaggcgggttgcgaggttcgtcgttttggttagatataggacgtttacgtaggcgtatcgtatcgtatagattttgcggtggtttattaagtagtatatcgcgttcggaacgggagcgcgttaggaggtttacgttgcggagtagtagtaagacgggagtatagagtaggttggttagttttatgttaaggttgagttgtttaaagtttagcgagtgtataatgtggtttgttattatgggttcgagcgcgtaggttatcgaataggagatgtcggcgatggcgtagacgttgttatagattgagatatggcgtacgtttattaggaaggcgagcgtgggtagtagtgttgtgtcgattagggttatgttaaaatagaggtcgtatagtgagattattagcggcgcgaaggagcggtaggcgggtacgatgtacgagttggcgtcgattatagttagtttaagcgcgtcgtatagttattgtaggtgtgggtagcgcgtcgttaggcgtacggtgaggtagacgtttagtatatgaggtacgaaggtcggtagttaggttatgtttattttttattcggaagtcgttatcgtatgttttatttacgtggtaatggtgggttcgaggaaggcgaggggaatgttataggtggtgagcgcgtcggttattacggtaatgtaggggtttagtatgaggcggtggatgggagtgtttattggtaggttggttcgagttcgtgtagtcgtcgagaagggtttggttattgttagtagtaatagcgcgttaaagagcgatacggtagttagtattaagaagggtacgcgtttgtcggcgaatttatagaggatgttttcgaagggcggggttattaggttttcgaagttaatgaaggttagcgttacgtttagtgtacgattgcgtttcggttttttcgggtatttatcggcgattatggttatgttagacgtgtcggcgaaggttgagtttaggttttgtaggttgcgcgtcgcgaatagcgtggcgtagttttcggcgaaggcgaataggattgtagaggcgaatatgacgtttaggtcgattagtagcggtacgtcgtagtttatgcggtcgatgaagggttcgtttaaggggtttattagtagttgtaggatagttttggaagtaaatagtatttcgatttttacgttttcgtttttcgtagggtagcggggtcgaagggttgagttcgttggttacgtagttgtcggggacgtcgaggtgttggtcgtgtaggcgttggtattggtcggagtgggtagcggtagggtgggtttttatatttcgggagttcgggtggggttttcgtcgttttcgcgtatgtgggcgatgtagtcgggtattatgggtacgatgattatgtatagtatgttgtttagtaatagcgttacgtatacgataataagtattaggcgtttttgtcgtcggggtttttgtagcgtcgcgtttatagttttcgatagtttggtggtcgtcgttcgggtttggttcgtaggtttcgcggattttatgtttttatttcgatgttttttcgaggacgttttcgttagggtcgagcgttggcgtttcgtagtgtagaggcgagggtacgggatttcggggaggttgttttggtcgagtagatttttttgtgttttaggtggtcgcggagtttatggtttagcgtttcgggaaaggaaaggatttcgttcggcgaggcgttgtagttatttttagtcgatttcgggattcgcggttgttgggtttaggggcggtcgggaagtcgggcgcgtcgaggggtcggggtcggagattgggcgtatttcgttcggggcgcgtttagagtagttttcgtcgcgttaagaggtcgttcgcgttggtcgagggatatgttgttgtcgttcgttcgtttgttcgttcgttagtttcgtcgttgcgttttttttttttcgcgtcggtttttgtttttttcgtcgtttttttttttttttttttttttattcggggttgtgacgcggcgagttttagttttcgagtggtgttcgggttatttacgtcgtttatgttaatgcgacgtcggcggggcgggggtcgggggcggggcgtggtcgggtaggggttcgttttttagatgttttagggttggaggtttaggaagggttttcggtgtggaagttttgaattagtttttgggatgggcgtttcgcgtcggtagttggttttttgtttttcgttttttgtttgtttttcgttcgcggttttaggattcgcggggttagcgttcgtttttttttttttggggaagggggcgcggtagtcggtttttcgaggttttttgggagaggcgggagttagaggtttgcgattttcgttttagtttggatttcggcgtatagcgagtaggaagttttcgaggtgagtcgtcgttgcgtttatttgttttcgtagttggattgtggagtcgcgttcggaggagcgttggatacggatatttttaatttttttttcgatttcgttttttggttttttgtatatatattttcgttaggaggggaggggaaggtttagtaattgtttggtttggttttgatttatcggttttttcgtagaatttttcggtcgcgaatcgcggtcgggagtttgtggggattgagggtagaagttgtcgcgttttagtcggggtcgcgaatattagtttggtcgttgtcgttttttcgt

SEQ ID NO: 7363 - DNA, 990 bp, synthetic construct; identical to SEQ ID NO: 7133
  misc_feature 1..990: note = Description of Artificial Sequence: Synthetic polynucleotide
  source 1..990: mol_type = other DNA

SEQ ID NO: 7364 - DNA, 829 bp, synthetic construct
  misc_feature 1..829: note = Description of Artificial Sequence: Synthetic polynucleotide
  source 1..829: mol_type = other DNA
cgtagcgatttcgcgtaggtgagggtattggggagttcgtggtttttttcgttcgtcggtttttttttattagtcgttagttagggttttcggcgtcggggaagttttttatagggttttaggttatttaagcgcggttaaacgtcggcggttcggtttcgtttatttgacgtagtcgcgcgttcgtttcgatttattaggcgcgtagggttcgttttcgaaattcgcgcgggttttcgtagtcggtcgcgcggtttttagtcgcgaagagagcgtcgcgtacggtggcgtcgttatagtcgtgggtcgtcgcgtttaggtagcgttttagttgttcgtaaagtttttgtagcgtcgtttcgtcggggtttacgcgcgtcggttagagtagcgtttatcgttcgagttttagattttaggtttcgtcgtcgtttacgtttagtttcggcggtagtcgtgggaagtagtgttttagaggcggttatagcgtcgttggttgtcggcgcgcgtcgcggaatttcgcggtcgagagtcggtcggtttagttgggcggggatacggcggtttcgggtttgtgttttagttttagtcgggttttttcgcgtcgttgcggttgttgcgcggtgcggtcgtgataagttatagtaaatttgtttttcgcgtcgttttaagttattaggaagcgtaatcggtgtttttggggatcggcgaagaggttttttcggagcggcgtttagttttttaggttgtcgggttgttcgttttttatggtcgtcggcggtagcggttttagggtttggcgggcgcgggtttgatttcgtcgtatcgt

SEQ ID NO: 7365 - DNA, 4119 bp, synthetic construct
  misc_feature 1..4119: note = Description of Artificial Sequence: Synthetic polynucleotide
  source 1..4119: mol_type = other DNA
cgggaaaggtggtagtcgaagatttcgcggttttttttcgtttaggtatttcgtttcgtttttagtttcggttttgtttttcgcgttttgttggtcgggtattcgggcgtttaggagttttttttcggggtggcgcgcggcgatcgtcggcgggtttggtagtagcgttagtcgcggggcggttcgggtaattcgttcgtttgtcggttcgtttacgtgcgtagagaggagcgaagcgcgagtagtcgtttcgttcgcgtttgttgtcggtgggtgttttatttaaggggtcggcgggggtcgtaattcgagttttatcgtagggattcgtatttgtataattcggttttttttcgttttttcggatttagggttcgagatgcgagtcggattttttttcgaggcgtcgttttgtttatggttagcgcgggggtcgcgggattcgttagagcgtaggcggagtgggttggcgtacgtggtaagaacgtagttatttttttttgtttttttttttttttttttttttttgagaaataggattttgtatatttttgttggggtggggtatttattagggtgttaattttgttgcgatttttttttatgttttttttatttttaattggaaaaaagcgtatagcgcgagcgagaaatttttttaaatgtgttttgggtgatttaagttagagagatggtcggtcgttggatatcggttgttttggagggagggggagaagtagcgttttagtggaagagtagagggagagatcgttttcggtagttttagggttttgatcgcggtgcgttgggttcggcgagagttggcgtacggttgtagcggtcgaggtaggtgagcggttgaagattcgtttgtagcgtcgcgttttttttacggcgtggcgtcgtggttttcgttcgtttcggtttatattaagttagggtcgtttcgggttcggggtgaaaaagggataggataggtttgcgaggttgattttgcgcgttatttttggttttcgcggttttggagcgggaaagggttttggggtagttcgtaatttgtataaacgattatgaatgagttatgtaggcggcggtgcgttggatttgggtattcgggattagttttttgtggggtttcggataggttcggttatttattgcgggttggggcgtattgggaggtagaagttttgcgtttagtaagttagaatttgttgttatttggattttggaaaagtttttaaaaattgttttgggaacgaaatagaagggtttttatcggggtttcgtaaagtaaaacgagtgggttgggggatggggatggcgttttgaaagtgattagagatgttttcggtcgttattgaggatcgcgttgggtttatcgaggtgttttttggggagggagagaaaatatttattttagtacgtgtattttggttcgggtgcgggtagggcgcggttttggattttgggttatgggggttagggggattttgtggttgtagggatcggtagtgaaggttaggttagtgtttttatagaattttttgtttagcgagttcggagttcgttttgtcgtcgggatattgttggtaacgacggcgcgcggacgtagttaatagggaggtgtgtagtgtaaggtgtgtgagcgggtgtgtgaagagggtagcgggggcgggagtgtgtagcggaagtggagcgagtgtgagtgtgtgtgtatgtgtgtttggaggggtagggtgagtgtttaagtttttatttggacgtttttacgtagtcgatcgtttagacgcgtcgggaagggcgttcgtttcgcgtagtagttgaaggggggcggggagcgcgcgggtagaggaaggagggtgttttcggttgaggatttttttcgaagttttttatagtaattttgttttttttagggtttatttttttagttttaaggtgtttaaaatatttaaataaataaataatttaaatttgtttcgttttcgtttttgtataaatagaatagattttttaaaaaagtaatacgtatttatttttattattagttatttttttttattaagtaatttagaaaaaagtagttagttttcgtgaatgtatgtagtttttttttttttcgttgtttttttttgtttgcggttttgagttgttaagaaagtgagtaggggtttgattgtagtgtttcggtttcgttcggttttttttcgaagtttaatttttcggaatggtttttaaataagggttagggaggcggagtcgtcggtatcggattttcgttttttttggaaagttttagagaatcggaattttttttcgtttcgggaggttgagtcgtagtttggagtagttcgtttttttgttgtggttgtgattgggtttatggcgcgttttttttttcgcgatttttgcgtttcggatttaggttgtagttagggtcgcgcgttcgggattttagcgattttcgtcgtttgcgagttggaagtcgcgagttcggcggagttcgcgcggtcgagttcgtgtatgtaaattagttatgtgacggtaaaagtcgtttggtttagttttgttttttagtttatatatgggtagcgacgttacgggtattgaagatttgtttataaatatttagagtaatatttttcgtttaattgagcgaggagtaattgattaatagttcggcgaggggatttattgattgttataataatattatattagtaatttttggttttttagtagtcggaatatagataggagagagttagtggtaaatagatattttttttattttttaaaaaatagtaatttgtttgttatttttatttttgttgattttttttttttggtgtgtgtggtggttgtttttaagtgtggagggtaaaaggagatattattttaggtttagtttaatttttttttaaaacggtttttttgatattttaggtagcgagggagttgggtttttaggttgtgcgaggagtaaatgatgatcgttaaggtcgtagataaaattttagtaatttttagtggttttgtgtattagttgtttgataatatttattcggtggaggatttcgtcgttacgtcggtgattattttttttaatgtcgaattgggaggtttttttgattagatgaacggagtggtcggaggtaagtcgcgtgttttcgtaggttcggatttgcgcggttcggaggtggtggatggggtgtagtgggtgtgcgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcgtgcgtgcgtttcggcgcgtttagtttcgggcgagcgtagggatgggggtggaagaggcgttttttcgggtttcgaggtttgcgtaggttttttggtcggtagtatttcgattttttttttttcggggtaggggtaaagtgacggtaaagttcggggttttcggggagagttgcgcgtttggagagtcgagcggcggagaagcgttaggggaaagcgtcggtagtttttttttgggtagagtcgatttcgggaaaatttcggagcgttttttttttgcggtttggaggcgcgtttttatttgttcgtcgttcgcgaagttgagggggttagtaaggcgggggtttcggtcggcggaggtagcgagtgggtggtggaggagggcgcgtaacggcgggaagtagttttcggattgtcgagggaggttcgcgggggtatcggcgacgtcggtttttttggcgatgttgtggaaagtcgtttttcgcggttttcgcgtttttttcgaggtcgggttattggttttgggttgaggcggggacgcgcggttgtcgggaaaggcggagaagattgggagggtacggaaatttacggatttttttttttatattttttattcgttttagtagttttcggttgaagcgtagcgggagagggagggagaaaaaggtataaggcgtcggggatggggagtagtcgggaaattatttatttttttttcgggtttttttttcggtttggtattattacgg

SEQ ID NO: 7366 - DNA, 1575 bp, synthetic construct
  misc_feature 1..1575: note = Description of Artificial Sequence: Synthetic polynucleotide
  source 1..1575: mol_type = other DNA
cggtttgggtttttgggcgcgtttgtcgttgcgcgggcgcggggcggttgttatattattttggtcgggtttcgaaagggaggagtggagtttgttcgttttcgcgagttttcgcgcgtttagtttttttttatttgttcggcgtgtttagggcgtttttagcgttggaagtcgggggcgtttgttcgaggcgggagtcgttgggttatgtttttgtttattaggtttttcgaatttttggtagggtagcgtttgttcgtgttttcgatttttttcgtaggtaattcgcgcgaatttggggttcgtagagagcgagcgttcgcggatatcggttgaatagtttggaggttgcgcgagggggcgtcgcggggagggataaaagttagtaataaagagtatagatttcgtttagtagttgattgattcgttttaaaatagtcgtttttatttgttgtttttcgcgtttcgtttttaggcgtagtattcgggtttgtagttcggtcgttcgaaagtgggcgagtaggttgagtgttagcgagtagagggttagcgttagtagttcgtacgattttggattcggtagtcgtgcgtcgcgtttcgttcgcgtcgttattagagttatcgtttcgggcgcgtttaattttttagggtcgcgggtatcggtggttgtcgttttgtgggtgcgtttcgttattattttttcgcgttttgagaattaataaataaataaatagaataaataaaggcgatagtcgttgttaaaaggttttatttaaattgcggggtagggggaaagggtttgtatcgttggaaaacgttttttttcgttgttttcggtaaagaggacggaaaaattagtagtaggagaggaagtgtcgaaaaagtataattagcggtaattggggtatatttaggtgagaaaaaagttatttcgaagaacgttttaagtttaggaaagttaggggaatttgatcggtttttttttttttcgtttagtttttttttttaagtgtttgtagagtagttggtgtcgcgttgttagtttttttgggcgtttcgtgtttttcgggttagttagttttagttttcgggcgaaggggcgtatacggagggttttatgggtagaggtgggtcgtggcggttggcgaggagcgtaggggtcgatttcggcgtttttgtaatttgatatattttttgcggcggtacggatcggatgagtaattcgtgttattttttaaattaatttttttttttttttttttttttttttttttttttcgttattttttttttatttttcgcggggtcgacggtttggatttgtttatttatgtaaattcgtttagggtggggggcgtggtgagtaggttcggcggttttagttcgtcggttcgggagtttttttgtcgcgtttttcgttttttttgaagtgatatttggggttatttataggtaggaagggggtgtggagtggagttggcgttgtattttttttttttttttcggatttatatcgagggttcgtttggttttttacggaggcggtgaggcgggtattattttttatggacgcgt

SEQ ID NO: 7367 - DNA, 2401 bp, synthetic construct; identical to SEQ ID NO: 7143
  misc_feature 1..2401: note = Description of Artificial Sequence: Synthetic polynucleotide
  source 1..2401: mol_type = other DNA

SEQ ID NO: 7368 - DNA, 1579 bp, synthetic construct
  misc_feature 1..1579: note = Description of Artificial Sequence: Synthetic polynucleotide
  source 1..1579: mol_type = other DNA
cggttcggtgtacgtcggtgttattttcgcggttaagtttggggttgatattatgtagtatacggcgttatttataatgtatcggtttttttttgttatatataggtacgtatatttattttcgcgttcggagggagtttagggttcggttcgtgggcgtttaggcgtcgattttttcgatttcgtatttatttagaagttgtatcggtcgcgatttcgttttggcgttttcgggggtttggggttcggtcggcggcggtcgcggcgagcgatttcgggtaggatttagttagcgtcgaataaaggttgcgcgtaggtagcgggcgtcgtttgtattttcgtttcgcgtttcggcggcggcggcggcgcgggggttcgggcgggttcggcgttcgttcgtttcgcgttgttcgtttcgagggcgtttcggttttcgcgttttcgttcgttgttgttcgttatcgtcgtcgtcgttcggttatcgtatcgtatatattaattatttatcgttcgtttttagtttttcgggcgaagttaattataggcggaggtttcgttaatggggtcgtcgtcgtcgtcgtcgaggaggtagttagtcgcgcgttcgggcgtaagcgatagttttttagggacggggatgggtcgggggcgcgcggggggcgggggcgtacggggcgcgtcggagaaattttttacggttcgcgttttgcgtcgcgttcgcggattttgcgggcgtgattatttattttgcgtgtgttcgcgtggggttgggggtttcgggggaggttaggttagtcgcggtggggggaggggagggaggaggaggaggagcgcgggaggaagatgaaaggcgagtagatttgttttggcgtttttagggagtttcggttcgcgcgcgtttttttcgtttcgcgagtttcgtcgttcgtatttcgttttttagttcgtcgttcgtatttattcgcgcgcgtagatcgttagtttagttatttcgttgcgagggagcgcgagcgagtatgaatcggaggtagtttatattttaaatttgtacgtaggggtggtgttggtgtacgtcgttgtcgagcgaacgtacgattcgacgagtagtattttagttttcgggcgggggcggcgacgaggtttttttttttttttcgtttaggtaattaattggaagtaatatttgtgcgagtggggttttcggagcgttgtcgttcgaggaggtcgtcgggaaggcgttggcggtggatgatttcgggtgtttttcgttttttagcgaatttttttaagtgggtatgttaatgagggtttacggcggggagggggtggaggagggagttgaattggagggggtttcggtcggggggaggggaggggaggggaggggagggcggggttaggtatttagattaaatttcggtttaaaggattttcggaacgggttacggggtggagaaggtaggcggttcggtattttatttttttgattttgggtgttttggtattttcgggatttttcgagcgaggggtttaggatagggtgaatacgcgtacgtacgttttcgtttttcgatttcgg

SEQ ID NO: 7369 - DNA, 919 bp, synthetic construct
  misc_feature 1..919: note = Description of Artificial Sequence: Synthetic polynucleotide
  source 1..919: mol_type = other DNA
cggtttatttatttcgcgcgtttttatatacgttttttttcgattttttacgagtatacgttcgtttcgcgtgttcgtttttttttgtttttcgtttcgattttacgtttttttttttttttggatttcgttttttggagcgcgttcgtttttttttgttacgtttttttttttttatttttttttttttttgttcgttgttttttcgtgcgcgtttttttttttgtatatcgttttatttttgtcgtaggttcgatttttgaacgtttttttttttttggtttttttttttggcgcgcgttttttttcgtacgattttttttttttgtcgggcgtttcgcgtttgtacgtttttttttttttgtcgcgttttttttattttgcggcgggtttttatttttgtacgttttttttattttgtcgcgttttttttattttgtcgcgttttttttattttgtcgtttgtttttatttttgtacgtttttttttttttgttgcgcgtttttttttcgttgtttatcgcgtgttttttgtttatttattcgcgcgtttttttcgttttgcggcgtttatattggtttttgaggcgcgagttttcgttgtttggtaacgggacgtcgtttttgggtggcgagtaggcgcgtgtgtaggggtgagcgtatcggaaaggttcgaattgtttttgggatttgtttttttagtttcgttgggttcggcgggtagaggcggttttgatcgttgggttttgggcgtcgagtaggatttatttgaggcggagagaggtcgtttcgcgtttggggttttcgaaagcggttagttgtttttttgttttttttgagcggggagcgttgcgttttttgcgggttgcgggagatttttttagattttcgggtgggaaaattatattgagcgtttcgg

SEQ ID NO: 7370 - DNA, 944 bp, synthetic construct
  misc_feature 1..944: note = Description of Artificial Sequence: Synthetic polynucleotide
  source 1..944: mol_type = other DNA
cgttgggcgaggttagggttgcggtaggggagtcgagtcgggagaggggcgtaagatttggcgttgggcgggacgttcgggtagggtgcgggaggggttgagggtcgtttttattgttttttcgttttggagttggggttaggcggtcggagattggttggggcgtacggcgaggttcgggttggagtttcgaggtgggaggcgttaggattagtcggggcgttcgtagcgtaggttgttatttatttgggcgatttttgcggcggcggcggcggcggttgggtagagttagggtcgggggcgtacgtcggaatatttgggtcgtcgggtatcgagcgtcggggggttgcgcggcgcgtatttggagagggcgtagttatgcgggcggcggcggcgggggggggcgtgcggacggtcgcgttggcgttgttgttgggggcgttgtattgggcgtcggcgcgttgcgaggagtacgattattatggttggtaggtcgagtcgttgtacggtcgtttttattttaagtcgtcgtagtgttttgatatttttgtcgatttgtcgttttgttatacggtgggttataagcgtatgcggttgtttaatttgttggagtacgagagtttggtcgaagtgaagtagtaggcgagtagttggttgtcgttgttggttaagcgttgttattcggatacgtaggtttttttgtgttcgttttttgcgttcgtttgtttcgatcggtttatttattcgtgtcgttcgttgtgcgaggtcgtgcgcgtcggttgcgcgtcgtttatggaggtttacggttttttttggtttgagatgttgtattgttataagttttttttggataacgatttttgtatcgtcgtgtagttcgggtatttgttcgttatcgcgtttttaggtagcgtcgtcgtcgtcgttttcgcgcgtttcgacgg

SEQ ID NO: 7371 - DNA, 1096 bp, synthetic construct
  misc_feature 1..1096: note = Description of Artificial Sequence: Synthetic polynucleotide
  source 1..1096: mol_type = other DNA
cgagtattaggaaagcgaagttatataacgcggttttttttagtttcggcgcggtagtttggaggggatgttttttttgtaaagcgagttttttaattttttcgggttttggcggagtttcgggatcgcgtaggggtaagtggagtgtcggggaaggggcgttggggttggggtgtcggggtaggggtgttttgttcgtacgtatttacgatagtgagtagtatgttgtttagtagtagcgttaggaatacgatgaataggatgagttttcgcgagcggcggtttttttgtagttagcggattagcgttagttcgtttagggttatggtttcggggtttcgttgcgggcgcggtgcgcggtgaggatttaaggcggtcgtggattttttattttttcgttttttaggtcgcggaagggcgggttagggagtcgcgcgtatcggtattcggggatattttcgggcgttttagtttcggtttatttgtttcgagcgcgtttttacgagagttcgcgttttttggaaagagcgttcgcgagcgtcgtcggggatttaatttggagatttaatttagaatttttaggacgttgttttgattttcgtcgtttttaattgtgttattttttaaattgtacgttcggtttcgtgtattttgcgttttgcgttttgcgtttcggttgtttcggggttttcgtagtttcgttcgcgtagttttgggggtttttttgtttttttgtttttttcgggttcgttttttttcggtatcgcgttttgcgagtagggaatcggggtcgtgttatttcggggtcgtttgcgatgtttgttcgggtttttcgtgttcgcgttaacgttcgtatcgtagtgggtttcgttagttcgggcggtttcgggtcgtagttttcgttttagcgtttcgtcgtcgtcgtttagtttatttcgttcggttttgacgttacggtcggagggagcgggggcggggggttggggcgtttcggttttcgttcgttcgcgtcgtcgttgcgtaggaggggttgtcgtttttttgttttcgtttcggtcgcggtcgcgtttttttttcggatttagcgcgtggtcga

SEQ ID NO: 7372 - DNA, 4048 bp, synthetic construct
  misc_feature 1..4048: note = Description of Artificial Sequence: Synthetic polynucleotide
  source 1..4048: mol_type = other DNA
cgtacgtttagatgggtttttcgcgttcgggtcgtagttatttgagttttcgtgaggttgaggttgtgtgttagttgttttttttcggcgtttattacgtagtgattttttttaaaggcgtgttttagttttagaagttgggacggggagaaggcggttcggattcgtttgggttttcgggttagcgcgttgtgtaaaaggaaattttcggggttagtgtcgttttttgcggggagtatagtagaaattttattagggggggttgttttgatcggagtcgcgtatttttttcgagtcgggttggttcggtatcgtgtttagggttttcgtatagtcgcgtcgttcgatttgcgggggtcggtggtttttttaagggtttacgaagggaacgtttgtttagttgttcggttcggaacgtcgggtttttatcggtgcggtatttaattagtcgttgtcgtagaggagttagtttttaggtttttgatttcggtcggtttcgtagtcgttttggcgtcgcgggtttcgttattttttcgtcgggcgttggaggtaggggagggagtcgtagagtttggttaggggattggcgtttataattcgaagaaattatttttttttttttttaatttttcggggaattttgatttacggtggaaaggcggcgggttgttttttagagtttttatggagatttatttttaaattatttgttttattgttttttcggaaaagtatagaggcggggcgagtcgttgaagttcgatcgggatagaaatttggtcggcgggtgtgtttggttatagtcgttgttgtttttcgcgaattgggtttcggggttttcggttttcgagaattagaagagaaacgcgagcgaagggatcgaaattcggggggttatcgatttgtagatatcgttaggatagtttgtaacgtaggaagattttagcggtttcgggtttggtgaggggattataagtatgattgatagcgaatgaggaagggtagttttaaattttttaagtaaagttttagagttttgggtttatttattagtataggaaatcgatttatcgaaaatttaaataaagaaaaataagtcgatagtttaggtaggatgtaggtaaatttagttcgggattaagggtaaaaggttttttgggtttttttttttttggtttgattttttaaaatatggggaggggggtgatatttattcgattttaggtttcggtaggaacgtaatgggttaatgaatggataagtcgcggagtattgatcggttgtcgtcggaggtaggttttttattgattttaattcgtaaattaattatttttttttttgaagttttaatttttttttttttatttcgtatttagagaaaaataaataaataaaaaatatcgtaagaaatgaaaatatacgaatagatatttttttttaagatagttttttgattaggttttttttttttttttttaaagaaagaaagaaaaataaaaattagatcgaatttgttttttcgttgtggttgttcggcgttttaattaagtaggtcgcggcgagagcgttaagttttggagtttttttttcgtacgggttttcgtttttttttaggttttcgaaaagtaggaaagaaaaaataaattttatatttttttttcggggcgcgaggattttttcgtttttagaagagggtggaagattaagaagtcgcgggtttggattgaaggggcgtaaagtgggtggtgaatagggtcgaacgtagtcgaaagtaagtttggcggtcgagttttgttcgcgtttttcggagttaggacggttgggggtattgtcgagggtattaggagtttggggatttcgcgggttttgggtttcgcggcgtcgggtacgtatagtttagtttgttttgattcgagcgtattgggggataattttttcgttcgtatttttttttaaagggttaagcggttcgtaggttattattttaaattagtcgtagtttcggagattggggatcgatattacgttcggtttcgcgtcgtttagttttttaatagggcgcgttggttcgcgagtcggaggaattttcgtttaggttttgttaagcgtttattcggagtaggtcgggggtagtgaaggatgcggcgggagcggcgcgttgtagtttcgcgacgtggtacgtattttggaagcgatgatttagatatcggtagcggtggatgagttaggggtagaaggtggacggatttcgttgttgcgaggcgaatagggggtgtggcgagtgcgaggagggtagggggtgggcggttagggcgtgcggcggcggtatcgggtgtattggtacggcggggttgggcgggtgcgagatcgtttcggcgaatattaagttcgggttggagtagacgtttttatcggcggcggcggcggcggtcgagtggaagtcgttgaggaacggatttatggggttggagttagcgtagttgagtgtcgcgggacggatggggttttcggagcgcgaggcgggtaggggattgtttttggttattagcgattcgatggtgaagtagcgtttgggcgtcggttggaatatgttgcgtcgaggagcgggcgttttgggtttttagtttttggcgatcgtcgtacgttgttttcgtcgttcgttgttcgcggcgaggacggacgagaattggggattcgtttgtttggggtgggggtgggggtggggggaaggaaaggaagaaagaaaggaaaggaaaggaaaaaggaaaggaggggggagggagagggagaggtaaagtcgaggatttcgagaattttgtattaaacgcgtttaatttgaagagaggggggaaaatttttttagaagaatttgtaggcgtggattggggtaatttttttttttttttttttttttttttttttttttttttttttttttttttttggcgagatggcgtggggggatcggagttagaggtagggaggagaaggggggaaagttttcgggggaggtaaaaaaaaaaaaaagtttttttttttttgtaaaaggcgggtagggcgttttaagtttaaggataatttatggaagtgttcgtttttttataagttgtgtaaacgatttgttagtttatgagtttaattagtgcggggattatataaatagtttttttcgaagtttggtaaatggtttgatgattggtcgttattattcgttttgaggtggaaggggggagattttttaaagtgcgttagagggaggtgagcgtttgggaattcggaggtttggattcgggtcgagagtggaacggagtcggcgtcgtcgtttcggttgagttttttgtcgtttatcgggcggtcgggttttttcgcgttttcgtttttcgtttttagtttattcgtttttgcggcgttcgttgcggtttttttttttttttcgtttttttttttttttttagttttttttttttttttttttttttttttttttttttttttttttttttttttttttttttttttatttatttttttttagttatcgtttttttttttattagtattatttttttcggggtatttcggtttttgtagagtttttggtcggcgtcgttttcgttgcggttttttgaatttcgagtttgtttcgtttaagttggtaggatagaaggatagatagatttttttagtttagcgtttcgtcgttgttgttttacgcggtttcgcgtcgggagaattgggatcgttttaagagtatcgcgagggtaagcgggtaggggttggttttcgggttaaaggcgtcgttcggttatattaatttttatatttagtaaaatttttagcggttttttaggttaggagggattttggagtgaggggtacggggtttttttattttattaattacgtttagtttcgaggttttagggtcggtgcgttcgcgatttttgattcggttcgttcgtttgcgagttgagatcgggagttgtcgatttcgtcggagtagtgggtttttaattttttttttttttcgttttacggtttttagcgt

SEQ ID NO: 7373 - DNA, 3292 bp, synthetic construct
  misc_feature 1..3292: note = Description of Artificial Sequence: Synthetic polynucleotide
  source 1..3292: mol_type = other DNA
cgcgtttaagttttagtttttgaaggtcgttggatttttcggcgttttcggttcggtttagtttttttcggggttcggataaggaggtcgggcgtttttttttttatttttttggggttttagatcggtcgtagtagcggtacggaagagattatcgggtgcgagtagtagacggggtgcgggaaggtgagtagcggttggttgattggtatcggggttttcgcggttgtagtcgtcgcgttttcggtcgtcgagttttcgtggtagaggatgggtattcgtacgatgcgttgcgtcgcggtatggtttaggttggtcgtttttagtttcgtcgttagttgtcgtttttatttgttgcggcggttttggaattagattttgatttgcgtttcggtgaggtgtagggacgcggttaggtcggttcgtttcgagttgtttagatagcgttttatgtcgaaggtggattcgagttggaagatttggttgcgcgagaagattgtgcgcgttttttttttgcggtacgtcggttttttttttggatttttagcgttttttttttagttttttgcgttcggagtggtcgtcgtcgtttttacgttcgtttcggtcgcgtttggcgtcgtttcgtttttttttttgtttttttcggagtcgtttttttttagaatgatttcgttcgggtttttggagtttagttttttgtgatcggggtcggttttgagtagtggtttcggagagtcgcggtttgtgtcggaggcgggggaggagttttttagtaaggtttttttcgaggttggggagatagatagacggacgtatatatatgtatatcgatatagttttgagcgaggttcggcgtttggggacggtaggtttaattcgcgtcggtttttaggttttaggttatgaggttttattattttcgcgggttgtttttttttcggttgggttagagaagggacgtcgagttttgggattttttttttttcgaggataggtaagtagatggtggtagcgcggttatttttttttatttttttagttttttcgttaggggtcggtagaacggttttttttcggtttaggcgtattggaattattttttttttttaggtcgtgttttaagtttcggtcgttcgaagtttttttatttacgttcgaggttatttttttcgggaagtatcgtgttcggggttttaattttatttttttttttattaagtgggattggattaacgggtagcgtaatttagcgcgagggtaggttaggggtcgaaaaaaattgatcgagtagagggtttgcgggtgttggggttttagaattgcggagggaagtagcgcggggcggggacggggcgggcgcgtagggggataacgaaagtttaaagagaggtcggtatttttaggtcgcgggaggtggtcgtcggcgggggttagggtgtaggggtattattaggttggggagcgttttaggtagtgcgcgggtagggtaaatttttgcgtcgggattttaaagcgagggaaagttaggtcgtttatttgcgagagcgcgaagttcgcggcgttttttagggtttttttggtcgttgcggtagcggtagcggcggcggcggcggtagtcgaggttggcgcgaagagcgttcgtgggggcggttgaggtttagggggcggtcggtggtggttttcgttgagtaggtttttgatggagaacggggattttttgggagcgggtggggggggcggcggcggttggggttgtgcgttggcggtgtcggtagcgttcggttcgggtttcggtatggttttttttttttcgggttttcgggagggagggagcgggataggcgggcggcggggcgagtaggcgagaggtcggaaattagattataaacggaatttaattacggggcgtaaagtcgggggtcgtttcgggcgtaaatttaacggcgggagggcggagtgaggatttagacgggcgggttcgtatgagggaggggtgcggaggggcggggagcggttttgtcgcggtatcgagggatcgaggcggttcggttgcggttgcggttttcgcggaggaggtagtaagagtagttttcggttcgaggttgcgttaattcggcgtcggatgttaatgatgaaattaaaatgttatttaagttaaatgcggggagtatacggcgattgggcgcgtataatggtaaatgggattaggtaggcgaaggtttagtcgagtttcggtttcgtagtcgttttcgttatcgtttttttttcgttttttttcggattttggcgttttggtttcgggttataagagttcgttcgttattggttttatatagtttaattaggtagtaaatgaggataagtttattagtataaaaggatattggttttcgttaaagaggtattcggagcgtttttgcgagcgtaggaggcgagcgagggacgcggagtaggcggcgtttttggtcgaagcgtattaacggtcgcgagttcggagatcgcgtttgttttttttttttgcggcgtagggattcgtttttcgtcgttaggtttgcgggaggggggaggggcggattaggttttttcgggttatttcggggttatttgcgttcgtagttgtcgttttttcgttttttggggttggataggggttcgtcgtttttacgtagttggagagttacgtagcgtcggtttaagaggtaggacgtgatttcggttttcggagaatttattatttttttattttttggggttcggcgatttcggtattttttttaaagtttgttaggaagggcgaggttaagaagagagggatttgggttttttatttattatttagtcgatagtaagggaatttaggtgtaagttttcgtattgcgttttcggatttagaaattcgcgtggttttggtttttagttttggaaaatcgaagagtgagttttttttcgggattaggagtgggtgtgtttgtgtgcgtatgcgcgttgattcggttaaaattcgcgcgttattcggtggggttgttggggtaatagtttttcggtatcgacggttgttttcggaagggtatttttttgttttggtcgtcggtgtttaaggttcgcggattaatttcgagtttgtgatttcgacgatagtatttttttttaggaagttttttcggttagttggcgtttggagttgtttaattaacgttttaatgggggtaaggtgaatcgaaggcgtagcggcgtagtttttttcgtcgcggtaagtagcggtattcgttgcgcgtttcgacggtagcga

SEQ ID NO: 7374 - DNA, 3753 bp, synthetic construct
  misc_feature 1..3753: note = Description of Artificial Sequence: Synthetic polynucleotide
  source 1..3753: mol_type = other DNA
cgcggttattttttcggtgtagcgtttttttagtttttgcgcggtcgtaggtgttagggcgaggaagttcgtgggcgttttcgtcgcgcgttaaggttttatttagagtaagcggtcgcgtgttagtcggtgatttagttatacgttgaattaatgtaaattattaataataaaagagtgtagggaagcgtttttgttttttttattttttttgtttggtttcgggtttcggattttttttgagtcgtagaattgttttatcgcgtttagtttttttttcgcgcgagatatataattttgttatcggtcgggtagttgggcgtagcgataagttggtcgcgttaagttcgcggcgagtaaagtggaggttttattaggtataagtagcgttatcgtttgttttatatttttggagaggaagtgcgcggtatagggtatgttatagcgggagttgttgtggttaagtttaaggcgagtttagtgtcgggaatatgtcgttgggtatttagttcgtttgtttttagaaggtaatcgtttaaatggcgaggtttgttttttagtttttgttttttttcgcgcggatttttgagttggattttagtcggggtgcgttttagttcgcgcgacgattttgggcgttaggagggagagtgggcgggtagttttagttacgtgtagtttgggcggcgttaaggtttcgatttttaatttttgatttcggttttattttttacgtggagcgagttaaatttttatagatagacgtatgtaagtttttttatcgaaaaatttgaaaatttttcgtgcgttattatgtcgggtaattaagtttattaaagttagtaaagatgtttaaaatgttttatttttttttttttttaaaaatatttatagatttgaattttttttttttcgtttttattattttcgggatgagggaaacgaaaagaagtaatttagtaattgtttaaagtttttgagggtttggtttggtcgagcgtgtatgtatgtatatatatataggtgtatatatgggggaggagtgtatttggttttgtaggtgtttttttgatttttttttttattaattatagtttgtttggttaaaatttttttttttattattattcgagaatattttatttcgaatggtttttaaagcgtattggttcggtttaggtaggaagtaggttttttgatttagggaatgttaataaatattcgaaataattaaaataaaaagtagggtagagattataaataagagttaatgaatatatatggtgtatttttttatatttttggaaatacgtcgttttgtttcggagttttgtttatagtatagtacgcgttcggttttgcgggtagttgggggcggcgcggggcggcgggtcggttagtagtcgagtttgttgtataggttgtagagaggtaaggtcgagaggttgtttttcgggtagtagagcggcgcgggaaaggcgagcgagcgcggtatcggtacgcgtagtagcgaattgtttcggaatattagcggtatgtttattagagtttgcgtcgacgcgtgcgttatgttggtcgtttttagtttagtcgagagttgtcgtttttatttgttgcggcggttttggaattaagtttttatttgggttttcgtgagttgtaggttggaggcgaggtaggcgcgtttcgagttgtttaggtagcgttttatgtcgaaggtggattcgagttggtatatttggttgcgcgaaaagacggtgcgcgttttttttttggtcgcgtcggtttgtcgtttagcgtcgtcgtttcgcggtcgttcggatttcggcgagggcgagttcgcgggtaggagttttttttttttttttttaaagttcgagtgcgaaggagagaggaaaggcgtgcgttttaagtcgttcgggttcgagttttcgttgtttttgggggtatttgaggagcgagaatagatagaaaggttatggagttggttggggagtttcggagatcgttagttttttttgggattaagcggttggtaagcgtttgtagttttggttttattttattaattttttttttttattttttttattggttttttaaatttagtatttcgttttttaaaagcgataagagagggatttagttatttggagtatggggtttttgtgtttttatttttatgaatgggttaggggtaatagggagaggaggtttggagggggaaatattagtatggttttaaaaggcgaatttgtttggtggtaattgagttggaagagtttttcgagttttatagggtggtattattttataggtcgtttgtttggaaattacgttaaggattaacgtaggattttttttcgttaaatgttgtaaagaggaatcgtttttgaaatgtattattgttaattattttggagtgttaattattttaaggaggagagagagagaaaggtagagatacggagcgagtgaggaagaagatttagaaagagattacggtggagatagattgtttagattcgatttgtagatttttatttcgtgttcggaaagaaagtattagatgtgtagtgattgaggatagtcgggtgtaaggtcggtcgcgtgtttttttcgttgtggtttatttttttaataatttaattttttttaggaagtttaagtcggtacgggtttgtgttcgtttgtttttaggggtttatcgggcggaggaggtattatagtgcgcgttttttttttcgcggtttcgaattttcggttgtcgtagttttggttagagggggttcggcgcgggagttttggcggggcgtttagttttttttttttcgcgttcgttcgttgttatattggcgacgtgcgatttttatttaggtaaggaaaagggatggggggatggtgtttggggttttgttttttagggtcgtgttggtttgggtagaagtaggcgggcgttttttagtcgtcgttcggttttttttttttcgaggatacggataggttgcgttttttggttggttagtcgacgggttttcgcggtgttttcgaggggttttcgtttaggatggattggatggtgaagttggagacgttatcggtcgtcggatattttttgttcgtattttttttgttgtttattttgggtttataagaaatcgaaggaaattaagaattttttttagagacgatttgggtgatttgggtggaaggtggtgtagtaggtaggtagtggggaggggcggggaggaaatttagggggagggggcgtcgaggttggtgaggcgtttttttcgcgttagggatatgtaggtatcggatggttgcgtaggggtttttgttcgtttggttttgggtgcgttcgtttagtttcggtgtaaatgtttttttttcgttcgttaattcgtcgggttttcggcggcgcggaggcggcgcggttttatttgtatagaggttattcgaacgcggttaatcgtagcgtcgtcgagcggtttcggaaaattttaaaacgtttcggttaggtatatagtatcggtgcgtttttagagcgcgtcgagggtttggcgggtattagcggcgtttaattaggggtagttagggttgaaagtagttgtagattttagttcgggtttttggcggttgcggtaatttcgattttttggattttttggatttttttttttagaggtaggggcggtgcgggattcggagttggagtggttcgacgttttcgtaggcgacgggttttcgcgt

SEQ ID NO: 7375 - DNA, 829 bp, synthetic construct; identical to SEQ ID NO: 7364
  misc_feature 1..829: note = Description of Artificial Sequence: Synthetic polynucleotide
  source 1..829: mol_type = other DNA

SEQ ID NO: 7376 - DNA, 1328 bp, synthetic construct
  misc_feature 1..1328: note = Description of Artificial Sequence: Synthetic polynucleotide
  source 1..1328: mol_type = other DNA
cgggcgagagatgtttttttgggcgtttagggtcgggcggggtcgcgcgtcgggttgtgggtcgcggtggagatttgattcgtatttcgagggtttttagagagtcggggagcgagtagtagagttatcgtttttagttttagtttgaaaagttggatcgtgtcgtcgtatgtgcgtttggtagtcgggcgtttcgggttttgcggttatattattttggggcggggacgtgtgcgtttcgggcgttcggacgttattgagttacgtttgagtcgtttattttcgggggtgagcgagtcgcggttcggggcgggattttggcggggggattcgagcggtttttaggattcgcgggacgtcgttaattggcgggggtgcgggggagataataatttgtttcgcggtaataagaacggtgattgttggtcgtggatttattttataggtttgtttttttttattaacgttttttttagttttcgggttaattcggatagtttgtttatttattgtaacggttaaggttggtttgtgttagaacggcgcgcgcgcgcgtacgtacgtatatatacggggggaaatttttttaaaaatgaaaggttagaagagtttagcggcggcgcgggcgttgcgcgagggtttcggagttgattcgtcgaggtaggaaattttttcggtcgcgacgttcggtttcggttcggcgttcgcgtgggatggtgtagcgttcgtcgtcgggttcgagagttgttgtattgaaggtcggcgacgatggtagcgcgttcgttgttcgtgtttttcgttcgcgtttttttgttcgttttggtcggtgttttgttcgcgttttgcgaggttcgaggtaagtcgtcgaattagggcggttcgttgttcgtttcgtcgagggtatcgtacgttgcgtttgggcgcgtcgaggtttagggttgtttcgaggggcgacgcgtttcggcgtattttcggagtttcggggtttgcgtttttagcgcggcgagatcgattttttttttttaggtgttaattttttggggaagggcgatatttggttcgtagttttataggagttagtatttgtttcggagggtatagtttcgggatcgttttttcgtttttatttttttgggtgatatttgtagatgtttttgtattttgatatttatacgtgttattcgggacgatgcgtgtcgggtttttttgttggttttatttcgtagtgaatatttttattttaggtttcgggttagttttttattaggttttttttttagtttcgtttttttcgttaatatatttaggggggcgcgtagcggtttcgt

SEQ ID NO: 7377 - DNA, 2957 bp, synthetic construct
  misc_feature 1..2957: note = Description of Artificial Sequence: Synthetic polynucleotide
  source 1..2957: mol_type = other DNA
cgagtcgttttcggttttgcgtttttttttagggtattaaggtttttaacgttaatacgtggggttgttattaggggaaatcggaggtttgagtttagtatttttggattcgtattcggttagtttttagtttttttttaaatttcggttttttttcggttgtagaggaggtgattgaggcggaagtcggcggtcgcggtttggtggttaggggcgaagttaggggaggggttaagggtttggggagcgtgggtggcgattgtcggtggtcgtttttcgaaagaaaagtcgttcgttaggttttcggggaaggtgttaaggtcgttagttagagcgtttatagtagaagcgaaatcggagaagtaggtggcggtttcgggtgcggatggagagggcgaggtttgtaggtttaggtaagtcgcgttcgggggttttagcgttggcgtttcggttttttttacgtttttggttttcgagcgtacggtcgcgttggttttagttttttttttttttttttttcggaagttttcgttgttaaatattttttcgtagttggggtttagggtttagtaattgtttttatttgtagaagaagaaatagtttagtttagaaggttcgagttttgacgggtcgtggtgtgagttagcgaggaggttagttttagaaagattttttgttggtttttatagagggtttgagttttcgtttttattttatttttgacgggtattttgtattcgatgggtttttatagtaggattgggaagaaagtgataatttagaaaggaggaggaagggagttttgggaaaggtcgagtttcgttaaggtgaaggaaggtttgcgagatgttaatggtgggatttcgttagtcgttttgttaaggatagcgtagattacgttaggtttttaggtaggttttagagttttttaaacgggtattttatttgttttgtttatttttggggtaggcgttgttttttttattttattaggtagggtattgaggtttagggaagttgagttatttttaaggttatttagtttgttggttttttcgttttttttttcgaaggagcgtatagagattgagagtttcgggatcgtcgtattgtaaacgcgggtttgtggtgggtttagtcgttgtttgagaatttgtttatgtttaagtattttttttttttttttttttttttcgggtatttttaatcgcgtagggagaaattaggttgtttaaggtgtttttattttcggagtgttcgcggttcggcgggaagatggggagttttggacggagcgagtcggcgcgtcgttgttatttgggtcgttttcgtcgcggggtatttttttgaagtagtcgttgagcgataggttgtggcggatggagttttgttagttcgttttgttgcgtttgtagaaagggaagttattagttacgtattggtagatttggttgagcgttagttttcgtagcggcgcgttttggatggttatggcgatgagcgtcgagtaggagtagggcggtcgtattagttttagtagtttttgttggtcggagaggtttagttaggcgaggtcggcgttcgttaggtcgttcggggcgtcgaggagcgggtcgggagtttcgtagttcggggtcgcgtagggcggcgtaggttcgggattcgaagcgtaggatttggggttgagcgttggcgcgtttatttataggagggggttttcgtttatcgcgtttagattttttggtttatagttcggggggtgcgcggtggtttgggtttggtcgggcggggtcgaggaggggtttaggtcgtcgtagtaggtggttatgtttagtcgcgttcgggtttgggttagcggtgtcgtatcgaaatttattggcgatttatttagtttggtcgttagtagcgttcgggtgcgattagttcggtttagtttttcgttttttaaatatcgtcggggttagagtttatggagagtgacggtggcgagttttttttttggtagttttggaggagcgaaatttttgttttcgttttggtgttagtttttcgtttcgtttaggtttgatacgttttggatcggacgtttttttgatttttttttttttttttgtgcgattcgtttcgagtttatagtcgttcgcggttttggttgtagggattttaagttcgtagtttcgtttggttttacgggtttcgtagtttcgattgttttggatcgtattacgattttttaaggtttttagggttgtggtttgggagtttcgtttaatgcgcggtttttttgttcggttcgggatatttcgttttaaagaaattcgtttcgtcggggtttttgggttattcgggattcggggttagggatagagggcgattatattgcgtaagagatcgtaatgaagttcgtagatttttaggttggagtcgtagagcgaggtggcgaggtggagaacgcggggttgggtttggatagcggttttggggtcgtttggagttttcgtttttttaattcggaaggtagcggattgatatttgcgtcgaagtcgcgcgtattttacggagggtcgggattttggaaatttcgaacgttttagtagtttagggtagttatcgttttttttaagtcggggagttcggggtttcgttaggttttttcgcgttgtgatttcgggcgcgtagagcggagagcgttaagttttttgttgggtgtcggaggacgcgtcgaaaatagggacgtttttgtagtgcgttcgatattagttttttagttttgttgtcgttcggggttgttgtagttcgggttatttcggttttttaagttgttcggttttcggttttttttgtttttcgcgttgtggggtggcggaggatggatttaggttgacgttgggttgggtatttggaaagagggttcgtttttcggatttcgagtcgggtatttgtgcgaaagaggcga

SEQ ID NO: 7378 - DNA, 1860 bp, synthetic construct; identical to SEQ ID NO: 7150
  misc_feature 1..1860: note = Description of Artificial Sequence: Synthetic polynucleotide
  source 1..1860: mol_type = other DNA

SEQ ID NO: 7379 - DNA, 1422 bp, synthetic construct
  misc_feature 1..1422: note = Description of Artificial Sequence: Synthetic polynucleotide
  source 1..1422: mol_type = other DNA
cgcggggagtagaggtgtttagatacgcggtttgttttcggtttttattttatagagttttttatttcggtattgagttcggaagttcggttattagttcgttattttataatttttttagtttgggagtttttatacgggtggtcgttttttcgtagcggtttagtttttagttgtaggattttcgggattttcgtatttattatgagcgttgtaaagttgcggaagcgtgagcgtcgttggaggaggcgtttagggggaggcgattaggtggcgttttgtttttcgttagtttttatggtttttggaaggttaaagttttagacggcggttaggaggtcgcgttttcgggtttttggttttagggtgatcgcggcggggcgggcgtagttcgggagttgtttttatttgtgaagatagcggcggttagcggggcgggcggagggttttcgcggagggtagttcgtagtttcgatttcgttagggagtagtcgcggtttttgtcgttttttttttttcgcgggcggtttgggggttgcgtttggggttggcggaggcggtgtcggtggggatcggtggggggttcggatcgaacgcgttagcggtagatgcgtttttttttttatatttaaaaattaatttgcgttttattttcggtttcggagttaaatttaattatttcgggttgtataaagttagaggcgcgtcggggggtttgtatcgggaatcggtatcgagtgattcgttcgttttagttcggtcgcggcgtttgttttgtttggatgtggttcgagtttcgggtcgggcgcgcggggcgggggttttggattattcgtggcgtttttcgttttagcggagtcgaaagttattcggagttgtttttttcgcggttagtgttatttcggggcgcgagtttttttgtcgagtcgcggtttcgcgcgtttttttcgtcgtttagattcgcgcgttttttttatttgttgtggtcgaagcggttgtcggggcggtcgggtcgcgttttcggagatagacgcgttgcgtttttttcgtcggggattcgttttttattcgcgagggtagcggtcgagttgggatcgagttattaatagattgcggggttgcggcgtcggtcggtgagttatagtttcgcgtacgagcggtttagttcggttagtagcgtcgtcgtttttgcgcgtatttttcgcggcgatagcggggattcggggtcggaggtaggcgcgtaattatggggatcggggcgggcgatggcggcgggcgggtttttgtcgtagggtggggatggtttttttagtcgggcggtcgtcgttatattgtagagcgtatttaaagagatatttcgtttcgcgttcgttttttagtattagattttcgttcgaaaacgtcgtcgggcggattgtacga

SEQ ID NO: 7380 - DNA, 1479 bp, synthetic construct
  misc_feature 1..1479: note = Description of Artificial Sequence: Synthetic polynucleotide
  source 1..1479: mol_type = other DNA
cgacgagtttacgaattttatcgtggtcggcggtagtcgttggtcgagtttagcgtttaggtttaggttatttttatgtcgtgcgattcgtcgggaacgggtttaggttcgtttgtttaaggttagaagtattttgttttcggtttaacgtcggatcgcgtttcgttttttttattttatattaaggaaaggaattagacgtttgggagaaaggatgagtagtattcggtgggattcggttttaattcggggtcgtttttaatttttaattttttagagtttttttcggtttcgtttttttttttacggtttcgaggtcgtcgcggttttttttcgttttgagtgtagatagttcgggaagtggagagcgtagttcggagttagggagtcgtttttaggagttttggcgatgggagcgtaggtggcgggcgtggtttttttaattttgttttagtcgattcggagtcggttttcgtgtagtagttatcgttcgggttttcgtttggttatagtattaggttatagtgcgttggtttttgattatttttttggttcggtggtcgtttttcgtttttttttagttcgcgtcgttgttttgttttaggtttcggtgcggttttaagttttagtttagggtttttaggtttttttaggcggcggtggcggtatttatttgggtcgcggagtcggggtttggtacggtttcgtaggtggtaaatgaaattttggtagttgtcgtgttttagggttttacgggtatagagttcggttagtagttgtagcgtttggtgatagagcgcgtttttggtttcgggtatcgttttttcgtattttcggatcgcgtcgggtaggcgggcgtaggagatagtttttcgtttgttagtttagagtcgtcgttttcgggtcgttcgcgtttatcgttagggatttgtcgagaaacggtgcgagtttgagttcgagttttagatttagtcggttcggttttttatcggttgtatgtagtttttcgttagtcggtcggttaggttttttttttttttcgttcggttttttcgtttttttttagatatcgaggagaggcggtgtcgtatagtttagagcgtttttttgtttgcgtttcgttcgttattcgcggtcgtcggggggcggggttaggttaggagtgcgcgtcgtagggtaggatagcggcggttttagatcggggatttggggtatttttcggtttttggtcgagcgcgagatttggtttgggatttcgcgtttagagcggtcgcgttttggtttggggagtgtgagtgagtgcgcgtttcgggcgttttcgttattttattttttatttttgatgtaaattaagtattcgtttttatcgtcgagtgtgtttaaagtacgtttttggatgtttagtgcgaaggttataatttgggtatattcgttagatgcgtagaatcgagtttttgtttcgaatttggaaagagtcgt

SEQ ID NO: 7381 - DNA, 446 bp, synthetic construct
  misc_feature 1..446: note = Description of Artificial Sequence: Synthetic polynucleotide
  source 1..446: mol_type = other DNA
cgtgcgtttcgcgtattttgtttttcgcgcgacgtcgttcgcgtcgttcgcggttcggtcgggagcggtagttcgtgtttcggtttcggtttcggtttcggttggcgtttgtatttgcgattatcgtgagtagttatggcgtattttatagtgtagagagtcgttttggtttttgggtttgttttggttttgtcgttgttgttgtttaaggtttttttgtttcgcgggaagcggtaggagtcgtcgtcgatatttgaaggtaagagtaggttagttttttttgagtttttcggcgtcgaagagtacggagaacgttgtttgagggaggggtgattttgagagtttgtagtttttatcgaaatatttattaaattgattggagagggcgggcgagacggcgttgaagggttaatgtttacggtttcgttgttattagcgggtggcgg

SEQ ID NO: 7382 - DNA, 2991 bp, synthetic construct
  misc_feature 1..2991: note = Description of Artificial Sequence: Synthetic polynucleotide
  source 1..2991: mol_type = other DNA
cgtttgtcgtttataggcgtcgttgagggatagttggtttagtttgcggattttttttcggattttatatttatgtttagggaaagtcggagttacggcggtataaattagcgtttttattttgattatttgagcgagcgttcgcggttcgttcgtttgcggtataaacgtataaattttttgtagtattatatattatgttttagagataaatatagttttaggggtttttgttttggtaaagtaatttttatttataggaatagattataaaagtattataaaaagtggttttgaatcgggaaacgggttgggggtgggttacggttatatttgttatatttgggatcggagtgtattgggttttacgtttttttaaataatcggtgtatttcggggtagggtttaggtttgcgagggttttatttttatgggggagggcgcgagaaagttgaatttagttttttaaggtttagttttggtttatcgaggaatacggagcggttatcgtaatgggttttcgagaagggtgttgcgtggaaaaaatcgcgttgtgtttttgttttgtggggcgggggcggaaattttagttttttcgttttttttattttaagagaggtcgtttttaaagcgttgttgggaggggggtatttaagtttaattttttgggcgcgagggattttaggggtattatttttcgggcgggtgggcggttattatttttttagagtatttggtatatcgggttggggttcgtattcgtagggtattgcggggcggcgttcggtgattgggtggggtcgtcgttgttttttttttcgttgggggcggtagttttttgtttgcgcggaggcgatttagaaggtacgttcgttagtaggagggcgggcgtcgtagggttttcggtggagatgcgttttacgatgttggataggtagtttaggttcgatatcgtcgtatttttttcgggtttgggttttgcgcggggagggttcggttagtaagtaggggtggggtcgcgataagttttttattttcgggtttagtattttgagatagattggaaattgaggattttagttagagttcgggataatttaaaagatagggagttatttgtttagtattttattttttgtattattttttaggatataggcgtgtgtgagtgggggtgggagcgttttagatagaggttaggatagttttatgaaggaggaggagcgagtagggagaggttcggaatatttatcgttgggcgtttcgttgtagtaggcgttttcgtagtagtttcgtcgtcgggcgtcgttcggggggtcgttgtagtttatttgtaaatagtaagggcgattgagttaggttcgcgggacggttcgaggttcgaatattaatttttgtagtcgttttttttttaattttagtttaaggttttagtttcgggtttagatttgttttggttgggggggtaattacgggtgggtaggagatgaggtttgtaatatgtagggttaaattaagggcggatagttattaaggggcgtaaatttatattttggaagtagggataagtagagaaaaagatttttacgttcgcgttgtagtgttttaatagcgtttttaatggggtagttcgaacgtttgttcgtatatttttaaaataggttattttagtgatagttgtttaggataagggggttttttttttcgggaaggattttggtttaaatttttcgtaaggttagtttttcgttttcggaaacgcgtttttgatatttcgagcgtcgttttaatttttttattttttggggtttcggttttattatgtcgtcggagtagttggagcgcgggttggacgcgtcggagtcgtcgttgtagtgttcgtcgtcgcggttcgggggtagcgggttcggcgtatagaaggcggttgcggcgttagggggcgcggcgttttggtcgcgtagtagagtttgtaggttttcgatatagcggatggcgttgcgtaggatttttattttgggtaatcgttggtttggattgttcgacgtgtagcgtttgagtgttttaaaggttttatttattttgtttaggcggcgtcgttcgcgtatggtggcggttttgcggcggtcggcgttggtggttttgcgtttgtacgttttgtaggtttatagtaggtagcggttcgtttggtggtgttcgttgggcgcgcgtatatgttcgtttttacgtgcgttcggggtcgggtgtatcgtcgcggggaagtgcgagtgtttttcgggttttaggagcgcgtttacgtgtattaggcgcgggtttaggttttcgaagaagcgtaggttcggggagtcgaaatacgggtcgttatagaagtcgttcgttgtggtaaaggagtagagagagtcgtcgggggtcgttaggtttacgtcgcggagcggtggcgatagtagttttatattttggcggtggcgcggtacggttttggtttcgtttaatttaagcggtagagagtggtcggaattttttgtcgttcgggagtttcggttgtagatagtaaagtgttggtagtttgaatgtttatttattgttttttattttttttttttttgttcggtttgatttgtggttaaggaaagcggcggtagcgttttagggtttttttatttttagtttttcgttaggcgttttgggttatttattcgtagtagtttaaacgtttcggagtttaggcgggtagttgggggagggggagttcgaggttaataggaatattgcggggcggggtttgggggggttttcggggtggtcgtaggggttcgtagattggttagttagttcgtttttttatattggcgtgcgcgttaggttttttatcgggtagggagggagggagcgatcggtagttttaggcggttgtatttggtttttcggtacgttttttttaaatttttttaatattcgattgttgtattcgcgggaaacgttggttgcgcgcgt

SEQ ID NO: 7383 - DNA, 928 bp, synthetic construct
  misc_feature 1..928: note = Description of Artificial Sequence: Synthetic polynucleotide
  source 1..928: mol_type = other DNA
cgagtttcgtagtttttttttttcgtttcgttcgttagttttttgttttttttttttatattttttattttaaagttaggcgtcgggcgtttttttttgtcgtcgttcggtattcggttaatttttttaaaatgcgtttttattttgttggttgtttcggtagggagtatggaggattgggggttcgaagtttgtaaagggtgattttagcgttgtagttttttcgaaacggagatttgttatttttttagagggcggggaagtttatattattttttgttttatagtgttcgtttcgtttcgtttgttggtttttcgtttattcgagatattttaggtacggttcgtattggagagggtcgcgttgttgttgcgatcgtacggcgttcggggtaggaatatgttcgtttttttttgcgcggggggaacgaaatttttagagtgcgtttcgatacgttttttttattatttaaggtaggtttcggtagttttggttatttaggttcggggagttttagtcggatttgttgcggtttttttcgtagcgtaggtaaggattttaaattttaaattagggatttcgattttttttttttttttttcgttttttttttttttgaaagagaaatagatagaaagtttagttttgagataaagaacgcgagtgattttttcgaaataaatttgaagataacgatataatagtgaatggtaggacgtataaaattttatgggtttaggttaaatggtattagttataggttttagtcgtagtcgtcgcgtcgcgtagttttttgggttatcgcggagtttgaaaagacgcgtttaaggagattatttaaagtaagattttttcgttcgattttttgtttttttaggatttatttttttttttacgggcggttagttttcgttttttcgttttcgt

SEQ ID NO: 7384 - DNA, 1267 bp, synthetic construct
  misc_feature 1..1267: note = Description of Artificial Sequence: Synthetic polynucleotide
  source 1..1267: mol_type = other DNA
cgcgggattttagggttttttcgtagttttttgttttcgtcgtatcgcgttttttcgggtttcggtcgcgttcgttagtcggaagcgttttttttgcgggtgcgattttcgtagttatttttttttagtttggcgggggtcggcgagagtggtttttatagtattttataagttcgggaattcggggtacgcgggttcgttttgttgcgggtttcgattttttgggacggaaagtcggttattagtagtaagagggtgcgtttattcggtcgcgttttttatttttgcgtttttgaggtcgggttttttgagaaggggtatttaacggggatatttttaagttcgtgagtttttatttttattttgttatttcgagtagggtaaagagattttaggaatcggtttacgttatcgtcgttttttagattagcgtaaagttcggttttaggtttttttacgtcgtcgtggtttgtgggtatttttatttttcggatttttttaatcgttatagttatgtttatttgttttggtagtgtatatatagaattatataattaaaattaaatttatcggtatcgttttcgagggttttcgtttagtagggggtatcgaagttaggtggaagtaaatgagtttggattttgaggcgcgtttggtttggagtcgttaaatttgttagcgggcggcgggggaggtggttcggtagcgtcgggtgttgcgttcgtatatgcgttcgggaaggtagtttcggtcgtttcgtttttagttcgttttttatcgttggcgcggcggcggcggcgtggggttcggggttcggtttttcgttgcggttgcgttcgtttgggagttcgggtaggagcgcggggtttggttattgtggtttgttgcgttttttattgggggtcgatttcgttcgtttttttcgttcgtagaattgcgaggatttggattgtaggcgtcgtagtcgttattattcggagtatcgaagtcggagttttaggatttgcggtcgaaacgagagagcgggaggcgtacggcgtttttacggttttacgcgttttagttttttcgagtcgtagtcgttaatgttgttttttttattttcgtatcgcggtgggggttgtcgaagttgttatagtttattttcgtcgagtcgaaaagtcgtcgagttttcgcgggtgggtattttttttcgggggaatttagatcgaggcggcgttatcgagcgcgtacggattttttcggaaaataattattcgggattcgt

SEQ ID NO: 7385 - DNA, 1225 bp, synthetic construct
  misc_feature 1..1225: note = Description of Artificial Sequence: Synthetic polynucleotide
  source 1..1225: mol_type = other DNA
cgtcggtcgttttttggtgttttcggggttggtaagcgcgtagttgaggaaagggtataaaggtggcgagttttgcgggagtagttgtgtagaatttgtcggattttagggtttggtcggtaggttcgttttcggcggttgggttttttttttggagtttagattttttagtcgtaggttgtttttcgggcgggttttagttagggcgcgtagttttgagcgtttgtcgttgcggttcggttggtaggtttcgaggggcgcggggtcgcgggtcggtcggtagggttttgtgtcgttcgttttcgggtgtgcgcgaggcgcggagtatttaaattgatattatatgtttttttattagttgtttcgcggtcgagttttaggcgtataattatcgttagtgggcgagagcgttagtagtttttagggaagggatataatgattgaggtttaatttttgaaggggaatttggagttgcgttttttttttgttatttcgatgttgggagtggcgttttggttttggcgttttttgggtaagtattagtcggcggtatttgcggaggtggttggtacgttgttattttttgaaatgagtgaggagggaggtttagatttaggcggttttacgcgttcgttttggtattagtagattgggaattgtcgtggttatgttcgaagtttggaaagtttttttcggtttttttttgggatagttttttttttttcgggaagttttttgtgtttagaggtggggttttgtagttggaggggtagatggaatttgcgaagtaaaggaaggtaataaaaggaagttaggagaaatcggaaacgtgggttaggttttgttttgttggagaagcggtgttttcgtaaagtttttgtttgcgttggtttcggtcggagtttagattttttaaacgtttgttattttttatcgagttgaggtttcggtttttattcgcgttttggtgagggtttttttttagttttaagttttcggttattttgaaaacgcggtttttttcgaaggggaaataagtgtagtttaatttcgtttgagtgatttataaataaggacggaaagggtcgttttattacggtttcgtttgtcgtgacgatgtaatttttcggagcggagtattgttataaagtgataaggttgttataagcgtttcgattgatttttttaattagttttttatgtatgattcggagcgattttcgt

SEQ ID NO: 7386 - DNA, 1627 bp, synthetic construct
  misc_feature 1..1627: note = Description of Artificial Sequence: Synthetic polynucleotide
  source 1..1627: mol_type = other DNA
cggttgtcggcgcgagcggcggttttttttcggttgtagaacgtttttcgttgtcggagaaggggtttagtaaaattgatttttttttatttgtttttatttataattgatggggagatgagaacgtaatatattttagtatcgagtttttgtcgtttggcggagattttgtttaagacgttttcgtaaagtatttttagtcggggaataaagtacggaaagttgttgggtagagcggtcgggaggagatatcgggagtcgggtgggcggtggggtggtcggtgggttgtttcgggttcgggagttcgttcgtagcgcgttttgttagtaaggggagagggacggtgggaagcggtcgtttttcgggtttgggtcggggatggggatggttaagttattcgagttttcgtttttcgtcggtaggtattattcgggggtcgtgtaattcgggcgtttattgataggtattttacgttcgcgaggggttgtttcggttttaattgcggcgttgcgttttttttttaggacgtaggttaatgttcgttcgttcgtttttagtcgggcgtagagttgttagatttcgggcgttttagcgttcgttttggggttaacgggcgggagggggcggttaagttcgtaggcggttttttcggttttggtttagtttttttcggttggtttttggagacgttgtgttcggtagagaagtaatttttgttaattttagttatgtgcgggggacgtcgagttggttttgtttggtaagaaatttttatttgatgtttttttcgttttttttttaagggggtgtatagtggaggagggtttttaagtttatttgtttttttttttaagtcgttagttttgttagttttgacgcgttcgttaaatttttttagttttttgcgcgttttttgtacggtaggtagagagagtagtttggaaaataaattaattgtttagtggtaatatatatatatatatatatatatatatatatatatatatatatatagcgattcgggattttaggtttcgatttttatcgcgcgtatatatatatatatatatatatatatagcgattcgggattttaggtttcgatttttatcgggcgttataagagtattagtaaattgttgaaaacggttttattttattggggggaggttggtaagaaaaaagaaaaagaaaaaaaaaagtttgttacgcgtaaggaagaaagaaaataaagaaaaatattgtaaaaatagatatttttttgtttttttaggttttggtttttttgatagaattttgaaattcgttattattttttgtagtagtagtagtagtagtgggatagagtaggagtaaaataaatcgatgtacggtaaatggtgtaattcgatttatttttaagttaatttattaggcgagtcggagtttggttttttttacgtattcggtagttttcggcgcgggttttattttcgggtacggacggtaggaggcgcggtcggtcgggcgcgttcgttttcgcgggtgaatcgtggttagcgtcgtttggaggtttttattttggcgtcgcggttttgttgatttttcggtggttttcgcgtttttttttttcggcgttttgttgcgt

SEQ ID NO: 7387 - DNA, 1857 bp, synthetic construct
  misc_feature 1..1857: note = Description of Artificial Sequence: Synthetic polynucleotide
  source 1..1857: mol_type = other DNA
cggcggtcgtatttggttttatagtgtaaaatgtgtttggcgaggaagtcgaggcggcgttgtagtagttgagcgtgggggtttgtaagggcggttagttcggggaagcgaggttcgtggcgtcggtagaggcgtagtagtcgggtcgcggcgttttgttcgcggtgtagttttaggacgcgtcgcgcggttcgttcgcggaatacgtatattgattgtaatagcggttcgttatatttgttttatatgtttgttattcggtagtcgtgtattaagttcgttttattgtttagaaagattagcgtttcgttcggatcgcggtgtaggttgttggtggtacgttgtatgacgcgcgggttttattgtaggttgaagaggttgtttacgagtcggtcgaagttggtcgttaggtagtcgaaaaggattaagtcggtttattgtattaggtttattagtttcgtttggttgaggttggttagtttattttcggtatttcggagggggcgtagacggtcgtttttcgagcgttagggcgcgggtattattacgttcgtgaggttgggtagttagcgtgttaggtttattacgttgttttcggtttagtgcgtagcgcgtagttttttttgtatttgcgtttattgcgcgtttcgagtttttattcgagttagtgttagcggcggtacgtggcgttggaggtttagtaggcgcgttagatagtaagatagggtttcgttttgaatttgtttcgggttgatgtcgtagcgtacgtaggcgcgggtgtcgtcggtaaaacgggttagtcggttggagttgcgttcgtaattttcgcgttttagggttattattcgggcgtcgcgagtcgtttttagttacgtcgtcgtttgggttttcgaaaagttcgggggtatttgtttttttaggtcgcggttttagaagacgttttcgtgtatcgcggcgttttttttcggtcggggttgtttggttgatacgtgttatttgggttcgtttcgggattgtcggggcgggtcgttcgcgtcggtcgttagggtgagtagcgttcggaaagtttttagggagtcgtcgcgggcgttttacgttaggggcgggggtagagggaagcgaggcgcgggcgcggggtcgtcgtttcgggtcgggcgtcgtgggagtcggttttcgggcggtcgggaggcgggtagttcggttcgcggcggtaggagttttttttatagcgttagtagcgagtttagcgttagtagttagagtttcgcggtggcggcggcgtttcgtatttttttgtttatgttttcgcggttgtgtcggtgcgtcgtcgtcgttttaagtcgagtttaggtattcgggtttcggcggcgaggcgggttcggtagtttgtgggtttcggggtttcgggcgtttcggttttatcgcggtcgcggggcgttgcggggttttgttcggcgtttcgttcggcgttgggaattcgagttttcgtcgttttttagttgtttttgtatttcgttgtgagatttttcggtgggcgcgatttataggcgttcggattacgtgggagttagggggatttttttttttttttttcgttttcgtttttcgtttttcgttttttcgttttttttttttttttttttatttaaagcggcgatggtttttttcgagagggagaggcggttttatattcggttcgggatttgggggtttggaggaagtcggattggttgcgttcgcgtcggggcgtaggagggggtggcgtagagtcggagtttggggtttggcgggagggacgcgttttgggttttcgcgggggtgttttggtcgtcgggtttttttgtttaggtagcgcgg

SEQ ID NO: 7388 - DNA, 2423 bp, synthetic construct
  misc_feature 1..2423: note = Description of Artificial Sequence: Synthetic polynucleotide
  source 1..2423: mol_type = other DNA
cggagcgtagagaacggttggagatatagcggtcgcggtttttttcgtagcgtaggagcgttaggtattgcgttgggttaattgcggttagggagttatttgttcgcgatagcgagcgcgtatttatattttcgattaatttaggttggtttttagtttattttcgggttttaacgtttaaatatttcgtattgttggtttcgatatttttttattcgtcgttaggaattagcgtagagggagatgcgttttttgtggcgggtgcggggcgaggattttgattttagttttgggaagtgaattgtacggaggagagagttttttatcgttagttttgttttcgttttttttgcggttttattttagttcggatgtcggcgatggggaatagattagggacgtaggagtatattggatcgggggtggatttatttggggaggtaggtaatcgattcgcgtatcggtggcgtaatttcgtttcggtgatcgaagtttgtggaggtagttttattttcggttttttggttcgatatttttttgttatttttttttttattttttcgagttttgggagtttggatttcgaaggtgtaaaaagttaagagtttggaaaattgtattgtgtaaatatattgattttatttgtttttttttaggagttttatagatatatttaggtaaaaagatcgttaaataaatgtttttagttatcgtaatgtaaaaataaatattaattttttagacgtagtagtagtcgcgttgcgtttaaagttttaacggttacgtttaataattataaaagtgtttagcgagagtgttggcgtgagtgtgaatgggtgtgcgttggggggtacggtggagcggtgtgtaaaatcggagttgtaaattatcggataagggtatggagtggttattcgtcgtcgatttagcgcgggcgcgttttttcgtatatatttatagtagagttcgtattgggaagagttaaaaaataaatatttataaggacgaggaaagcggtttcgttttcggcgttttcgggttagggcgagcgcggcgaggggcgtatcgatcggttcgtagcggggcgggagttcgagcgcgcgaggagcggcggtttcgggtttttgcgggtttttcgggagtagggcgcgggtattttcggggtttatacgtcggttttcgcgcggatcgcggacgcgcgcgtttttttcgcgggcggcgttttttatagggtcgagtcggagtcgttggagtttaggttgttttttagtttgtagttgttgagttgttttcgttgtagcgataggttttgcgtgttgcggcgtaggtattttaggttttgtaggaacgattttttggttttttttttttttatgggggatattttttttttttttattttttggatttcgtcgaaggttatcggttgcgttttgaagcgagattggcgcggtcgtcgtagtcggtttcggtttttgggtagtttggcgggtcgtacgggttgcgggaattcgtcggttaggtatacgaagtgcggtattatcgtttggtaattggagtagatgtttattagttcgtcgggtttggcggttatggcgttttcggcgtttgcggggtcgggcggcggggcgtcggggtttttcgagggcggtcgttgcgtcggggtttttcgggaggtagtagtcgggggttcgtcgggcgggggatttaaatttgttgcggggtggcggcggttttcgcgggttcgggtcggcgtttttcgggagggcgggcgggcgggcggattcgtcggggggtacggggttcggggggcgttgtttcgtcgcgtttcgaggcgttcgtcgtcgttgttgtcgtcgtttgtttcgcggcggttaggttcgcggtttatatagttcgcggttgtttatacggttttgagttcggatgatagcgaatgttatttaaagcgtgcgcgtttcgcgttttttcgtttgacgtcgtttcgtcgttttgggaaagtaacggtttttttttcggcgtcgttcgtttttcgttaatcggtttcggaaggtaggtttcgttcgcgggggtttcgggagaagtcgcggtttcggagtacgcggttggttcgagttgcgttcggatagggatttttaatcgtcgcgattgggcgggtattgttttttttgggatttttaagtttgtattaatcgggttggtcgcggggtcgtaggtttttttttttcgttttttggttttagatgtatatatttgaggcgttggttattttatcgtcggttttgcgcggggcgcgaggtagtttttagttttttttgtagtttggcgagtttgagcgttcggttttttagagttgagttcggaagaaggggtgggttttttttttggatttttgttattttttttcgtaggcgcgcgcgcgt

SEQ ID NO: 7389 - DNA, 1146 bp, synthetic construct
  misc_feature 1..1146: note = Description of Artificial Sequence: Synthetic polynucleotide
  source 1..1146: mol_type = other DNA
cggtatttgggtttttgcgcgtttcgtttcgcggtcgggtttatggtattgtgagtttgtaagggagtttcgtttagcgcggggagcgttcggttttttttcgttttatgcgttcgcggttttgaagtttgagcgggggtcgggggtcgggcggggtcggggtcgtcgtaggtatggcgttcgggagtcggtggcggtcgatattgtcgtcgttgttgttgttgttgttgttggcgttggcggcgcgcgcggacggtttggagttcggcggcggtttcgggtagtgggttcgttacgcgcgttgggcgggcgcggcgagtagcggcgagtttagttttagtttgcgtattaacgttacgcgcgcgttgttgttttatttggacgacggcggcgattgcgattttttggagttgttgttggtggacggtcgtttgcggttgcgttttacgttttcgtgcgtcgagtcggttacgttgtagttggatacgtcggtggtcgacgatcgttggtatatggtgttgttgattcgcgacgcgcgtcgtacggcgttggcggtggacggcgaggttcgcgtcgtcgaggtgcgttttaagcggcgcgagatgtaggtggttagcgatttgttcgtgggcggtatttcgttcgacgtgcgtttttcggcgtttacgttgagtatcgttaagtacgagtcgttttttcgcggttttttggttaatttgaagttgggcgagcggtttttcgcgttgttgggtagttagggtttgcgcggcgttatcgtcgattcgttgtgcgcgttcgcgcgtaatttttgcgttaacggcggtttttgtatcgtgttggttttcggcgaggtgggttgcgattgtagttatacgggtttcggcggtaagttttgtagcgaaggtgagtttcggggagcggtcgttcggtgtttgggcgcgggggtgagggtttggggcgtttcgtgggggtcggagtgtgtgtgggtttttgaggtacgggggttgggtacgagggtttgtgagtgggtgcgagcgttttagggttgcggggacgcgtgttcgggcgagggcgcgtggggttggcggtgggcggggcgagtgggcggggtcggtttgggcgtggttagcgtgagttttgcggcga

SEQ ID NO: 7390 - DNA, 577 bp, synthetic construct
  misc_feature 1..577: note = Description of Artificial Sequence: Synthetic polynucleotide
  source 1..577: mol_type = other DNA
cgttttttttattttgcgcgttttacgtgttttttgtaaataagagaacgcgtaggcgtcgtaaattagcgtttattggtcggcgtgtcgtcgtttcgttggagggaggatttaggtttcgttggtcgcgggttcggtattcggtgggtcggtggagcgtttgttgggttcgggtcgtcggtttcgttttcgttatggcgttttggttgtagtttttgtcgttgttggggttgttttcgggcgtagtggtcgttttcgtttagtttcgagtcgttagtttttaggtttgggggtcgtcgttttcggagttgttggcgtttattcgtttcgcgttggagatgtttaatcgcggtcgggttgcggggacgcgggtcgtgttgggttttgtgcgcggtcgcgttcgtcgggtgaggacgcgtcgggggcgggggcgttaggttcgggtttaagggataggagttttgatttaatattgggatggggtttgttcgttggacgaatcgatttttggtgatggggaatgggtagcgtcgtacgggcggggttttgggcgtcgttaagggtcgattgtgttcgt

SEQ ID NO: 7391 - DNA, 1721 bp, synthetic construct
  misc_feature 1..1721: note = Description of Artificial Sequence: Synthetic polynucleotide
  source 1..1721: mol_type = other DNA
cgtgagttttcgaaaggcgaagggtaggtagtagtcgttggtttttgcgtttattaggagtttcggatgttcgagttagggttgcgttaaggcggtcggagtagagagggagacggggacggggataggtagggataaagtgtaagaggtaaaattggttgaaaagtagaagtgtaggagtcgttaaggggcgggacgaataggttcgtgggtcgggcggagttaagggtgggggtcggggtttttttaggtggtattcgcggcgttagtttttagtttttttttttttttcggttttgattggtaggcggtttgcgattagtcgcgaacgttatagcgtttcgggcgtttaggagaacgcgaacggtttttcgcgggagcgggcgagtaggagggggcgtcgggttatatatatagcggttcggtttcgggcgggtttggcgtttagggaggcgcgtattgttttttagagttttagttttagtcgcgcgtttttcgttcggttcgtcgttttatgtagtcggggtagagttcggcgttcgggggtttcgtcgtttgtttttcgtattttttcggttgcgtatttttgttcgaggtcggtcgtgcgttttcgcgggacgttataggcgtagttttgttttttagtttttcgggcgtattgatcgtttgatcgacgtacggttttcgggtcgggatgtcggggttcgggacggtcgcggtagcgttgttttcggcggttttgttggttttgttggcgttttgggcgggtcgagggggcgtcgtcgtatttattgtatttaacggtacgttggaggtcgagttggagcgtcgttgggagagtttggtggcgttttcgttggcgcgtttgtcggtggtagcgtagtttaaggaggcggtcgtttagagcggcgtcggcgattatttgttgggtattaagcggttgcggcggttttattgtaacgtgggtatcggtttttatttttaggcgtttttcgacggtcgtatcggcggcgcgtacgcggatattcgcgatagtgagtggcgcggttaggcgcgaaggggcgggggcggggggtaacggtcgtcgggttaattcgtttagttatattttgagattttcggcgggtatttgttcgggggtttcgggaatcggggcggattcgggtttcggttttttttgacgcggggttggggacgtagatatttttggtttcggtagtttagcgtaatttttgaggtcgggcgtcgtttttcgtttttagaaattcgggtttcgagcgtcgaattttagcgttttcgttcgtgggtatagggcgcgcggtgtagttatagggggttcgagatacgcgtttcggtttggtttaggttggggaatcgttggggtcgggttcgcgtttgaaggttcgggattgggtgcggtcgtcgggggttttttatataggtaagttaatttgagttagcgtaggtttgggtttcggaggttttagagggtagtttgggttttggaggtttttgggggcggttgcgtcgggaattttggttttttatttttaattttattttagaaatagggttttcggaggcgaataagtcgaggggcggagtgggttagggattatttgtttcgtaatgatttgcgtttcgtttttaggtttgttggagttttcgttcgtggagcggggcgtggtgagtattttcggcgtggttagtcggtttttcgt

SEQ ID NO: 7392 - DNA, 1721 bp, synthetic construct; identical to SEQ ID NO: 7391
  misc_feature 1..1721: note = Description of Artificial Sequence: Synthetic polynucleotide
  source 1..1721: mol_type = other DNA

SEQ ID NO: 7393 - DNA, 615 bp, synthetic construct
  misc_feature 1..615: note = Description of Artificial Sequence: Synthetic polynucleotide
  source 1..615: mol_type = other DNA
cggagtttcgggtacgtatcgtcgagcgttttattttgagttttttcggtattcgtagtttcgatagtttagttttttttatttgaaagttttatttgaggttttttttaattttgtttttttgtatttttggcgtcgcggggagttaggggttaaatttcgtggttcgcgtggtttttttttttttcgtagttttttcgtttttattcggcgtcgcgtttggagcgttcgtttcggagattcgtataagagaggaggggaaaaagtgggtttgtttttcgggtggttaatttatcgagttcgcggtgttttagaggaggcgttagcgttaggttagcgttaggtcgggttgtttgtttttcgcggtaaagtataaatgcgttcgagcgcggcgtttgaagtttttggcgagtatagtcggttcgcgtttagttttttttcgcggtcgtcgcgtcgtcgtcgttgttgggatcgtcgtttcgtcgggttttaggttttcgcggttcgatttcgagtttatcgagtagggggcgtcggtcgtttttagttcgcgcgttcgtaatattcgttggtttcgcgcgtttcgttcggcgttgcgcgttcggtagacgtcgg

SEQ ID NO: 7394 - DNA, 1542 bp, synthetic construct
  misc_feature 1..1542: note = Description of Artificial Sequence: Synthetic polynucleotide
  source 1..1542: mol_type = other DNA
cgggacggtcgtcgcgcgtttttttttttcgttttttgtttataagatttaatgagttttttcgggaggtagcgtagcgagttaggttcggaattagtaggttgcgtcgcgcgcgtcgcgtcggggcgggagttgggtttgggcggcgggtaggagttggcgggggcgtacgggtagcgttgcggatagttcgggagtcgcggcgatggcggtgtaggcggcgttttttagtacgtattttttcgtgtttttcggtttcgggggtttttcggacgggttagggggcgttttcggagttttggataagggttgttgtttcgaggacgatgagatcggggtttcggcgggtgcgttgttgtcgggagtcgaaggaggggacgtgcgcgaggttattcgcgatttatttagttttattgattcggcgtttagtaatattaagttggcgttggataagtcgggtaagtcgaagcggaaggtgaattatcgtaagtatttgtagaagtagattaagcgttgtagcggttttatgggcgtcgcgtttttcggttcgtttttttcgagcgtcgtcgatacgttagttaaacggtcgttggtcgtttttagcgtttcgatagtcgcggtttcggtttacggtaaggttgtttttcggcgggaggcgtcgtaggtcgtcgcggtcgttagtttgtaaagtcgaagtttggtcgcgtttttcgattcgttgcgttacgttttcgggggtgtcgagtcggcggggggtgaggtggttgcgtcggcggtcgggttaggaggtgcgggtattgggggcgcgggaggggacgtggtaggtttcgcgggggttacggcgattttaggggttaggaaggtttcgttgcgggtacgtaatttgttttcgtttttttttacggagtcgtttcgggtaggcggcggcgggtgtggttcgtcggggtcggacgtgagtttgggcgatttggagaagggcgcggaggtcgtggagttttttgagttgttggggttcgattacggcgtcggtacggaggcggtagttttgtttgtcgtcgagtttttcgacgtgtttttcgtcggagttttcgtattgcggggattttcggagttggagttcggtttttttgagtcgtcgtcggtagtggtgggaaatttattgtatttcgagttttggagcgtttcgggttgtttttcgattaaaaagagttttttgattgtttttcgcggcggtttgattttgaacgagtttttgagttttttgtatttcgtcgttgcggattttttcggcggggaggacgggcggggttatttggtttttttcgtttttttttttttagattgcgttttgttttcgtcgtcgtcgttttattaggtgttttacgattatagcgcgggttatagtcgtatcgtttattttagtttttggagattcgacggggtttgggaaggggcgtcgggggaggagggggcgtatcgggattgatttcgaggtacgtttttttttattagagacggttgtggagagcgtcgcgttttcgt

SEQ ID NO: 7395 - DNA, 1542 bp, synthetic construct; identical to SEQ ID NO: 7394
  misc_feature 1..1542: note = Description of Artificial Sequence: Synthetic polynucleotide
  source 1..1542: mol_type = other DNA

SEQ ID NO: 7396 - DNA, 1768 bp, synthetic construct
  misc_feature 1..1768: note = Description of Artificial Sequence: Synthetic polynucleotide
  source 1..1768: mol_type = other DNA
cgcgtttggagtgggttttcgatatttagggtaagtgggggcggtagagtttttttttcggtcggtatagtagtttttgtcgcggtttcggtttgcgacgcgtttagttttagtttttcggttttcggcgtttgttgagtgttcggcgggagaggcgtagggagcgcgttatcgggaggcgcgggtagcggggattggttttttttcgggttagggttttcggggtaatcgtttttagcgcgtatttttggtgtaggtggaatagttttttgtttcggtagggttttatttatcgcgggagaggttaatttcggatttaaatttcgtagtcgtagagcgggttaaaatcgttattttatttttttttattttttttttttttattttaagataaaaagttttaggtcgggtaggatttgattatttttgtttttttttattgcgttaattttgcgagcgagaggtttcgtatcgaggcggaggttggtaaaggggagtggaaagggaggatggatggggtcggggggtggggtggtgatgagggcgacgaaggagggggtgttattttttttttttttttttttttaaaaaaagtatttttttcgcgagaaatcgttgcgcggacgatatttgaagaggtggggaaaggagggggttgcgggagtcgcggtagagattgtgggtgttataagcggataggagttatagttgggatagttgcgagcggagtcgagtagtggttgtagcggttacgattgggagtagtcgtcgtcgttttttcgggagtcggagtcgtcgtttttttagtgggtgtagtcggggtttcgacgggggtcgggcggttatcggggttggagttgcggttacggaggtttttgcgtttgcgtcgcgtcgagggtagggatagggattggggtgaggggttgtttcggaacgtttatagttggcgttggtttttttttgtttgatagttttttggttcggggtttttggtgtcgggtttcgcgttagatgttcggggggcggtggtatcgttcggagtcggcggggacggcgcggttggtttttagtttggcggagagggtaggttgaggagtggggcgtttagagcgcgtatcgcgcgtaattcgtgtcgttaaaaaaaataaatttagagagttcgttcggggtttaggatcgttggggatatgggtattttgcgtcgcgtttttttggcggggttcgggaggtcgagggatcggtcggggttgttgtcgtcgggggtttgggttttttagttagttgtggattaaacggtttttttttatttaaattaattgcgttacgcgtaggcggcgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcggtggaggatacgacgcgt

SEQ ID NO: 7397 - DNA, 2656 bp, synthetic construct
  misc_feature 1..2656: note = Description of Artificial Sequence: Synthetic polynucleotide
  source 1..2656: mol_type = other DNA
cgtataggaattttagtcgtttaagtttcgggtgggcgcgtcgtatttttttaggtattgtttagatagttcgttttttttttttgggcgttttttttagtttggttggggtcggggcgggttgggggaggttttcgcgggtttgtttgatatttgtaaatggaagtgggatttaatttggaaaataaacgcgttagagtttgggggcggagaggagcgggaggaggggagaggggggaaaaagattttaattattatcgcggttttagcgtttttttttttcgtcgcggttgttgtaggttcgtttaaattcgaagttgagttttattgggcgcgcggcggcggcgggatggagttggagttttcggtcgaggcgttaggagtttattagatttcgcgtgttagagttatcggtcgtttacgtttcgggtcgtaggcgttattttttttcgggagttttttttagttttttacggagatttcgtagggttttcgtagttttttcgttttcgacgtttatttcggggatttttttttatcgtttggtttgagtttattattttagcgagttgtagttttaggatgttatcgttagtatatttatatttcgggagtatttttgttttttttatttcgagtaatttaagcggtttttttagttcgtagttaaatttcggttatttttgtatttttgttttaagtacgttttcgttatttttcgtttataagaggagaacggtggaaagtgaataaaagttgtttttcgtaaagtttaattatgtttaatgttaaattatttcggaaagtatatgtgataaaagttaacgagagaggagaggagggaatttagattatagtatagttaaaaatattcgggttcgttattatgtaagtcggggggttagatgtattttagtttagcgatttttattggcggaattttcgcgtttatcgcgcgtcgcgttaagatggtttaggttatttttattgttttttcgttagcgttttttagttttttatatttgttttgtatatatattggtttgtagaggggattcgtttcgaatcgttcgggagtggggtttgagttcggagttggtgtttttggcgttttcgtttttaattcggagatagttttttcgtatttttggggatggttagattcgcgttgttttttttttaaagataagtagtttttttatacgttcgttaaaaattatgtattttcgtaaagtatttcggttttttttttttgttaagatagtagggatagtttttgtttttaattatttcgtaaaggatgtcgtttttagtcgaagagtcgtcgtcgtcgtttattatattttattttgattataagtttcgtaagttcgagttaggcgtggggaacggattcgtagattggtaatttttttttttttttagcgaaagtggaggttgggttttttttttgcgtcgcgtttcgtttagcgatgatttaatttgtatttcggggttttttaagtgtattatttatcggtatttgaatattttttattgcgttcgagaggtatcggttgttaagtaggttcgttatttgaatttttttatttatttgtaggggcggttgggagtcggggatgggtgtattgattcgtaatttttttcgtaatttttttttagatttttagttttaaatttggttaatttttcgtgtaaatttttcggttttcgtcgcggggttaagttattttttttttttgtttgtagcggtagtaacggcggttcggggttgcgcggaggttggaattttataaggtgaaaagttttttttacgcgtttcgtcggttttcgtttttttagtttatttcgtagtttatttgtatttagtagttgaggttgtgtttcggtaggcgcgttttagtcggtgtattaggtagttaaattattacgttataaatttttacgtatttttgttttcgttggcgatttacggttttacgaggcgtttttttcgtggttttttttattcggtgttcggcgtttttgtttcgggcgagtcggtttttcggttgttgtcgtcgtagcgtttatcgcgcgttagtcgggattgaggtcgcgagtagaagcgttttgcgttcgggacgtcgtcgtcgtcgtcgtcgggggttcgtaagcggaggaggggagtcgagatgaagagaatagtagcgggaggagagggacgggaggcgcgagattttaattcgtaggttagtttatagcgtagtttgcggggaggagcgtcggtttttttgtttgtttcgagttgtagtcgtcgtcgttattgttcgtcgtttggttgtttcgggttttttattatagtcgacgtcgacgtacggttaagtttttttttagtttttttttcgcgtttgtttttcgtagttttttttttttaaatcgcgagcgaaaagggcgagggggagaggagtttcggcggcggggatgattagcgatttaggagcgtggcgtaggggagagggggcgcgcgggagggggcggcggaggaggcgcggcgaattggagggtattttcggcgtcgggtttggaagcggttaattttagagttcgagtttttttttagttttttggggttttaggatgatattaacgtatttttttgtcgcggggagagcgt

SEQ ID NO: 7398 - DNA, 623 bp, synthetic construct
  misc_feature 1..623: note = Description of Artificial Sequence: Synthetic polynucleotide
  source 1..623: mol_type = other DNA
cgatattacgcgagtgtgtacgcgttggggattgagttttcgaagcgaagttttgtcggaggagttttaggcgggagtgggaacggttgggcgtggggttagtaacggcgttattcggtagggtggggggagttaggtttgttagagttagagcgcgttatcgtcgtcgcgagagacgtcgcgttgtttaataggtagaggcgttttttagtagtttggtgggagtagagatataaaagtgttttaataaattcggagttggcgtgtcgatcgcgggttggtggcgggcggcgcggtgtttcgcgcgttcgggttttttggtttttcgggacggttttgtatgttgtgcgtttcgtatttcggttgcgcgtttcgattttagcgggaggggacgttcggttcgtaggtttttaggggaggggtggtttttgtaaaatggttttttattttttgttgttttgttttttttttttggtgcgagttatcgagttttacgagggtcgggtcgacgagtagagcgcggaggcggttttggtcgtgtttaatgtttcgtatttttttttttggaataattatatttttttcgattggtagaattttgtgggtaggaggcgttacggcgt

SEQ ID NO: 7399 - DNA, 1967 bp, synthetic construct
  misc_feature 1..1967: note = Description of Artificial Sequence: Synthetic polynucleotide
  source 1..1967: mol_type = other DNA
cgatgatggaaaggatcgttaggcgattttttaaaaggtttattaaatattcgggttttattgttacgtttttattcgggggcgaggatgttttaaaaatattttttttttttcgttttatgtggataggtcgcgtcgcggtatttacgggtatcgcggaaaggggtataatcggggtggttttcgtttaggtggtagcggagatttagggttaggcggattaggtttggtttttatttttttttttcgggttttgttacggtttcgtttcgtcgttagtagagttttcggttcgcggtcggtcggttagcgtacgcgcgtaggtgtgtttgttaggatgtttttttcggcgacgcgtttaggttcggatttcgcggcgcgagagtgagcgttggcgggggcggtgggatgttttaagtcggcgtgaaagaggcgagagtgggcgagtacgggcggtcggattaggagtattttcggtgattatttagtttttattttattttttcggaaattgtcgggtaggcgggggatcggtcgtagggcggggttttttttggcggtgagtgagcgagatcgttaggttgaagtatcgggagattgttttggtagtttttggtcgttattcgcgtcgtaataaaagtttttcgcggtttttcgtttagttagtttcgtattgattggtcgtcgtgggagggattcgagttggttggaggcggcggtcgagcgttgtttttgtgtcgttcgcggagggggcgtattgggtgttttttggttcgtttcgtgcgttttttaatcgggggtcggtcgtttagggtaggtataacggtatttggagttgcgatcgcgatatatagttttttcgttcggtttttttcgatcgttttttagtatacgtttttcgtttagaatgttcgtttaatttatttagttttttgcggtttttgttttttttttttttttttcgtttattagagttaaagcgtaaatttttgggtggaggtggggggatgatagttggaggggagggtgggtacgtatagaagaattttttagggaggtcgggatggaaatagttaaaatgaaatgtatttttttgtatattgtcgaggttttttgggcggcggcgtaattttcgttattcgcggtagtattattattgttttttttttagttttttattgtttatattttgttaggatcgggaatttcgtttaaagaaaggagatagggcgaggtgtttcgggcggttatttgttatttttttttcgtttcgtgtaatattgggtacgcggcgcgtgtaaagatatacgcgcgtatacgcgcgcgtatatattaggtagttttaattacgtttttttcgtttttcgttttttcgtatttttttttgttaaaacgcggcgttcgatttttttattttttagtgttcgcggtcgagggtaggttttgtaattaattagtaatttggtaaatgaaaaattaacgttatgtcgattggggtgtaataacggttatattaataataacggtcgtgcgattttgtttattttgttttattttgtaaatcgttatttttttggggcgggggaagtaaagtagcgattttgattttattagatttaggaatataacgatttggggcggttgttttagttttattgtttatttttttcggagtcggggttgataagttatttttttttcggaattcgagttcgtgcggcggtattattcgagtcgcgatttttttcgtttcgtcgttcgtttttggggaaggagcgttgtttattattagcgcggtcgttgagtttttaggagtcggtcggttttgtttttatcgtcgcgggcgtataaagtgggaagggcggacgcgtcggaggggcgtcgggcgttggcggttcggggaggtagtttcgtgtagcgtagttttggagggagcggggttcggttgggtagtaagggcgacgcgt

SEQ ID NO: 7400 - DNA, 2558 bp, synthetic construct
  misc_feature 1..2558: note = Description of Artificial Sequence: Synthetic polynucleotide
  source 1..2558: mol_type = other DNA
cgtttcggggtggggacggaggtcgttaaggttgggatgagtatttagtcgagtcgagttatcgcgtgttttttcgtagatatcggggtttttgagaattaggagggaatagttaaaagaatggaagtttggcgttttgaaataagttttttgggttttgagggaaatttgggcgtttacgggtagtcgttttttttattcgtcgttcggcgttcgcgattcggttggcgttggttgtagcgtttagttaggcggcgcggggaagagtcggcgataattcgttcgagtttcggggatcgatcgcgtttttatatttttttagtttttagcgatttttatcgagatttggagacgattttagtaaatttggggaagtaatttttttcgaggagttagatttttgaaagaaggagagttgagttagggacgagggaaagcgaaagagacggggaggaacggcgatagttcgggcgggttggatttcgcggcgagagcggtaggggaggcggattcgtttcgcggcgaaggggaagtataaaagtttcgtagcgagttgtgggaggaaaggcgagaaggggtttgttcgtttttttttttcgatttagggtcgtgattttttgggagcgatcggttgggttttaggtttttggttagcggcgttagcggttagcgcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggtttcgtcgagagtcgaggagggttcgtagcgttgtagattttttggagttttttttttttttttgtaaaaggggggtggggattaagtttaattaagaaaaagtttattacgtttttttaaagagaaataaaacgtaagtagttttagttttgttttttttcgtttttagatttattcgttagttttttcgattttagttttttagtcggtcggcgaataaatatataaataaataaattataattttattttgcgttcgcgtatcggttcgtatatataagagtatttacgggttttgttgtttcgttagtttttggcggtataaagttttcggattttcgatttttttgtttacgtttttagttttcgtatatcgttacgttttttattttttatttcgatcgtgttttgaagaggaagggttggggaggtagttgcgtttaggttgatagtcggggtttttttttttagtcgatttttaatcggtggcggcgacggttgtagcggtaggaagggaatacgttaaataaaaaaggtataagtttagcggtcgagtggtcgaagcgagcgcgcgttttttagatttttttagtttcgggaagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcgtttttatcgtttttaatttttttttgttgcgaggttagtaaattattatcggttgttgcgttttcgtcgcgttttacgttaacgtcgagtttttttttttgtaaggtttcggcgtttttttatttttagtgttggcggtcgagttcggttttttgtttatagttgtttttttttttttttttttttcgcgtcgttttcgggtttagttcgtttattatttcgtattggtcgagttcgcgcgcgtttttcgttttatttttttttttttttttttttttttttttttttttttttgcgtttcgcgtttcgggtttcgtttgatatttagttgttgttggggcgtcggcggtcgttttttatcggtcgagcggagaggaaggaaggagttagaggataggagtgtatggggatttagaatttttaataggggaattgagggtgaagggcgcgtagtagtttttatttatttttaagattttaatttgtattggatacgggttttgttttttttttttcgtatttcggtgtttaagtacgtagttttgtttttttttttaatgtttgttttaatttagtgcgtgttatttcgtttttaattttttttttatggttcggggttgtagtttttttgatatttgttttaaaaggtcgtttttttagtttaaattcggtttttttatttttttggttattgcgcgtttttcggtttgagtattcggattttaataagtttttcgaggtagagttcgcgggcgttagtgaattaggtgttagaaggttcgcggggatttattgtcgaagcgagatattcgtttttagttgtcgcga

SEQ ID NO: 7401 - DNA, 2558 bp, synthetic construct; identical to SEQ ID NO: 7400
  misc_feature 1..2558: note = Description of Artificial Sequence: Synthetic polynucleotide
  source 1..2558: mol_type = other DNA

SEQ ID NO: 7402 - DNA, 1508 bp, synthetic construct
  misc_feature 1..1508: note = Description of Artificial Sequence: Synthetic polynucleotide
  source 1..1508: mol_type = other DNA
cgttttttagatagcggagtcgggtcggggcggtttggttcgggtcgtcgtttttgtttttgggtttgtggggttggggttcgtttgggtttcgggttcgcgcggcgtttattattcggggtgtcgcgggggggcggggagagcggtcgtttagtttagtttcgcggatgataggagtcggggagtcgaggagggaggagtcgtcgtcgtagtcgagcgttgggttgaggagtagagagagcggggcgtcgagtgcgggcggttgggagcgcgttgagcgggggagaggcgttgtcgtacggtcggttataggattattttttcggagaatagggtttttttatggtatgtggttggtaattttttttttgtttttggattttttatataaaggtgagatttgcgcgggcggttgggcggcggaggcggcggggttagggtggcgcggttggcggcgaggcggggtgttcggcgggttttaggtgcgtgggggaatcgatcggggtgtaaggtttcgggtggggcgtagcggggaggggtaggtattttgataggggtcgagtgagagttagttttcgatcgtttcgttagttattcgcgtttgtcgttttggggcgcgttcgtaggggtggtggtaaaggagttttttatttttttgttttttgtacggcggtagttttgttttggattttttttttagttttttgttttttttttgcggtttggtggtattgggatttcggagtgtttttcgagtcgaggggtttttaggtcgtgatttttgatttaggagtttttgtttatttaggtttcggattcggcggttgattttttcgttatgttcgtgcgtttttttttcgtcgcggattttagttttggcgcgaatgttggcgtatcgtatggcgtttattcgcgtattggttggaggtagggtggggatagtgagagtttcgagagttggaggtttttcggatagtaagtttgttttttaaatttagaggttattttttttcggttttattttatttttttgtttcggttttagtttcggtttggtgcgttatcgtggttatttcgggtagcgcgttttaagatgcgagatttttcgttttcgcgtttggttagttggatttggggataagtttttaggttggggggcgtgttttttttttcggagagagggggttgttaggggtgggtttaggtgttcggtatgtttagatttgcggttggggcgttgcgtatttgattcgcgaggtagtcgggatcgggaggttggaagagggtagatattttcgattgaagttatttgggtattgagtcgggattaggtaggcgtaggtagtttgggttttaggttatcgtagaggacgtgttttcgggcgcgtagatggcgggagatgaggcggtcgaatttcgcgtttttgcgtggtggagtatatacgttttaataagtttagcgttatttgtttagttttttaatttttttttttttcgtttcggggcgg

SEQ ID NO: 7403 - DNA, 1119 bp, synthetic construct
  misc_feature 1..1119: note = Description of Artificial Sequence: Synthetic polynucleotide
  source 1..1119: mol_type = other DNA
cggtggcgatatggtaggtagtttcgcgtggcggcggtcgggatagttgggcgcgttggtaggagagtaggtatagcgttttttataggtaggatgacgcgggtttcgtagttcgtttttttacgttgtttcgtattattgtttcggttttgacgtgcgtgcgatagatttatcgtaaatagtttttagcgggagtacgaggtcgggataggaggtgggcggttatataggatattttattttttttattttttcgtagtcggcggagtcgatcgtcggaaaagggaggcggtgggcgaaaggaaagcggggagttgggagaggagttgtaaataaagagttgtttttgtgcgaagttttgagtcgggtttagttagttcgttttttgtggtttacgtattgttcgtcggtttacgcgggagtttcgaggggcgaggcggaggttgggcgtagtttttgtagttagtagttattttcgcgcgtttcgtcgcggtttagttaattatttgttgcggcggcggtcgtgttttttagggtgtattagtattttcgtcgcgggcgttgttttcgcggcgtcggtatcgatgttcggttatttttaggttcgaacgattgcggttgcgggaaggcgggtcgaggggggttacggtattttagggagaggtcgggagtcgttcggatttcggaggggatggggttttttttgggaggtattcgttttttttttgggttttaagattttttttagttttgcgtttcgattttatttttttcgaaacgtcggggaatcgggaaaggagggttacgggtaaagcgggggcgggcgttttttgattagtatgcggcgtcggttgttcgggttcggattttcgagtttttttttcgcgagcgtatattaataagtttataaatggaattcggtggcgtcgtttgtaataaaaggtagaagttgcgtttcggcgttttaatgagagtattttttttcgtaataaggggttggatttagttgtttggtgtcgtttgagcggggcgagttgttagagtaattaaggtttagcgcgtacgtggggagagggagttggttggggttttagcgttagtcgtcgtttgcgcgttcgg

SEQ ID NO: 7404 - DNA, 1119 bp, synthetic construct; identical to SEQ ID NO: 7403
  misc_feature 1..1119: note = Description of Artificial Sequence: Synthetic polynucleotide
  source 1..1119: mol_type = other DNA

SEQ ID NO: 7405 - DNA, 653 bp, synthetic construct
  misc_feature 1..653: note = Description of Artificial Sequence: Synthetic polynucleotide
  source 1..653: mol_type = other DNA
cggaagtaaggcgggttagttatcgtttcgagttaaagtttttgtagttttggtaatttttcgcgcgtttttgtttaggagttttatattttagagaaatttttcggcgtttttagtttcgttgttttttttaggttttgggatatagttttaagggattgagcggttcggacgggatttgaaatttttggaggattagttacgttcgtatagttcgtttatgcgcgttggtattaggattcgtaggttgttagcggcgagttttcgtcgcggttttttagggtattttcggagaagggggcggttttgaggaattttttgtatttcggatgttttatttttttcgtttttagcgttttagggttttgttcgggttttggtcgcgcgtggtgttttttttagtcgcggagttttgttttttagtgtcgttgaaaggaaagagaaagaaaacgttttcggttttggaggttttgtttttttttgaagcgatgttattttttttttttatttttttttttttagattttttttggggtttcggtagaggcggggcggttgcgtttcgagttttttttcggcggtagcgcgggagcggggttggaaaagagggcgtcgggagtcgtttcgttttttatcgtttttggttttttcgt

SEQ ID NO: 7406 - DNA, 1768 bp, synthetic construct; identical to SEQ ID NO: 7396
  misc_feature 1..1768: note = Description of Artificial Sequence: Synthetic polynucleotide
  source 1..1768: mol_type = other DNA

SEQ ID NO: 7407 - DNA, 1101 bp, synthetic construct
  misc_feature 1..1101: note = Description of Artificial Sequence: Synthetic polynucleotide
  source 1..1101: mol_type = other DNA
cgttgcgaggattaagggagatggaatgtagcgtaaagttttacgtaaacgtgtcgtgtaatatgaagttttttattttgagttggggagcgggtggtacgcgtggaagttgaatgttattatttttgggattaggcgtagcgttttttagaagcgtttttggtgacgggtttttgtttttttttaggacgttttttttagaatgtttcggggttttggacggttttggagaggacgggagggaagggaaggagacgggcggaacggggacgtatttgtttttattgtatttttttcgtttttttatttttagttatttgcggaggaggaagcgttttcggcgcggggacgcgttgggtgtggagtagttggattacggggtgttttcgtcgttggagggcgtgatttcgatggacggtagttgtaggaattttttgtcgggggttaagacggcgggtaggtttcgggttagttcggtttttaggttttgtttttgtacgttttttatgcggcgtattttgaagcgtcggcggcgaagcgtgggggtcgacgaattggattagatcgggttgttttcgggcgtattttgcggttcgggtatttgtagggcgggtagcggtcggttttttattatgttggtcgtcggtatgggggtcgtcgtttttgcgttttttttgagtttttcgttagcggtttggttcgcgtttttttttggttgttttttattttcggtttcgcggtatattttttaattttggggtcgaaggaataagtttttttttcggagcgtagcgaggaagggacgcgaggggacgcggcgtagcgcgtcgtcgttcggagtttaatttttcggagcgcgcgtttttcgggtcgttagtcgtcggcgaggttattcgggaggggcgggagtcgtttgttagttattcggtagtttttttggggtttttttcgcgcgttcgtttgtttttttttcgttgcgttttttcgtttgttggcgtttttgttttagcgggattcggtagttaggggttttagggggcggtgtagtaaatttttagcggtttgcgtttagtagattaggttggggagtcggtttggcgt

SEQ ID NO: 7408 - DNA, 1101 bp, synthetic construct; identical to SEQ ID NO: 7407
  misc_feature 1..1101: note = Description of Artificial Sequence: Synthetic polynucleotide
  source 1..1101: mol_type = other DNA

SEQ ID NO: 7409 - DNA, 2341 bp, synthetic construct
  misc_feature 1..2341: note = Description of Artificial Sequence: Synthetic polynucleotide
  source 1..2341: mol_type = other DNA
cggtttttgtaacggaggcggtttcgaaggacgtaggattttttcggaggcgatagttttaggagttttggttttggagtcggcgtacgtttaggcgcgaagggcgggggttcggggcgttagggatttgtgcggacgggggttggggaaggtttttcgtcggagaggcggcgaggtcggtttaggagtttcgcggagtcggcggttttttagcgtttagagtcgggcgattgagtgtcgagaggaagggaaagcgttgatatgtaaataggggtttttatttggaggagttcgtttagatagatttttcgatatatttatttgtatttttattttcgtgtaacgaggttatttatttattttagggtttattaggtagggattcgagttcgggcgattgtagttttcgttttcgtcgtgtttcgtttttgcggagaggaagtttagtgtttagcgttggggttacgggagtttcgggtgtcggtgggagtggtggatttcgaggtttttcgtttttgatttcgtttcgtattttggggtttttcggtttttcgtcgtttttttttgtagtttcggcgggtagcgaggtgggaggggggtcggggttttattttgggggttgggatttcgggggagggtcgtttttaatgcgggcgtttggtcggttggttcgcgagtaggattcgttattcgagcgtcggaggagtcggcgcgaagtcggggcgcggagggaagggagagaggttacgtttttcgggacgcgggtttcgtatttattcgttcgtcgtttcgttttttcggtcggttttcgtcgttcgcgttcgttgtttcgtcgtttattttaatagtttcgtttatttggttaagtttgtagtcgagttttttaatattttatatattgattcggttatagtttgatttcgtagttttttcggattagttcggcgcggtttttttggcgttttgggttttttttgcgtgttttttgcgagcgttttgtttttatttttttgtgtacgtttgttgttgtagcggagcgaaagagatagttaatcggatgaaattttttttttagttaattttgggaagtgattttattttgcgaatcggggaggaagttttatttttttttttttttttttttttttttttttttttttttttttttttttttcgtttcgagtttttttttttttttttttttttttgtttttttttgttttttttttttttttatatttttttttttttttttgttggttttgtttttcgtattatatattatataaatatacgcggagatgtttagatatatttatgcgttgcgtatataggatatttgtttttgggagataagagttagtcgggaataatgacggggtttacgtttagcgttcgcgttttgattttcgaagtttgaatttttttttattatttttttttaaaatttaaagttaaagatttttggtttttttgttttttttgaggcggttggtcgaaggtggtttttttgatttatttatttttcgtttttttttatagatacgtttattaatgttttttttagtcggagataaattttttgggggtggggtagggggggtatggagggagagttggttagggttgcgggtaatttagcgtttattgtcggggaagattcggacgaaaatcgaggtaaattaattattaaaaagtgtatttaataagaatttttttatttaggtttttcgttgtcgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacgttttttttaggatagttagtaggttttaggagcgtagtacgtaatagcgtagagtagatttagatttttttcggggtgagattcggaggttcgcgttttggatcgttttttttatttagtttggaggtcggcgtttttcggtttaattcggagattttttcgttttttttttgggtcgtcgcgcgttttagttggagtagtttcgaggggttgggttttttcggtcggatttttttttttcggatatttaaaataggttattttgtttacgtttttcggattacgt

SEQ ID NO: 7410 - DNA, 3857 bp, synthetic construct
  misc_feature 1..3857: note = Description of Artificial Sequence: Synthetic polynucleotide
  source 1..3857: mol_type = other DNA
cgagtagaaattatcgtgtttttgggggtttttcgggcgtcgtggggcgacgcggtgtagcgtttagggtcgtcgtaggtcgggggtagggtttttagcggttttttcgcggttagcggttacgtaggaaaaattcgttttttcgtttttgtatttgttgataagtcgttcgaggtgtttgcgttgagcgtggttatatcgatgtagttttttaggaaatggttcgggagggggagggggcgagtgagggattaggttcggttttttttcgttttttttgcgtaaatattattattttttttttttttcggaggtatgaggtttttacgttcggtttttcgttcgtattttcgtcgattttttcggtttcgcgttttattcgttaggttttttttttgggagtcgattgcggtgaagtcgtcgttagtacggtcggttttgatacgtgttttaacgtatgtttgagttaaggttgtttttataggagatacgatttggtggcgtttttttattttttttttttcgttattttttatttttatcgcgttttttggtgtattttattttaggaggaaggggagagattagcgttttgatgtgttggttaagttggtacgtgtagcgggtatggcgtggttcgagttttttgggtatatcgaggtcgattgagtgttttttttatcgagagagggggttcgggtaggggcgcggagagttagtaaggcggggtggggcgcgggttgggtgagtcgtatattaggttttttgtaaggcggaggaggggagcgaataaattagaggtgtaagcgattaatttaggtttcggagttagtttttttaaacgagggtggggcggaaggggtggtgggggggaaaggaggggatatcgttttaaaagggtgaggaagagtttggggcgtcgttttttttttttttatttgtatagttaatagttttggggtttttgttattgcgcgttgattgttatcgggtagattattttttttttttttttttttttttttttttagtaggacgcgttttttattatattaaaaggaagttaagggagggcggagggagagcgggcgttggggcgggcgaaagttggggagaggttcggtcgttttcgattttattaatagtagcgggaatgagtattttattttttatatgtaaagaaaggggagggaaggggcgggcgaggaaaatgtttaattgttgtggaagttattagtttttaggaagaaaaaaagttcgttgaaaaatttaagttgtaaatttaaaatgaaatagtttagcgtcgcggatgatattcgggtcgaatatcgtgtatattcgtatatagtcggtttcgaataattatttattggttttagttacgttgggtttttcgatttaagtttttgagttatttcggataaggatatttatttatattttaagatttttataagggaattattttaattttatttaagttatttttgagcggattaaagaaagttgtagcggggagaggcgagagaaggagggagggcgggaggtatttttaaagtataaatttaattcgataggtaagggatagaggtcgtcggggtttttagtttttggatattatttgatatagttttgcgagtaaggttttttttatttcgatttcgtatattttttttttttcggggaaaggtatttagagttttgggtttttcgaagtgggggtagcgggggcgaggaagaagcgggtggtcgtttcggggtttagtttatttcgaggagaatgtttgggtggcgagtttttacgtttcgggagtgagtcgagggttttttcgttttttttttttttttttttttttatttcgttttgttttatagagaaattttagcggggaggggggtagcgaatgggaggggtagagagggtcgcggtcggatgtttttttttttcggcgttttttgtatttatggagattcgtaagttcgggcgtttttcgcgtggtaggttcgttttttgaagtttttttgtttattttttttttcgattattgattgttttcgagcgtgaagttcgttatcgaatttaattttcggtggttttgtagatttttatacgtggggtggggcgtgagagggtgcggaggttggtaggaatgtttttaggaggtttggattggaaattgagtttttttttttggtcgttattttagttatgtgttaaaattttaatgttttgttaaaatgtattttatttagtacgcgggaaaacgtatgttgttttttaggtaaaagtgtatatttttttttagtgtagatttcggttttaagaaaaagcgtaagagtttgtgttttggttttgaagtttaaattgattatcgtggcgcgggggtggggggcggcgggagggggtagattgttggtttttttttattttttttttattttttacggaaaaaaaaatatatatatatatattttatgtaggattggtgataaattttagcgaacgttagttttattggatttttatttttttttcggtcggttttttattttttacgttagcgttttggagtttcggttggaaagtgtataaagtttggaggtggagggtgtagtagggtgttgggtgtttataggtatttttttgtaggagtttgtagtattaagtatatatatttttaagtttatttggaggatgttttttagttaggtgatttcgcggtcggtttaaggttcgggagtagcgcgagttcgagtttcgtttttttcgcgtaggggcgtttaggttaggtggggagcgggtagtgattgagtttaggtttagaaatgggagttattgtttttttttcggtttttttaaagagtggagttgtgtttgtgttttttcgtggagggatggacggttaattaaaatcgaaaattcgattggtaaaatgcgaggggatatataaattcgaggggatatataggaggtatattaagaggaaggagggagtgtaggtaaagtagaaaaatgcggataaggagaagaggaaaacgtcgggaagcggagagtacgggggagtagggtgggtggggacgggtagtgcgattgtaggtgtttattcgttttcgggattttttggtcgtagtcgcgttcgtcggggcgttgggtcgttgcgttttggaggggggtagagttcgttaggtttgtgtattcgtatttttttcggcgaatttcggtttggacggggttggattattgaggcggtagatgcgataggcgtgagttaagaaggcgagcgtttgtcgtttgttatttatttagtattttattttttttttttcggaaaaaaaaaaaattaaaagattcgaatttttttttttttttgtttgatttagtttaggatacgttttacgcggtcgaaaatagttttggaaatatatttgttttataaaagtgaattttttaataagttttggggcggggggcgttcggcggtcggcgtcggggggttttgtttttcgggaggagaaggaatcggtcgttttcgtttttttttttttttaggcgttttcgggagggggtcgttgggcggcggaatcgcgttttcgttcggggagttattacgcggttttttcgcggaattttgacgttatttatacgtgggggaaggggttgggagagtaagaggaagcggcgggggagggggtcgcggttgggagagcgcggcggcggcgcggcgggtttggtattttcgcggtgggcgtagcgtcgggtagggttcgggttttgggtagcgcggtagaggaggtcgtgtcgcggatttcggagttagcgtcgcgattcgttttttttttcgtttttcgtttttcgt

SEQ ID NO: 7411 - DNA, 1439 bp, synthetic construct
  misc_feature 1..1439: note = Description of Artificial Sequence: Synthetic polynucleotide
  source 1..1439: mol_type = other DNA
cgcgggttttttcgttaagcgggacgtcgcgtcgggcgggtgagagaaagttcgggtaggagagtatagagtcggcgattggacgcgagcgcggggcgggtggagagcgttttttcgggcgtcgttgttgttgtttcgggtgttgaaaagtcgggaatttttcgggaagtagcggtatttttttttttggaaggtgggtgtgggggttttagattgcgtatttgttaaatttttttgggtttttcgggaggggttcgttagatgtgtttttttttagttttattcgggggagaaggatgggggcgggggcgtgggggtgagtatagtcggatatcgtaagtgggaatttggggtgttttttttcgtagttttcgggtagtcgcgcgtcgcgaatttcggtttatttgtaagtaaggcgggtcgggggtagagggcgtcgggttgtgcgggggaatcggttcgcgtttcgggattggggggcggtggaagagagagcgagcgggtatgcgtagtggggcggaggaggtggcgatggtcgggggaggcggggggattgttgtttatttgtagttgggttaatttcgcggcgtaggcggcggcggagcgcggggagttcgcggcgggtttagttgtcgtagtattatgttcgagttttttttcgggtagacgtcgcgcgtcgtcggggtttcggtaggggaggatgttagacgttcgggagaggttagggtagtagcggcggcggcggcgcgatggtggtgattatttttgttcgaggcggcggcggggatcgtatattttttcggcggcggggttgcgggttagcgtcggtcggggtcgcggcgttgttggtcggggtaagttgtttgtgttacggtcgttttttgtagggcgagttcgtgtacgacgacgtgtgggcgatcgtgaataatttcgacgtgcggttcggcgtttcgtttcgttggggtatttttattaacgatttttggggtaagggtatggtcgagaatattagttataagttttatcggtcgttttgcgtttttatttttaagtgagttttttatttcgcgttagtcgtcgttgttttttttatttttcgttcgtttttcggatcgggagaagttgcgggattgatttgggggtattttatttttgtcgttttttttttttacgttttttttttttttaggatgtgtatggtattttgtttcgggatttattgttcggttaatttgggttttcggggcggttcgggaggcgtcggttggggagttgggatcgagttttttaattgtttgtttttttagcgggtttttttttcgaggtagggttgggagcgggttggtgaaatcgttttcgtattttttcgtttgtcggatcgtgattaagtgggattagcgcggatttagagggtttcggaggggtggcggtggtggcga

SEQ ID NO: 7412 - DNA, 1288 bp, synthetic construct
  misc_feature 1..1288: note = Description of Artificial Sequence: Synthetic polynucleotide
  source 1..1288: mol_type = other DNA
cggagagggtttttcgggttaattttgggtaacgatgagtattttcggtttcggtaggggcgtcgggtcgttcgtttttttttttttttttttttgcgagttttttttttagaggacgcggggagtcgggtttgcgcgtttcgtcgtttgttatttagcgttcgcgtcgggttgcgattggacgcgtcgtcgttaggtattcgttagaaatattagtgcgttggggagaggaggggggcgtgtttgcgagtcgagggtttgttttggtttttttacggtttttttttttttttagtattttatgtcgggtttttagttttagcgcgtttcggttcgttcgcgcggcgggagagttggcgtaaatttcgcggtagtcgtagttttttcgcgcgttttttttttttttacgtttttcgttttcgttatggggttaacgtggggtttttaagagttgtcggtttttagcggcgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcgagttgtgtttcgtcggttaggtggagtgggagaagtgttcgggtattttttttcgggataggggtagttagggcggaagtagtataggtaatcgggagggtttcgttcgcgttttcgcgtttcgttgggatttcgcgcgttaggttgtaagtttcggggttttgcgtttttcgcgtcgttttcgcggtatatttggggcgttacgtttttttatttcgttttttttttcgtttagtttttgacgatttcgagggtggggcgtttgggttttgtttttttttgtttatttgtcgggttttttttattttttggttcgtttttcgtttttcggcgtcgtttttcgtttttagtttcgtcgcgttttttcgcgtttttttacgttttttatttttttttcggagtggagaagtgagtgcgggcggtgacggcgtcgggacggttcgcggtttggttgtttgtgggggcggtttatttgtgggattagggttgttttcgttcgttttatcggtcgttggtttcggttttgttgatgggggttaggcgggacggataagttatgtttggacgtagaatttttttgtagaggtggttgttttggttttcgaggtaattcgcggttgtaatttgtcgg

SEQ ID NO: 7413 - DNA, 1006 bp, synthetic construct
  misc_feature 1..1006: note = Description of Artificial Sequence: Synthetic polynucleotide
  source 1..1006: mol_type = other DNA
cgagttcgggtttttacgttttatttggtagggggcgcgcgggtttcggagttgtttagtattttttggttaagttttttgcgtttttcgcgttcgggaagtttttcgcgtcggggaagttttttagcgtttcgttttcggtagggaatttttttattaggatattcggggttttttaggttcgttattcgtttttattagtttttatttattttgtttagttttatttcggtagtgtagcgtgttttggtggttttttttcgtacgttttggagggggagtgttttgtatttcggggttgtttcggagtttagtgtacgagtgtatatgggttttttttttttgtttaaagggtaggcgagcgttattcgttttagttttgttttttgtagttgggtggtttttttttttttttgttttttaagatacgcgttcgaaatcgaggggtgagagtaaagatcgtttattaatttagtattttggatttagagtttttaatttcgaaaggaggttggtattgttcgggttatcgagagagggagggagaagagttgaggttgtaacggtttttgggttttttagatcgggtttggtatttaggagatcgtgcgggagatcgacgttgagcgtcggtttcgttttcggcggttttttttttttttttatttcgtttttttcggttcgtttttttttttttggaggagtagttttttcgcgcgtttttcggagttttttttattgtttttgtttttataataggttcgggcggcggggaagacgggggggtgcggggtcgttttagttcgggtttttttggggtcgttttttttttatcgggtgtgcgagtttttggttgtttttattcggttcgggagttaatttttcgacggagtcgcgtcggggcgagttcgattttttttttcgggtttttttcgggtcgcgttgtcgtttcggttttgcgtgtgggaatgatgtgcgtattggagggtttaagttttttacgcgt

SEQ ID NO: 7414 - DNA, 1185 bp, synthetic construct
  misc_feature 1..1185: note = Description of Artificial Sequence: Synthetic polynucleotide
  source 1..1185: mol_type = other DNA
cggagagttagggttcgtttaataggagtacgcggagatattttagacgatagcgcgttttttttatttttatttcgtttttcgggcgttttaggttagcgtttattagattttacgtttgggggattgtttgggttttagcgagagtgttacggttttgtacggtagcggggaggtggcgagcgcgttcgatttacgtcgtttttacgtttatttttttttattacgagttttttttttttgttatagtattatttttattgttggtcgcgtttgttattttgtggggttggtgatatgaatggatgggttggatatatttttcgttcgtttagaaaaaaataaaaaataaaaaaaaaattcgtttagatttgtatagagagggggaaagatttttttttgcgtttttagagtttacgttgtcggttagagaaatttatagttttttttttttatatttattttttttattttttaaaaaaacgtttaacgtaaataaataatatcgttttaagttcgtcgtcgtttcgggtggttttttttttttgtttggtttcgcgcgttttagttttgcgggaggcggcggcgagaagttgcggttttgggtgcggtgcggggcgttcgggcgataggcgggcgtaaggcgggcgcgtagtagatcggttggcgtcgtattatgttttttagcgcggtcgtagtttacgtcggtgcgtattgggacgttgtggtttttttcgcgttttttaattttttcgttgcgttcggttttggtaatttgggtaagagttttttgatcgagaatttgttgcgggtcgggggcgttttaacgtttaggttgtagtcgttcgcgttttacgattcggcgatcgttttggttatcgcgggcgcgtagtttcggtttttgtttgttagtttagtttttttaaagttgtgtttcgtagtcgaataagttagtttcgtcggggcgttttacggaacgcggtgggttttttaagtgtttagtttttttgcggatagtgcgaggttgtcgggtcgggtttcgggggatcgagattgtattttttagtttttagcgttaggtgagttagtttttttttttttttttagtcgcgttcgcgtttttaggtcgggtggtttagggatttgggagcgtcggcggtgcgtattgcgtttagggagagtcgg

SEQ ID NO: 7415 - DNA, 409 bp, synthetic construct
  misc_feature 1..409: note = Description of Artificial Sequence: Synthetic polynucleotide
  source 1..409: mol_type = other DNA
cggttttggttttacgcgggtagcgttagttggtcggtgttacggagttttcgcgtttttcgttcgtttagttttcgcggatttatttattggggttgtttcgtagcgcgatttttttttatttcgggggagggttaagggcggcggtggggggcggggtgggggggaagcggcgggagggggcggtgcgtcgtcgttttatttcgggttcgcgaattcgtagcgtttttcgtagtatttttttaggttcggttttttttttttttcgcgtcgatggtacgcgtcggttcgtttggttcggttgtagtggatgttgttagaatttacgcggaggaaggaagagacgtaggtaggttgcggttatttaagcggttattcgggttttagggatttttttttcgagagacgg

SEQ ID NO: 7416 - DNA, 1813 bp, synthetic construct
  misc_feature 1..1813: note = Description of Artificial Sequence: Synthetic polynucleotide
  source 1..1813: mol_type = other DNA
cggggtcgttgcgtttttttgattattgacggttaggacggttttagtttcgttttatttgtaagttttattttaggttcgagttttcgagggtagggatagtttttcgggtttcgaggtttgattagagtttgaaagtttttgtcgggggttgtttcgatttagcgaggcgttaggttgttcggcgcggttgggggcgtttagcgtcgggattttagttttgtttcggtcgttcgttggtttagtgcgtacgtttcggtagtttagtttttttttttacggcggtaggagagttttcggtatttgtttggggcgggggcgggggcggggcggggcgggcgtcgcgtttttttgtttgattggtaggaagatagattaatcggaggggtttttcggggggaggggcggtgtcgtgtttgagtcgggcgcgggcgatcgagggagttgtagttattcgcgtgcggtacgcgtcggtcgtttgttcggatcgcggttattagtgtcgcggtttttcgattttcgtttcgtcgagtcgcgcgcgcgattgttattttttttaattgttttttacgattttttttgtgtatgtatttattttttgtttcgttttgttttttttaaggcggtggcggcggcgatagcggcgtaagttcgtagcggggagggggcggtcggaggatgcggcgcggggttgcgttcgttacgttcgttgttgttgttcggttcgggtttgagcgtcgagtaggtgggtataggtgcgtcggggggcgggaggcgagcgttggttagagggaattcgtggattcggcgatcgaggggcggatttggcggtaagggacgcggcgatcggtgtcgtttcgttttatcgtttatttttttttttttcggttatcgcgttttttttgggttttttttttattttcgtattttattttagtggttttttatttttttatatttattttttatttttttttagatttttttgtaaaattttttagtcgttgcgtcgttttttttaatattttttttcggtttcgtttttagtttttagtttttttttacgttatttttatttttattttttttcggatttcgtttttaagttaaggagcgggagggggatttattcggtgtttgtcggagtggcgcggggggtgtggtcggttcgtttttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttgtcgggtcggcgcgttttgggcgtattggttttcggagatggcgcgtaaggattgattttcgtggtgttagatattttgtcgggcgttttgcgtcggggttagcggtttcgttggtttgcgttagtgcgttgcggtttcgttttttagtttttcggtttttcgttttattttttttgttgtgggtttttgagtattcggtttgggtagtttagatagaggtcgtttacgaggttggcgttttttttcgttttagaagtatttcgtttttatatattttagttcgtcggttttttgaaggttgggttagtttcggtttttcgttagtttttgttcggttttttgagttttagcgatattgtatttaatcgttagttttttttcgtcgttcgt

SEQ ID NO: 7417 - DNA, 1294 bp, synthetic construct
  misc_feature 1..1294: note = Description of Artificial Sequence: Synthetic polynucleotide
  source 1..1294: mol_type = other DNA
cggttggagaagttttcgttagcgttgtttgtggttagattcgttttttgttttttttcgggcgtatatatacgtttatttagatatttcgcgcgttttttcgcgtttttgtttgttcgttcgtcgtcgtttgtttttttttttttgttttcgtcggtcgttttttttttttttttttttttttttttttttttttttttttttttttttttttggtattatagagttgttttgaaaatagaagatagagggagtttcggagttcgttatttttagcgatttttatattgggaaaaaatatggagttagtttcggtagttttcgatttcgtcgttagcgagttaggtagtagcggcgcggacgcggtcgtcggttttagggagatttcgttgaattaggaattcgttcgtaagagcgagtcgtttgtttcggtgcgtagatagagttattttagtattagtagaggtaggaggttggagaggggttggggagggggcggcgggagttcgggcgcggagcggggggcggtcgggagcgggcgttcggggcgcggggttcggcggtcgcgcgcgagtttgcggcggcgtttcgagttcggaggattttttttttttttttttttcgttttttagaaatgttgtaaatttttgtagttcgttttcggtttgcgggagtagagtggggcgggggaggcggcgggaaggttgatagtcggcgggtttatttttttggttttgatttttttgtaaatattggaggaaagttgcgttgttttaattaaatacgtttttttaaaatacggagatgcggggagtgggggttcgggaaagaaatttttaaagcggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcgagttgttcgttaagttgtttggcgggcgcggcgaggggagatgcgtaagtttgtagatcgggggttcggagttcggcgtttaggttggcggggggcgtgtgcgcgttaacgcgtagagggcggcggttttgtggggcgttttacgcgtattcggagggagcgt

SEQ ID NO: 7418 - DNA, 939 bp, synthetic construct
  misc_feature 1..939: note = Description of Artificial Sequence: Synthetic polynucleotide
  source 1..939: mol_type = other DNA
cgtcgtaaggttatgggtcgaagtggtgtaggggcggcgttcggggaagcgattggtagagttgtgcgtattgggggtgttgtaggcgttggggagagtgtggagaggttgcgtggagttgcgcgttcggggtgggggttgtatttttaatgaagcgcgtgaagggtaagcggtgatgggttttgcgttagtggggttgggagttcgttcggggttgtatatggggttgcgcgtaaggtgaggattgcgtatgtgggtttggggtttgcgcgtatcggaggttgtaggcgttggggagggtgtggggggttgtgcgtggggttgtttttatcggaagttgtacgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcgttgaggttgttaggcgagttaggtttttttggatttcgtttgattcggttgggttgtgtttgaaattgatttagttttattatattttttgattatgagaaaataaggagtaagtttaaagcggttgtaatttttcggtcgtagttagtttaaggggcggcgcggggtttttttcgttcgggagtcggaggtagaggaggagatggaaaagtcggttttaggcggcgggaaattgttaaggggtttttggaggtttttttcggggaggatttaaagtttgaaagagcgaaaaggtttggagttagaggtggtggttaagattttttttttcggttttttttagttcgttcgtaattttttggcgtagtttcgggaaaaggtgtaggaattgtaggcgcggcggttttttagtagaattattttcggtatcgg

SEQ ID NO: 7419 - DNA, 939 bp, synthetic construct; identical to SEQ ID NO: 7418
  misc_feature 1..939: note = Description of Artificial Sequence: Synthetic polynucleotide
  source 1..939: mol_type = other DNA

SEQ ID NO: 7420 - DNA, 899 bp, synthetic construct
  misc_feature 1..899: note = Description of Artificial Sequence: Synthetic polynucleotide
  source 1..899: mol_type = other DNA
cggtttttgagggttcgggtagttattcgtattttttcgttacgcggagaaagtcgagtatataggtcgtagggtgggggttcgcggggagagggtggaagtagcgggtttttcgcgtttggggtggtcgttgttttatttaggttttcgtttgttttttatttttttagattaatcgttttttgtaggtgttaacgcggtgtttcgtattaggtggtacgcggattttttttagagtttttcggtttagacggagttaggttaaggtagaagcgcgggtagtttcggcgttattttatagcgttttatttgtagttttggggtttttattcggttttagggtgtatagtagtcggggcgcggttcgggaaatgtagttgcgttttttgagtatattgtttaggatggtgtttacgtcgtcgttttgtcgttttaggtattttttttcgcgttttagagattcggttagtttgttttgtcgtattcgagagcgtttcgggttttggtacggttatcgttcgtttcggttttcgttattttattcgttgagcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgggagcgagcgagcgagcgagcgcgtgggagacggaggcggcgtgttcgtttttaatttcggtatcgtcgtgcgtaggcggggtcgttttagttttttcgtgtttagaagcgttagagatagggagttagtgggcgcgtaattgcgttcgg

SEQ ID NO: 7421 - DNA, 899 bp, synthetic construct; identical to SEQ ID NO: 7420
  misc_feature 1..899: note = Description of Artificial Sequence: Synthetic polynucleotide
  source 1..899: mol_type = other DNA

SEQ ID NO: 7422 - DNA, 547 bp, synthetic construct
  misc_feature 1..547: note = Description of Artificial Sequence: Synthetic polynucleotide
  source 1..547: mol_type = other DNA
cggcgttttggcgaattcggttattttagttttttacgtggtgagtatttagggtagcgggtcgatttttcgaggttttatatttgggtttgaggggcgcggttcgtagcggcgggtgtaggggcgattgttagtttttatttcgtttcggggtgcgttcggaggtcgatatttggaggacgtttttagttttcgcgggacgttacgtttgcgcgttagggattcgggataagaagtgcgcgtcgggtttcggttgcgcgtcgcggggttattagtttgcgcgtagggtttaggcgatcgtgcggttatggatacgttacggggtatcggtattttcgtggtgtgggattacgtggtgttcgcgggtatgttggttatttcggtcgttatcggtatttattacgttttcgttgggggcggttagtagatttttaaggattttttgatgggcggtcgtagaatgatcgtagtgttcgtggcgttgttttttatcgttagttttatgttagtcgttattgttttgggtatttttttcgaggtttatcgt

SEQ ID NO: 7423 - DNA, 2505 bp, synthetic construct
  misc_feature 1..2505: note = Description of Artificial Sequence: Synthetic polynucleotide
  source 1..2505: mol_type = other DNA
cgtttcgtttcgtatcgggggcggaatttcgcgttttcggatttgggatagtattagtagcgtgaaatacgcgtattcgagtgtaggagtaaataggtaattttttgttttggttatttttagttcggtcgtttttttagcggtttgggatagtagcgcgtggttgggaagacgcgggagggggacgcgaggtaaatttgcgttaagagttggttaggttaggtgagagggagtggtattcgcgtagatatttatcgttggcgtttttttcgtagattaggtgttggtagggttgtaggagattttagattttcgagtcgttgttgatcgtgtgttttagggtttttacggtgaatttgggcgtttcgtggagcgtatggtggtggtgatggtggtggttggcggcggttgtcggcgggattgcggcggtcgcggcggtcggcggggcgtaatagttgttgttttcgttggcgttgttggttgcgttgtaggcgtcgtcgttcgtcgtttttttttcgggcgtttttcgttttttattcgtcgcgggggtcgtattagggttcgagttcgggtttgggtcggagttcgagtttgatttagggttattgtagtttcggggtatttcggaggttacgattcgcgagtagatgtttcggaagaggttttttatgtaggttgttaggtagatggcggcgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcgtcgtatagtgcgcggttaggttttaggatagtacgatttttatggcgttttggatttcgtatttggtgtatttggcgaagcgtaggtttaggcgttgcgtttttttggttatgcgtattagcgttcggtttattagcgtcgatagtttggttagcgcgtttttgggtaggtcgtcggggatcgtcgggtttgttcggggatttcgcgaacgtagtagtagcgtttttagtttttggagagtttaggggatttcgtttaggttcggtagtagtcgcgagtagtgttggtcggcgtagtttagtttttcggagttttttattagggtagtgttgatagtgttaaagttgttgtgtcggttgtgtatggagttagttagaggcggttagtagttttcgttatacggggacgtcgggtgcgagtcggaatagtataaagataagttggaggagcgtatcgagttcgtcgcgttattataattcgagtttagcgttagattttttagcgtttttattacgggttttttattttttttggttatcgttgcgttattttatgttgtagtcgtttgggagttaaagggaaggagcggcgaggagtagcgagtgtcgcggggcgcggggagagtcgagttcgcgtcgttttggtttatttttttattagtcgttgttattaattgttagtattttcggttgtttttcggaattgtcgtcgttggaatatatagagtagattttggagttattttttagagttcgggtcggagttgggcgtaatggggagcgagttaggtcgggaaggaagttttcgtcggggtttgttttttttttttaaaataaaaagtgtttagatcgtttttttttgagtttcgttgggcgtagtagttatcgggcgtcggttacggtgttcgtgggattgagattattttagatgtcgtcgtcgtcgtagtttcgcgggtagttggttttcggttttcggtttttagttttcggttttggttcgttcggcgttagtttgttttgtatcggagcgtagtagcggtcgtggcggttgtaaattttgtcgaattttagtaaatttcgggtagttagtgggacgggcgtatgtaaagtaggggcggcggagagttagtggaatcggagaatgttaattatttcgttttttttttttttttttaaattttttttttttatgcggtttcgttttttatatacgttttcggcggatatcgaggttgtaggaagtggggagtagtggttagggatttggggaatttttgtaagcgtagagacgtggatgttgttttttgttgttgtttttgttcgtattttttcggagggtggtgggttgggtcggtgatttttttatttaggtgtgttttttatcgcggtttataaggtgtttgtttgacggtcgtttttttttttgcggttcgtattttattttttttttttcgtaatatttgaaatatggtttttttttttttttatttttatttcgggtacgtaaattaattagtgcggtttttttttagtcggggtttgttttagtatggagggaaataagtttgtcgagcggaggttcgtggcggtggatattattgggaggtcggattttcggttattcgttatttgttattagggcgcgttaattcga

SEQ ID NO: 7424 - DNA, 1587 bp, synthetic construct
  misc_feature 1..1587: note = Description of Artificial Sequence: Synthetic polynucleotide
  source 1..1587: mol_type = other DNA
cgaggagtggggcgttcggaaggacggggattgggaagcggttaggacggggagaaggcgcgggtgttggaattatttattagaagaaatttaacgagatttgtcggcggattaaaaaaaaaaaaaaaagtgggtttttttttatttttagattgatgatttcgcgtttttcgcgaatgttacggttaaggtaggatgttttaatcgttttgttattcgtattattttttcgtttttgattttcgtcgtattcgtcgagattttgcgagattttaaggttggggggttttgttaggcgcgttcggggtatttcgggaaagaatagaggtcggagtcgcgtttttacggtgcgttttttgagattttattttttagtttcggtttttacggggttcgtagagaatatttttaaatttaggggaggtatatagatttttataaagggaggatggggagaaagtgatggggtttcgaagagtcgttttagggaaggagagagaaagagtagggaagagaggaaagaaatagaagaaaagtagagacgggagagaggagacgaggggagtagcggggagaaacgtaggaggtagaataagtaaggaaattttttatttaaaagtttttttgggttcgagggttgggagttatttgttttgcgtcgttttcggttttttatcgttttggaggtaggagcgtaaatttgcgagcgttcgggtttatttttatcgttcgtttgtatttagatttgggaaggggatggaaggggcgggggggtaaaggtaagaagtaagacgaattttaagatttcggttcgaggagaagaggtttgtcggcgtttgcggttagttcggcggcggcggttttggcggcggcggcggcggttttcgggtggcggcgcgttcgggttgcgtagttaggcgggcggcgaaggttgaggtgtcggcgagcggcggggcgcggagtcgttttttcgttaatttcggtttttttttttttttttttttttttttttttttttttttttttttttttgttcgttagttttttttttttttcgtcggagttttagtcgggtgcggattggtaagcggcgcgtttcgcggttttttcgggcgtcgcgaagttgggaggcgcgtaaagtgcggtttaggggggatcgtcgggggttttcgttagtagttttttgttcgaggtcgtagtttttgtttttttcgtttttcgttcggtcgtttggtcgttcggtcgtttcgtcgatcgagggtttattagcgtttttttatggtcgcggtagttaatcgatgattgaatcgaataaagagtagcggcgagattaatttttaatatttatcgatgggtagcgggcggtcgagtttcggcgagtttcggtagtcgtcgttcgtcgttttagggcgttcgtttgttcgttcggggatttttttaatgcgtttagggcgcgttcgggggttttttacggtcgcgcggtcggcgttgttcgtattaatttggagtcgtcgtagattaaatcgtttttaatattgaaatatcgattttatattggcggttattttgggggttatcgagacgcgt

SEQ ID NO: 7425 - DNA, 5693 bp, synthetic construct
  misc_feature 1..5693: note = Description of Artificial Sequence: Synthetic polynucleotide
  source 1..5693: mol_type = other DNA
cgcgcggagagggtttaagagcgtttttttaaaggtttagtttcgtttggagagagtgggcgggtatcgggtttttgggggaggggttgtcgtaggtttgggagggaatttagcggggttggtcgtagtttgggtaggtcgtagtttgggtcggcgggaattcgttattggattgaagaggcgtttggtcgtcgttgacgtcgttgtttttttttcgattcgttcgttcgtagtgttattttgtacggatcgtagtttgttttcggatttttaggacgtattgtaggacgattttaaagagacggataattcgatttcgtcggataaggagacggttaataacgagaacgaggagtagaattcgggtattaagcggcgcggttttcgtattattattaaggttaagtagttggagacgtttaaggttgttttcgtcgttacgtttaagtttacgcgttatattcgcgagtagttggcgtaggagatcggttttaatatgcgcgttatttaggtgcggttcggggcgggtatagttttttagtttcgttggtttgggagtcgggagtttcggaggagtttttcgttaagtttttttggttacgagcgcgtttggttttggtttgggagtagatcgtgcgttcgagtggggtatttgttcgaggtcggggattgtgaatcgaaagattttatttagttttgttgtttttttggtattgcgatttgggggcgggttattttatttttttgaatttcgtttttcgttttgtttatggaaggttgtaagtttttttggggttcgggatttttttttatttttatttttcgagtagagaaataggcgatgttttttttttttttgcgtcgaagcgcgggtagataaacggttagaggttggtttcggagtcgaggggtcgaggcgagagtcgtgtcgggagggaggtttttatagagtcgttaggtcgcgggcgagtcggggattaggaagtttaagtttttatgagtcgttttacgggttcgcgaaattttttatttttggttggttcgtcgaagtttttttttatttttttcggtttaattcggttcggtttcgtttcgggggagttttggtgcggaagaggcgtaaggatttagtaggggtagtttagttagggaagggagaagagggggggagaggatatttttgattttgggtttatagtttttttttttgttttaggtgtggttttagaatcgacggtttaaagaacgtcggatgaaatagttgagcgttttaggcgttcggaggtacgttttttttcggagttcgcggcgtatgcgttcgttgggcggtcgtttggacgagtttgagatgttggggtttatttcgtatatttattacggaggtaaggggcgtttcgggattcgttgtttcgtatttgttttatttcgggagttgagggcgaagggtttcggttagtacgtttttcgtcgttttagaatatcgtttattcgttggatatacgattatagatatatgtatatttatttatatgttttggatataaaattagatatatggttttatttatatagtgatgtatatagaagtatatacgagatatagtgatatatttatttacgtagggtataaggtgtatttatatttgcgtttagagattttagggatatacgtttagatacgatcgtacgattacgtataggtaaattttatttttttatatataggtatatttacggagatataattttatagacgcgtatatttttattagttatattgaggttagtattggtaaatttatatgtatgcggtttttacggatagacgtatagtttttttgtcgttttgtgtttggtgtatttggtatgaggtggatttcgagcgttggagggtagtgtgaggggaggggatgggggtttggatttattttaagtcgtttgtttattagtatcgaaggtagtaatttttgttttatgtggcggggtgtgtgcgtatagtatttggtagtgttagtttaaatgtcggtagttgttttgggtaggattgtagtttattttttagtttcgagatttttggggtttttatagattgggggtataagtgttgggttaattttagatttttatcgtttttggggttgtagagagcgaggagttttagtttataaagggttttagatggtggtattaggtttgggtttggggtgagttgtttttttgttattttagttttttttttttttattttttttatattggattggtgagttattttaattttttttattcgatttttttagttttttattttgagtcgtattgtttgagtttattaagtttattgttttgttttttttagggttgagggtttaagaaagtatttttttttttttattttgaagtttttgaatttggagagattttaggattgtttatgtttgagaggtatttgtatttttgagttgtaacgtaggttaggaagaggtaattttttttagaaagtgggtttagtggtagtgttagtaaggtaggagttaggtatttaggtagacgtagaagggaagggaagataattttattattaattttagtatattcggaagtttgaggggggattagattttgagatcggatcggggtttttagaaattgtgggtaaaatgttaggttgtgttttttagggtagagattttaggtagtggtagggtttaggttggagcgttttagtcgtttaattttggatagttttttaattttggatagatttttaatttcggatagatttttaattttggagagttcggatggtgggcgtgtttttcggagtttttatttatcgattttttttatttaaatttgtttttttttttataaaatttgggttcggagtagcgaggtagtgggggcggtatcggttcggaattttttttcgtttggataattaattaaggttttttcgaggattatttcgttttcgtttcgatttattttatcgttttttttttttgcgcgttggatgaggtggggagttggatattgggggtttttcgtttttcgtaatggtggggaagattttttagtttttagcgaggtagtttcgtttaattcgcgttgggagatttcggcggtggcgatcggtagcgggcgagaaaggggtcgggcggcggggtcggcggtttttcgtgggagcgcggataaagttttagttgcggtttttgtgttttttttagacggcgtttgttttaattattttcggttcggtcgttatatgggcggaggcggcgcgtacggcgcgggggtagcggttttcgttggtttttcggttcgtcgcgggtcgcggtcgttttttatttttgtttttttggggttttaaatttgtcgttttttatttttttttttattttcggggagaattaaattaatggttttaaaaagtaattggtaatcgttttagttgttgtttaaattgtttttaagttacgtttttagatattttttatttggatagattttagggtttggagagggaagagggtggtagggggtattaggaattcgttttttgattgagattttaggatttagtagggggagtggatttgtagaagagatttaggtttttggattcgttggttttttcgtcgtataaagcgggtgtttggtataaggtggttttttcgtgacgttttttacgttagttttttagggttttatttggtgggggaaggtaggatatttcgaaggttttggaaaaggggttatgtggggcggttagagagttgatatagatttgttgaggtagaatgggtttgtaattcggagtttttatattttttgaatttatgggtaaaatttttatttttgtattttttttgagagagagtttatagttattattagttttttaaaagattttaatgtttttagatgttttagaatttgggggtgttggtaaaattaattcggggtaaggttggaggatcgagtttttattttaaggagttcgcggagttttggttatgatttagagaattttcgtgttttttttttttttttttaagtcgttggagtttagtttttttttttttaggttaggttaggtcggtataaatggttttatcgggatcgacgcggcggtcgtatttggcgaggcgaaggatttggattgggttggtagggcgtagggatcgagtttagggcgttaaggtcgtttcgttcggtttaatttattagtcgtttttgtcgcggttcggatttagtttttttcggttaggtcgtttttcggttttaattatttcgcgttttgttttgttcgttggtttgtttttgttcggttttttttttcgggtttgttagttttcgtttttttggaggtttttgggatttatttttgatttatcgttttgcgttttttgggcgtatcgatttttttttattttcgggtttatttttgattttttcgttgtcgttttcgggggtttttacgcgtgtttttaatcgcggtcgttttttttttttttgcgttttttcgattttttcgcgatttttcgatgtttcgggttttcgggttttagtcgcggatttcgtgtttttgggtttttttttcgtttttttttttgtttttttgtcgattttttcgtttgtttttcgttgtttcgtatttttgtgttttttatcgattttaagatatttaggaattattgtttgtttttgcgtttttggtcgtttttgtttttttttatttttaggtgttagggaatttgtgattgaagttttcgagtttttgtcgcgtgtgttttttacggtttcggagtttttttcgtttttgtgtgtggtttttggtagtttgagttttttgttttttcgagattttttattgtttttttttttaatttttttcgtgagtttgcgacgtttatcgttttaaggggcgtcggttttcgtaggtttttttaattttgggtcggtgtcgcgcgtttttttttttcgttcgttcgggtttttttttcgggtttcgggtttttcgtttatttcgtttttttttatcgcgttttgtttttttttcgttttttttttgtagattattaaggcgattattacgcgtcgggaagtaattacgattttttcgcgtacggttcgttttcgtaggcgtagttttcggtcgattttagttttttggcggtttttggtttcggttcgacgtcgttgggagcgttggaatcgtcgttcgtcggttcgtacgtcgcggataattttaggtttatcgatatgatttcgtattcggatatatcgagtttcgagttaggtttgtcgggtacgttgtattttatgttcggcgaggtatttagcggcgggtttagttcgttttttttaatgagcggtattagcggttatagcggatttttgtcgtattttaatttcgagtttaacgaagtcgtcgtgtggtaaggtcgtcgggtcgtttttcgcgttcggttttcgggggtttcgtttcgaagtagttttttgaaattaaaacgttcgacgtagacgcggtgggagacgtgggtgtttttcgggggttttttttcgggttcgtatttaattggtagttgtttttcggttgggcgtcgagggggggtcgatttttatttttatttcgcgggttttttaggagttttagtttatcgttagtatttttttagtaatcgcga

SEQ ID NO: 7426 - DNA, 589 bp, synthetic construct
  misc_feature 1..589: note = Description of Artificial Sequence: Synthetic polynucleotide
  source 1..589: mol_type = other DNA
cgtcgcggaggttttagcggtaggtgcgttttagtaggtagtagtagtcgttattttgggtaagtagtaaatttcgtataaatttcggagttattatgtttgttttttcgttttatcgtcggtttttttgttaggagtagtagaggatgtggtgaatgtatcggttttatcgaacgaggtaatcgtttcggtagatggttcgggaggtttaggagggagttcgtcggtcgagtcggttggggcggcgggaatggcggattttagttcggttttgtattttgtagagtatagtttgtagagattttgcgcggttcggagtttttcggtaaatggagtttgggaggtcgtcgcggttggcggagcggtattgaggtttgtagaagtacggtttggttttgttaaatcgtattttgttcgttttcgttagtttagagtttttcgggattttggcgagggcgcggggtaggatttttttcgcggtcggtagtgaatgggagcgcgtgtaggggcgttagttttgtttttttttgttgtgagtaggtagcggggttttagtcgtcgtttttttgaagtttcgagaacgaggcga

SEQ ID NO: 7427 - DNA, 1294 bp, synthetic construct; identical to SEQ ID NO: 7417
  misc_feature 1..1294: note = Description of Artificial Sequence: Synthetic polynucleotide
  source 1..1294: mol_type = other DNA

SEQ ID NO: 7428 - DNA, 1373 bp, synthetic construct
  misc_feature 1..1373: note = Description of Artificial Sequence: Synthetic polynucleotide
  source 1..1373: mol_type = other DNA
cgattttcgttgagtttacggtttagtttttatatatttatgtcgcgtttttagtcgttgggtgaggagttatttagcgtcgcggttttttcgaggggcggtcgggtagcgagtagcggtcgagcggacggggtgagttaggggcgcgcgcggggcgtttagtattgcgtcggggaagttcgtagttttcgtttcgaatttgggttcgttgaggttgagggaggggacgtaaggggagggaagaagagaagggaggagtgggggttaggggagagggggtggggagggattttggaggtataaagcggaggggaaggggagggacgcgcgcggtttttattaggaggcgagtgggtgtaatcggcgttttttagtcgcgcggggcggcggattcggaggatttagaattcggagcgcggcggtcgcgggcgttcgggaggaagaggaggagtacgaggcgggcgggcgggtgcgtagcgcgaagaggtagtttcggcgttgttcggttcggcgttaggtgagtttttgatttaggcgtttcgcgtttttttttcgtttttagggtttttcgttttcgttcgagtttttggtgtgcgcggaaggttcgggttttgttgcgcgttttaatttggttcgggcggttttattttttttttagcgggcggttttaggtcgggggtttcggttcgggggtttacgcgtttaggttttaattttgtaagattttagtcgttttttagtcgcgcgtttggtttcgagttgtgcgttggcggtaatggcggagtttttggtatagttcgttattttttcgcgggtagttcgggttgggggatgttagtttttggggatcgttgtatttgtttaagtttaattttacgtttttttcggtgttcgattttgcggtcgaatcgtaattgcgagtcgtaggtaatggcggagtttttggtattgttagttgttcgcggttgggggttcgaggttgggagggtttcgttttcggaatatcgtttcggtttggtttttaattttgcgaggagtttttttgcgtttttttttcgcggttatggcggggtcgttcgtattttttatttttttcgtttgggcgagattggggtgtaagagcgtcgtttttaaaatttgggaaagttgtgtttttttcgtaaaggaggttttagggaggtcgaggggcgcgtttcgttacggttcggggttgggtagtggaaggagcgttcgatgaggttgtttttaggtggttagggttcggagtagggttttcgggggatttaatttttagggttatttaggggttttgcgttcgaggtttcggaaggggttttttcgggattgcgttttagaggacgttagacgttcgt

SEQ ID NO: 7429 - DNA, 1524 bp, synthetic construct
  misc_feature 1..1524: note = Description of Artificial Sequence: Synthetic polynucleotide
  source 1..1524: mol_type = other DNA
cggggaaaggcgtggaggggggttgagcgggttcggggttcgttcggaatttggggggttgaggggtcgggcgttgggcggtggagggaggaggtagggggatgcggggagtggtgggggagtttttttaggaagtgagtgtgcgcgcgcgtttgtggggagatgaggtagttgttggtgcgttttggggttttcgattcgagttttgtggcgggtcgtttgttttttttttttttaagtttcgatttttttttttttattttttttttttgtattggcgggcgggcggcgggggcggttggggttttagtttttttattttagttttttagttttttcggtagttcgggggcggttttagttttagaaatgtcgtcggttttcggtttcggtttttcggttttgtcgtcgcggtcgttggggttgttgttatcgtcgagtcgggcgtcgtagcggttttttttggggtttatatttgtttcgttagttcgtgttcggagtttttttcgcgggttatataattaggttttcggtcgagtgggcgaagtttagtatatttcgggggcggggggtaggggagggtttttagatgtttttttagtgttttcgaagatatcggaggggagtatttcgcgtagagcgtagttggattttcggggtgcgggtttttttttttgttttgttttttagtatttttggtaattgcgtaaagttgtttgggttgtaatggtggggtgtagggggcgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcggttttagtttggaggagaagtttcgtagttagttgtattagggggatttcgtgtacgttatggagggtaaaggtgaggcgtttttatttcgggtcgttttttgcgttgcgggtcgagcgtacgtggggagggagttgtcggtggttgggttcgtatttcgcgttcgcgttttttattttaggggattcggtgacgaaacgaggtcgagtattgggggggtggggtggggtggtgagggaggagggtaggtagtaaggggggtcgggtatgggtttaggttcggttcgcgtttattattagttttagggtgggtagagttagggggtcggcggatagagggatttggagatggataggcggatcgagggagggcgggagcgtcgcgtttttttttttttcgagtcggtcgcgttttttgcgttgtttgaggtgtcgtcgtttggttggaattgggtttagggcgtttttggggtatcggggtaaggttttttaggttcgaagtttttttaatttcgttttcgtttggggtttgttagtgaggaattggtgatgggggcgcgtcgggtgtttgggacgatgtttttttaggtttggggttcgtagagtcgt

SEQ ID NO: 7430 - DNA, 1009 bp, synthetic construct
  misc_feature 1..1009: note = Description of Artificial Sequence: Synthetic polynucleotide
  source 1..1009: mol_type = other DNA
cgaagtggcgggtcgtggttattttttttatttgttgtattttttggagtttcggggcgtaaatagtcgttgtatttttttttattttcgacgggatgatattatagttttttttttagatagcgcgggtttttgtttcgtttttttttagcgatcgtagcgacgattttgttttagggcgggggagtagttttttaagtcgcgggcgtttattttttcgttcggatttcgggcggtgttggtcggggcgcgcggggaggcggggattagggattttttaggaattagtttgggttgttgtatcgttgttagggtcgttttgcgtttagtcgagtttagggcgtcgtcggttggacgttcgttaatttttattgcgttcggttttcgagcgcgttcggttggattcggcgcgttttttcgttttaggcgtcgttaagttttagtattatgcgtttttttagatgttcgaaagcgtttttttagggtagtttatgtttttttgtgtttttttcgcgacgggtcgggtttattattttatatttttcgggtttttttatgtttattatcgtgtgtttttttagtatttttttttttttttaagttttaatatagtatttttttatatatttttcgcgtcgttttagaggtttttttagttattgtttcgtttttttatttttttagtttttttagttttatcgaggcgcgtttttttagtacgtttttatttttttatttttttttcgcgtttttgtatttttttttcgtatttttgtatttttatttcgagtttttttgtgattaaatatcgcgtttttttaagcgtttttttttcgcgtcgttttaagatttttttttatattttgtatttttttcgtatttatttacgtatttttgcgcgtttttattcggcggtttttttatttttagattcgttttcgcgatttagcgcgcggggtattgggtagggatatttttcgtttttacgcgagtttttcgttgtagacgt

SEQ ID NO: 7431 - DNA, 961 bp, synthetic construct
  misc_feature 1..961: note = Description of Artificial Sequence: Synthetic polynucleotide
  source 1..961: mol_type = other DNA
cgtcgtcgttgtgagcgcgcgaggattcggggttttaagtggtgagaattattcgagggatttttcggatgtttttttttttttttgtttttgagttttgtagtatagcggtgtcggtcgtcggtagggaaggttgtattttttttgcgtcgttaaatcgtgtttattatcgcggtgattgtcgtttaggtcgtatttttgagtcgtattcgcgcgtaggggcgtacgggtacgcgtatagggaggtcgtatatatatatatatatttgtatagggacgagtcgggggtttttgacgttcgtcgtttatttcgtttcggtttggagttttttggtttcgtaggtgtagcgacgtttagttttcgtgcggttagcgcgtcgcgtcggcggattttgtagtttagagagtttagggagtttagggaggggagcggggcgcgggcggggtagtgtcgtataatcgtaggcgcgtttcgcgtcgttttcgtttcgggtttattttttttcgtcgcgttttttttagtttatttacggacgagcggattttcgattttcgcggtagggatattttaagagttttgtttaggtttgcgtcgtttagtatttcgttcgtgtcgggggttcggcggtttcgggcgagagacggaggttacgcgtagggttgggcgtaggggtcgtcgttcgaggattatgggtgggttagcgtttcgtcgggttgttagttggcggggatcgtcggcgtttgtgtcgggtcgcgttcgaggttgcgtcgttcgtgtcgtagcggttaatgcggtagtattcgcgaacgttatcgcggcgggtttcgttggttcgggttgcggcgtgggggcgggggatcggttttgagcggagtttcgcgggaggaggagcggacgggaggttgggagggattcgtaatattacgtaggatcggggtttttaggtgtcggggaaggcga

SEQ ID NO: 7432 - DNA, 961 bp, synthetic construct; identical to SEQ ID NO: 7431
  misc_feature 1..961: note = Description of Artificial Sequence: Synthetic polynucleotide
  source 1..961: mol_type = other DNA

SEQ ID NO: 7433 - DNA, 980 bp, synthetic construct
  misc_feature 1..980: note = Description of Artificial Sequence: Synthetic polynucleotide
  source 1..980: mol_type = other DNA
cgtttttttgtttcgttcggtgtaagttcggggtcgtcggttggggtggggcgcgtagcgcggtaggtaggtagggttattatgtagtttttagttttttggttttttcgtttttcgtttcgcgtttttgggtcgttttcgtttgttcgtattttagagtagttttgattcgtgggggcgcgcggtttcgcggggattttgcgggcgggcgggcggtcgggcgcgcgcggggcgggggcggcgcgcgcgcggggagcgtgtgggtcgggcgggcgcggcggggaaagttgggcgcgcgagtcgaggttgttgtttatttgtagtcgcgtcgtttatttgtcgcggagtgcgcgtttcgcgttttttcggttcgtttcggagttcggtcgttttttttttgttatagcgggtaattgcgtcgatatgcgatacgagtagtttacgcgtttcggaagtatcggaggagttttttcggtttgggcgagttaaggtgattttttcgatgattttttcgttttcgcgggtcgtttgttttcgtattttgtttgtttttttcgcgttcgattttcgttttcgtcgttagggaatcggtagtagtgtatgggtatttgtttgtttgtttgtttcggtatttttattgtatatatttttttttcgtggttttttcgattgtttcgtgcgtacggggggagtttggagtttttttttgtttcggtcgggggtgcgtttgaggatgtgtacgcgcgcgggggatgcgtttggagggtgggagttcgatggaaataggcgatttaaatattttatcgaggatggcggtttttggttcgagatttgtcgttgtcgcgtggttttttcggtagtagtttagatgttaaatagttgttcgtttttagtatgtaagatgtgattttttaatgtgtatttttagcgttgttgtaaatagatcgtcgcgagttcgtgtgtgtttgtttcgtttacgt

SEQ ID NO: 7434 - DNA, 408 bp, synthetic construct
  misc_feature 1..408: note = Description of Artificial Sequence: Synthetic polynucleotide
  source 1..408: mol_type = other DNA
cgcggcgtttttttcgaaatatttgagtataagtagtcgtaagggcgagcgtaggacgcggggcgtggacgtcgggttgggaagagtttcgattaaattcgcgggtggttttgattttttttttcgggaggagttttgcgtagaggtcgtggttcgcgcgggtaagttatttgtggtagtttggtagggtagtttttttcggtaaatagcgatatgttttcggtttttgtcggttttggtttggtagagtcgtttttcgttttttggtttttggtgcgttcgaggcgggagaggagtttcggtcgcgtggattttagtttgcgcggtaattatcgcgttttgattttaggttcggttgtttagggaaggatagtttagggcgcgtttagcgagttttagggggtacgg

SEQ ID NO: 7435 - DNA, 2190 bp, synthetic construct
  misc_feature 1..2190: note = Description of Artificial Sequence: Synthetic polynucleotide
  source 1..2190: mol_type = other DNA
cgggtgtattaatgcggtcgaaaaagatacggatacgtttttttgggatttgagttggttcgtagtttttttaaaggtgttaagtaagcgttagttttttttaggcgttttaggtttagtgttttgtgtcgagggttttcggtgtttttttagatttttcgggatagtttgaaggggttaggagcggcgggatagcgcgggaagagtaggtaaggggagatagtcggattgcgttttagtttttcgtgttaagaatatcgtcgcggaggcgcggttagttttttttggatcggatttttcgtttttagggttaggcggcggagttttagttttgttttttttttagtttcgggcggtttttagagttgagtaagtcgggtggagggagtttgtaaggattttttgagcgcgatgggtaggaggaggggtaagggtaagagggcgcggagtaaagattttgaatttgtcggggtcgcgttttcgggttcgcgtcgttagtatttttttacgcgcgttcggtttcgggttattcgttttcgtcggttttcgttttttttcgtagtcgtagggaagcgagtttgggaggaagaagagggtaggtggggaggcggatgaggggtgggggattttttgacgttattagaaggaggtgtcggggtaggaagtgggttggggaaaggttataaatcgttttcgttttcggttgttttttatcgaggttcgcgggaggttcggagcgcgttaggcggatatttttttcggttttttttcggtagcggcggcggttcggagcgggtttcggggttcgggtgtagcggttagcgggcgtttggcggcgaggattattcggggaagtggttgttttttggttggagtcgcgagacgggcgtttagggcgcggggtcggcggcggcgaacgagaggacggattttggcggtcgggtcgttggtcgcggggagcgcgggtatcgggcgagtaggtcgcgtcgcgtttattatggttagttattgggatatcggggttttgttgtgcgcgttgtttagttgtttgttttttataggtgaggcgcggttgggggtcggggtttgaggcgggttgcgatggggcggtcggagggtagagttttcgaggttagggcggggtgtacgcggggagacgaggttgtagttcggagaagttggttacggcgagaatttgggatattagttgtagcgggtacgtttggggtcgttgcgtttttttttcgagggagcgtttcgaggagtggttggtttggattcgcgagtattagcgtttagatcgggttcgcgttggggttgttcgtttgcgataggatcgttgattttttatttagttgtcgggttggggttttattgtcgaggttttgggtattaggagtagtacgtatcgggatttgtttggtatttagagtttatttttagaggatttggggtaggtacgtagggtttttcggagtcgggagtagaggtttttgaaagtttgttaggttgttcggggttgggttgaggtcgggattttggtgatattgggtattggtcgcgatttcgcgttacgagagtgtaggaggggagtcgatttggaggggattcgtgtttgcgggggagtaggaggattttaggagagggttagcgtcggtattttatgattcgtttgagtttttaagtcggattgtttcggggaacgttcggcgagcgttcgttttttttcgtcgttttcggatcgcggggttttagtgcgttgcgtttagttattcgggtggggtttttgtcgggagtaggcgtggtgcgcggtttagttcgtgtcgcggatattagtgattttgatttataagggtagtttagggtttaaatatcgttaatttattgatttataagtttagtttttaaaattcgagcgaagagagggcgggcgattttgattaaacgatgtggtttgaggaatcgatgaggttcgttcgttatttaagttagttttcgttgggcgtttgggagacgggcggtggaatagttaggggtcgggggttttattagtagttagatcgtcgttattgaggggttaaagtttcgaggaatttgagggttcggattcgtagtttttgtttagtggggttgagtggcggagatttgtgtttcgtttttttgggcgtagagagttagatttcggagcgt

SEQ ID NO: 7436 - DNA, 2190 bp, synthetic construct; identical to SEQ ID NO: 7435
  misc_feature 1..2190: note = Description of Artificial Sequence: Synthetic polynucleotide
  source 1..2190: mol_type = other DNA

SEQ ID NO: 7437 - DNA, 679 bp, synthetic construct
  misc_feature 1..679: note = Description of Artificial Sequence: Synthetic polynucleotide
  source 1..679: mol_type = other DNA
cgtcggtttaggtttcgtgcggtaatttttcggttttgttgtttatttcgttttatcgttttttattttttagtttttgtttagttcggggaagtcgcgtcgtagcgttttagatgttatttatttttttttgcgaggggtttgtgatagtttagggtgttgtgtattttgtgcgattgtttatcgttcggtttatgcggtggtttgagtagtttcgcgtcggtattttacgtatcgaatttcgggattacgtgagtcggcggagggcggggaggtggcgttcgggcgtcggcgtgaattcgcgtttttcggagtttagcgtcgtgtttttaggtttcggttttgattttagggcgtttaggtggaatggtttcgtagttgcgcgttgttttcgcgttttcgttttgtttcgcggaaatcgttttcgatagttaattcgatcgggcgcgcggcgttttcggtcggttttcgttcgatttcgcgtagggtatagatcggggcgtacgcgttattcgtattcggttattcgcgggttaggtcggtcgagcggttgggtttagggggtatttttacgtgcgtagtcgttattcggtttggtcgtttagacgttttcgggggttcgcgtcggttagtttagttcgagtttggcgtcgcgttgcggtcgttgttttttattcgg

SEQ ID NO: 7438 - DNA, 2013 bp, synthetic construct
  misc_feature 1..2013: note = Description of Artificial Sequence: Synthetic polynucleotide
  source 1..2013: mol_type = other DNA
cgttacgtagtttagggcgtttagtttatatcgtcgtatatttattgtcggtttagaggtttggtcgttgagcgttttttggatggcgtggtttgatcgtttttttttttgatttatttttagtttcgagggtcgggttttacggcggcggagagggcgtcgttcgtacggtttcggttgtgttatcgtttcggattgttttcgcgtagcgaggtttttttttcggggttttcgggtggggtcggtcgagtcgggtgcgttatttttttaagttcgggcgagatgagagttgttagcggtagtcgaggttagcgcgggacgtcgttattttagcgttaggtcggagttagtagtcgcggagtcgcggagagcggagggggcggcggggtcgggcgtggcgggttttttcgtcgtttattgcgcgttcgaattttgggtttcgcgagcggcgggcggtattcgttgtaatgcggagaatgtgagaggtagcgtagggcggtggggaggaaggggcgcgggagagggcggcggcgagatagacggagagtagcggggagaacgaggatcgggttgggtaggtgggataaggtagggaggcgtcggagaggtcggattggaagggggggagaagggcggcggcgtcgcggagggggtcggcgtttttcgcgggagtgcgagaagttcgagtcggtatttgggtttaggttcgggttgggagcgcggtcgcggttcggttaggtagggtgcgggagtcgggtcgttcgcggggtttttacggggagtagcggggtatttaaggtcggcgggtttcggaggggtttagggtcgcgtttcgtaggtttcggtcgtttcggtagggggtttttgtgagcgttttaggagggcgagtcgggagtgcggagtcgggtgtgcgcgtttgggtgtgcgcgtgtgtgcgcgagtgtgggcgtcgggtagtgggggcgcgcggtagagattttgtcggtatcgtatcgtggcgagtaggaggtaggagcgggacgcgtaggggagtcgggattttttcgcgtatacgtatatgtatacgttgcgcgtttttacgcgtatatatacgttttttttgtcgcgttcgtcgtcgcggttattatcgcggagtcgagttttgcggagcgggaatcgaggtcggagcggggatcggaggtagtcgagtcgggggatgtcggttcggagcggagtcgcgcgcggacggcgcgttcgggacggtgagtgtggtcgggtcgggacgttgtagcggggttagggtcgtaggggcgtaggtcggggagtcggtgtgtttgttcgtcggcggcgcggcgcgcgcggtttttgattgggcgggagtttcgggggtagcggcgggggtggggtgttgggtgcgcgttcgtggggggcgtgtacgtttggggttgggagggggcgtgttcggtagtttaggtcgcggtttcgttttatttttatttgtagttgtagtttcgacgatttgtagtaagtttgtggagtttttggggcgcggcgggtcgggaggggtggggacggaggcgttttgagggtgtaatttcggtttttttttttagagaagagaacgcgaggggagtggggcgggggcgcgggtcgggtcgtttggcgggcggaggggtgcgtttttagttttttagtcgcgtagtcgttcgttttttgggatatttatttaggttcgcggcgtcgcgttggagtcgtttcgggcgttagattattatgatttcgttagggttaggtaggatcgcgcggggatagtttttaggtttagggtttgggatgtttttgtaggtaggaggaagatattaaggtttagttgggggagtgcggcgacgtgttcgggcgtgtatgtgtgtgttttcgcgttttttgttttttaggacggtggttggaagaagggaatttgtcgtaaggcgcgttttattcgatttggatttttaggagtttttaagaggtcgggggcgtttttaggtttgtcgg

SEQ ID NO: 7439 - DNA, 1501 bp, synthetic construct
  misc_feature 1..1501: note = Description of Artificial Sequence: Synthetic polynucleotide
  source 1..1501: mol_type = other DNA
cgtggtttttcgtttggtttttcgtatttattaggaggaggttgtgcgttattaggtattcgagtcgcgggttgtttcggatgtcgggggttaggcgttcggtggcgtagtcgtgttaggttattacgtaggggttgtcgatggtgatttagtatttgatttgatcgtcgaagtggcggaagtagagtttcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcgtttacgagatggagaagcggtagtgagtgatttcgagttcgcgtagcgttttcgtgtcgcggaagacgttgttgtagttgtcgttggttacgttttcggtggcgggttgtagcggcgacggggcgtttaacggtagattggcgtttcgggagtttttcgggggtgttagggggtggtgggtgaacgtattttagatggacgtatttttgtcgtgttgttgttagtcgttttcggtttggtaggcggcgttgtttacggtttagaggaagtcgtcggggaaggtgttttggaagaggttcgcggtttcgggggtaggaggtcgcgagaaacgggtttaggtttgcgcgtcgtcgttcggtttcgtacgtaggcggcggtcgtttaggtttagtagtattagtagtagcgatagcgacggcggcggcggtcgcgggcggcgcggcggggcgttggcgggtatgttgcgcgggagttaggtttcggggtttcgcgtcgcgtttttttatgttcgcgtttcgtcgcgttcgttcgtttatcgtcggcgcgtttattttcgtttttcggcgggtttcgttggtaataattatttgcgagtcgggattgttttcgttttggtattgggggcgggggtaggggcgtcgagggcgaggggtgttcgggaggggcgcggtagcgggtaaggtgcggtaggcgtcgttcgcggacgtcggagaaaggtatttgttttttttagttttcgggagtcgtgtaggacgtttcgtggacgtttaggtttattttttttgtttgtcgcgcgttttttgagagtagttttggagcggtttcgtcggggagaaaaggcgtcgattaatttttttcgatttgggggcgggattttgtcgggttttagcggagcgcgtcgttggggaagtatttgtttttattttttttttattcggaggtttaaagaagtttcggttggatattgttggagttaattagggattggtcgaaattttagagggattgttaggtgggatagtcgagggggaatttcgtcgtgcgttgaaagggatttttttttaggtgagatgttcgcggggagacgcgtttattcgcgtttttttttcga

SEQ ID NO: 7440 - DNA, 668 bp, synthetic construct
  misc_feature 1..668: note = Description of Artificial Sequence: Synthetic polynucleotide
  source 1..668: mol_type = other DNA
cgaggttgttgcggtgggaagagggcgttgggagggaggaggatttggggcgtagtcgtggtgggtgcgttttgttaagaagggcgggggcgacggggcgcgtacgtggaggaggaggaggaggagggagacgggagggcgtgtgagcgagtgagataagaaaagggagcgcgttcgtcgtcgtcgtcgtcgtcgtttttttttggagagagaggttggagtgaggttgtgcgaagcgtcgtattttaatgaggacgggtcgaggtatatttttgtattagtggtcgtaatcgaggcgtcgcgttttagtagttgttgtcgtttagttcggtttcgtcgtcgttttttagttttgtagtttcgtagtttcggtcgcgtttagttcggcgaggatagtattaggaggcggtttttagcgcggttataaagattttcggcggcgttttttcgcggatcggtgcgtggtttgttttttttggggacgggagttgcggggagggcggtcgggggatttcgtagagttcgtttcgttcgtagtcgcggggcgtcgagggtagggcgggcgtttagtttggtttcgtcgtttcgttcgtagtttttcgaaaggcggtcgttttgttttggttagtttggttcgattcgggggcgttgcgtgcgggcggtttcgg

SEQ ID NO: 7441 - DNA, 1006 bp, synthetic construct
  misc_feature 1..1006: note = Description of Artificial Sequence: Synthetic polynucleotide
  source 1..1006: mol_type = other DNA
cgttatagtcgtagagtttttatttcgagttcgcgtttttttggtcgcgtcgtgttattttgtttatttattgggcgatttgggtacgagtatcgcgatttttcgtttcgcgtagttttttagtatcgtggttttagtatatttgtagagtagttaggcgtaggaatcgaaattcgtcgggtggtgggcgggaagggaaaggtagatgtttaagtgaaggcgtttatttttttttttacgtgaatagaagttgatttttaattttaagtgagaaatgatagggagaaaaagtatgtaattattattagaaaaggtgagaggttagtgttgttttttagcgaagggacggggtgagatttaaatttatcgttcggttaggggagttcgtttttagagtatcgagaagttggggtgcgtgggcggagagagagtagggtgcgttcgatagttttgcgttaggttgtttttaaatttaatatttttttttttttttttggagttattttttttttcggaatatgtaagttttgggtggtttagttttgtcgttagatttagtttttaagtgcgggggaaggagatgggcgtttttagtcgcgattttttgggaaggtggttatttatttgcgttttgaaatagaagaatagggcgacgttgtagataatttggtttagttttagttttaggagggttacgaatatggagcgggaggcggtagggggttggtgcggcgtaggcggcggcggggcgtgtagggggttttcgtgcggggtttcggggtcgtcgtttatttttttcgagttacgtaggtatttggtgtagtttttgttggcgcggcgtatggcgttcggttttttcgtttcggagtttttttttttttttcgtttttttttttttttgtttgcggttaatttcggaggttgcggcggagtttcgacgtggggcgtcgatttggagttcggttttgggttttggggcgcgcgggcgagcgggtagggcgttcgg

SEQ ID NO: 7442 - DNA, 867 bp, synthetic construct
  misc_feature 1..867: note = Description of Artificial Sequence: Synthetic polynucleotide
  source 1..867: mol_type = other DNA
cggaagtaaagttcgtagtgaggtgggttggaagcgggttttgtagtagtcgcgagttcgggtttaggtttttaggcgcggttggagtagaagtgtagggatcgttacgatttatcgtcgcggtcggtttcgtttcgttagaggagatttcgtacgcgtagtcgattggttcgggttgatcgaggggatttagacgttgttattttttttttttaaggtagttttcgtggttttgtatgtaggaagtgtttcgattaatttttttttcggttttcgtagagattttaaattttgcggtttttatttttcgttgtatttttttttcgtttttttttttaatgtttttgttagtaaaagtttttatttgtagtatcgggtatgttgttcgtttaacgcgtttcggggatttgttggttcgtgtttttaatttaggggtggttatacgtttcgcgtttttgtttttgggtagatttttttatttgtgtattttggtttttttatttagtaaagagatgtgcgaagtgtgcgtttggagacgagtcgtttcggtgatttttattcgttcgtagcggtggttttggtttttcggattcgcgttcgcgttttgcgggtttttcgcgtcgtttttgttcgtcggattattcgggtttagagggtcgttcgtttttagcgtttgcgagcgtcgttttcgttcgggtttggggagcgttagcgcgttttttttacgtcggattttgtagagtatgtttagtgtattttatggaattcggtttttttggggttaggattagattttcgggttttcgttgttgtcgagggggcgcggaggaggggaggttgggagatagttagcgttttgtttcgcgt

SEQ ID NO: 7443 - DNA, 1072 bp, synthetic construct
  misc_feature 1..1072: note = Description of Artificial Sequence: Synthetic polynucleotide
  source 1..1072: mol_type = other DNA
cgcggagaagattgtttggtttcgtcggtttcgttaacgtgacggttagtttcgtcgagcgttcgtattcgtttatatttatgattattcgtatattcgttttaatacgtgttaaggcgcgatcgcggggtttttggtagttttcgttgtatttttttttttataggggtatttatagttgttatttgtatagggggtaatttttttcgatttagttgtggtcgtcgttttttttagttttttttggtttttcgtatttttcggtttgggttcgcgtcggtcggttttttttttttttttcggttttttttttcgtcgtttttattatatttttttttggttagtggcgtacgtcgggggacgagttagagggagcgggtcgcgggggtgtgtatgtatttttcgttttttttttgtagcgtatattgtatatggtagtgagggggcgagtaaaggtggtatcggtttttcggttgttttagcgaaggcggcggttgtagtttttgcgttgtttttcgttttttagcgtagcggcgattatcgcgttgggatttcgtcgacgttgttttcgcgtcgagttcgtcgtcgtcgcggtttttaattagtatttgagaggtttttgtatttttttggtagttttatttttacggtgtttgtagggtttttttttgtattttttttttagatgcggcgtataatcgttattagttggaattttttattatcgatattttttggggtttttgggggaaggggggggcgggtagtaatcgcgtcgttttatgtttgtggtttgttttggtagttcggtggttttaaaaaaaatttcgagaaagttgcgtttttttttcgggcgtcgaggaggtggtaacgcggtaagtaatatcgggtttttgagatagttgtttcggagcgggtgtagggtttagtttagtgtatttgtttattgtcgcgtttttggtgcgagttaagttgtagtagatatgatgggttcggggcgaagcgggcgttcggtggtcgatagatggtagtcgagggcgaaggcgtttttgggttagggcggcgtaatcgg

SEQ ID NO: 7444 - DNA, 1633 bp, synthetic construct
  misc_feature 1..1633: note = Description of Artificial Sequence: Synthetic polynucleotide
  source 1..1633: mol_type = other DNA
cgatacgttttatttatagagttttagagaagttcggattcggttggagttaagagtcggaaaataagtatttagattgtcgcgtaagttgtcggagattaagtgttatatatattggcgtcgagagaaagggtgggcgtttttaagtttttggtggagtaatgttagtggtcgggtatgcgggggatacggggttttcgaattcggattcgaatttttagttgagttattcgttaaagttggttgttcgttggtagacgaggtcggttttagatcgggtggtagggtgttttcgggttttgagtggttaatagtaattggggaagtattgaggaattttaacgggaaagttcgttttatatttgaaataggtagttcgtgaagtttttaaattagttttgaaacgtcggcgtttagaggttaggttttcggcgagggttttttttagttttgttcgttttcggttcgagcgtcgggcgttttgtcgttcgaaggacggataggggagagaggggttgggggagtttttcgcgtttttttatcgtttttgtcggcgtaagggcgggagtggagaaggcgttatttagattgtggcgttgggtaaattgcggtcgtagtttttttaagtttgttcgaattagaacgcggagtgagcgttcggttcggtttttcgtttgcgttttgtagtcgtttcggagtgattcgggttttttggttagtcgggtttgagttattaattaaggggtagaagggcgcgagagtagcgggaggcgggagttagggtgttttcgcgtgtgtatataatgaggcggcggagacgtatattttttttcgtcgaagaagtcgtaggagtattcgtcgtttaatacggagacgcggagttttatagcggtggtagaaagtgagtattaatttagtaatagggggaaggaaggggacgtcgggcggttagtgggacgtgcggtagtcgagggttgtagtttgtttttgtagcgcgttcgcgtttatttgcgattttttggtaggggatgttcgttaggttgaattttttggtatcgtacgtttggcggattttttcgtagtttcgagtttttatattcgtttcggcggggagggagagtagtagttttaagaggggaagaattatagtttcgatttaagaaggtatggtgtaatatataaatttagttcggtaaattttacggtcggtgcgttttttattttgttttttaagtcgaaagttcgttagaggtagcggcgcgtttttcgtcgttgtttagcgttatttttttttgttagtcgaggggacgagtagcgtagttttttggattgcgtttagtaaatttttataagttagatggacgatggtaagttaataagggttggttgggaaggttgttgttttgtttttttagtttttagatggaaacggtgtaattaaaacgaggaagagaaggaaaagaagtgtttaaaaaattattatgggggtttagagttgtaattcgagtttcgagtcgtagaattttggagcgttgcgggttcggttcgtcggagtgtgcggtaaaggtgggagcgcgcgtcggttttttcgggagggagatggataagcgagagcgagtgtgtatgcgcgcgt

SEQ ID NO: 7445 - DNA, 1143 bp, synthetic construct
  misc_feature 1..1143: note = Description of Artificial Sequence: Synthetic polynucleotide
  source 1..1143: mol_type = other DNA
cggtatcgtgtatagtttgattttacgttcgtacgttgggttttcggttttttggtagtgtatttaagtgtatttcgcgtgtgttcggcggattttcgtgtatatcgtcgtcgtgttgttgagtacgaaagattttcgagaggagttcgtagatgagagtttagttgttgttgtgagattgattgcgggtggtagtcggtaagaaggaattgttagtatcgattttggcgttttttattaattgcggcgtagttttttttgcggtgttcgtttttcggtattattgtagtttttgtagtaaagttaattttaaaaatttaaataaaataataattttttaaaggttcgaaaatttcggtttttattttttttttagtttgttcggcggcggcggcgtttagtgagtgatacggcgagcgtgagtcgcggttttagtcgggtcgagcgcgttgtttgagttgagtcgtcgtaggtgaggggttcgcgttttcgttcgttttgggcgtcgcgtttggtattgattttgtcggtcgtttattgtcgtcgtcgtcgtcgttcgcgggtattatgatagttttgagcgttggggttataggttggttatcgtcgtcggtgttcgggaggttgcggcgcggtcggtttcgtgttttgcgttcgaggttcgcgatgcgcgttcgttagttttttggtcggttcgggttaggacggtttaggggcgttggggttgcgagaggggttgttagaggggttgcgggcgggggtttcgcgcgggggaggggtggggaggggcgtttttattcgagagcggggcggtggggtttttgtcggtttggtcggggcgcgggagtcgcgatgcgttttttttatttttgcgcgtgggtgtcgggggcgtttgtcgcgggatgtttttgggttggtttgggaagtttagggtcggcgatatttcgggtttgtttcgtttgggtatttagtaggtgttggggggtaggtggttgaggacgaggttattgggtattattatagcgttgtatttgttttttcggtattagggtcgttgtttgggtaaatttttgggttaacgcgcgggtggggaggtgggggtgggtagtttggttttagtaggttttcgcgggggtttcgcgg

SEQ ID NO: 7446 - DNA, 1143 bp, synthetic construct; identical to SEQ ID NO: 7445
  misc_feature 1..1143: note = Description of Artificial Sequence: Synthetic polynucleotide
  source 1..1143: mol_type = other DNA

SEQ ID NO: 7447 - DNA, 1371 bp, synthetic construct
  misc_feature 1..1371: note = Description of Artificial Sequence: Synthetic polynucleotide
  source 1..1371: mol_type = other DNA
cgttttttttacggcgttcgtttagttcggtggttttaattttttgcgggagttgtatacgtttcggaaatttgggatagaaattgagttttttttttttttggtggtggtgatagtatttgtttagatttggtcggacgtcgtcggtcggagtatttagttcggcggagaaggagttcgttcggcgttggggattgggatttggagtttttttttttatcgtacgtacgtttcgtttcgcgtacgttcgttcgttcgttcgtgtttggcgtagttttatttcggatggtttttgttttttcgcgggttcgagggcgttggaaatttagcggcggcgaagcggagaggagtttcgcgcgttttcgttcgtacggttttaggtttggggtttgcgttggagtcgcgcggggagaggtcgtttttgcgatcgtcgcgttcgttttcgatcgttcgggttcgcggttagttcggttattagttatgggttttggttcgttttcgttgtttttggtgttgtcgtcgtcgcggttgttgttgttgttgttgttgtttttgttgttaggtacgcgtataggcgttagggtttcggagggacgggcgttcgagaaggggcgcggggttcggaggggttgtcggcgagaatatcgcgcgggcgagcggagagggttggcgtcgtcgtcggggattcggaattcgcgtagattggttttagttcggcggcgatttgggtggggtggttttttttttttcggtttattttttatttttagttattattaaatttgggagttattgagcgggcgttggtacgcgtcgggtgatggggaggtcgagatcgggtttttcgttttgggcgtaggagttggggattcgcgttttcgcgttgttcgtcgttttgtttcgcgtattggtttttaaattggcgcgtttaagtttttcgttttatcgtttgtatttcgtttatttttttatttgacggagatggttgaagatttggttaaggttatttcgggaagaggggagtcgtttcgggattggggttggagttggagcgttagtttttttttcggttgtagttttttagcgtttttggttgcgtcgttgagggattttttatcgggagagcgttttttgtttttttttcgttttttagaggagtttgttgggggaagtcggttttggttcgtcgttgggaggtttttgggtgtttgggagggttggtgggtagcgagagtcggggatcgggtaaggttgtagggaatttttggagggtttaggtcggcggtttgtcgtgcggttgtgagtttagagcgtttttcgttttcggtgtcgaggtttgtattatttagaacgttatacgtttttaatcga

SEQ ID NO: 7448 - DNA, 1545 bp, synthetic construct
  misc_feature 1..1545: note = Description of Artificial Sequence: Synthetic polynucleotide
  source 1..1545: mol_type = other DNA
cgcgttgtgagagttaggttatttaaatgttacgtttttcgtatcgtcggcgaggggataaatgattattttgatggattcggtagtttaaggaaattatcgttttcggagggatggcggtagagtaggtcgggtatgttgtatttgtttgagttggatcgcgtgtgagcgagtttacgtttttcgcgggttaggtttagttttcgtgttttttgataggtgaagttgagtatttttattaaattttcgggaagaataacgattttattttatattaacgtgattggaaattttaatttaagaattggatgtatcggtcggtttatttggggtttgtttagttttttattttatttcgcgtttttgatgtgttaggttttttgtatagatagtttatatatttaatttttaaaatatcgttttttgaagcgatgtttaattaggaaaatttgttttaaattgtatgattatttttcgtggttttttttttcgaatttttgttttgtttattaggtgcggtttcgtttcgtattcgtatatatttttttcgtcgttgttttgagcgtagcgataagggtttttatattttcgcggttcgtaatgtttcggggttaagtcgaggtagggaggcgttttcgtagtttttgattttataattcgcgcgcgtgtgtatcgagtcgcgggtatatcgcgaatatatatatatatatatatattcgtgcgttttcgtttttcgttcggttcgggtttttcgaatttattttcgaggcgtttcgggcgtagggttcgtttttttttgcgggtttttagcggttgttcggtagtggttcgtacggttttcgatgtcgcgttttcggtaggttttagagttagttggttattgttattcggtagttcggatttcgcgtttagggttgtatttcgcggatggagcgattttcgttttcgtcgttcgagtttaggtttgcgtttatacgcgcggcgtttatacgcgcggcgtttatttggttgtagtttcggttagggttagcgcgtcgcggttgaagggggcgttcggatttttttggggcggcgcgtagtcgggatagtttcgtatgacgttcgcgttttagcggtttcgggacgcggttttatttttaatttttggcggttttagtttcggtttttgtgtttcggtcggcgtcgttacgttatgggtttgtaggttgggagtagcgcgggtcgggaacgcggttggggagagttgggttgggtttttttatcgtcgttcgttcggggcgtttaagttggcggggcgtacgggtagtaattgagcgtattttgggggatcgagggggcggtttcggggaggggcgcggcgtcgcgttaagggggtgttttgttagaggttgcggcggaggaaagtgggagttagagcgtcgtcggagtttcgggaaggcggtgttcgttcggttttaggtcgcggttgtagcgtcgaggggaaagcgagcggaagttgcgcgttggagggagtttattattcggagttattcgcggggttcgcgt

SEQ ID NO: 7449 - DNA, 1545 bp, synthetic construct; identical to SEQ ID NO: 7448
  misc_feature 1..1545: note = Description of Artificial Sequence: Synthetic polynucleotide
  source 1..1545: mol_type = other DNA

SEQ ID NO: 7450 - DNA, 1027 bp, synthetic construct
  misc_feature 1..1027: note = Description of Artificial Sequence: Synthetic polynucleotide
  source 1..1027: mol_type = other DNA
cggtgcgtgtataggggcgtttcgggaggggtggtgatcggtagtcggttttttatttttcgcgtttattttttcgtttttgttttttttttagttggtggcgggtagtgtggtgatggtttttgaggaggtttgttcggagcgtatcgatttgatttataaaaattatcggaaattttgtaatttgttgatcgacgtggaggagtggggttaggtggttattattagtatgtttattcgttacgttcgtacgtagtttttgagttttatttagaacgtaagtgggtttagtttaggtagagcgggtcgaagtgtgtttcggggaggcgtttatagattcgtcggttttttcgtttaggaatttttattagaggagaacgcggaaaaagttttttacggtttagaggaggacgaggttaagggcgcggggtttgaggagacggtcgtcgcggtcgttttttttcgaaagttttatgttatggatttcgattatcggttgttgttgcgtaatattaaatttttgttgtagagtcgtagcgtcgcggtggtgatggcggtggcgtagttttatttttatttggcgtttaaggcggaagtgggcgttatcgttaaggcgttggtgcgtttgttgcgtagttataggtgcgtttcgtttttagtttcgttttttttttcgttttttgtttcgttttacgggttgttcggtttcgtttttttacgtttattagtcgtttttatttttgtttattcgttttatattgatcgtagttttgtttttcgtattggtttttttttcgtaacgatttgttttattttttttttttattcgttgatttttgttttaatcgaggggttcggggtgttttgattcgtttttttcgtagtgaggtgtagtacgttgtgttttagaacgtggttattatgtttattaagcgtcgggtgagtttgcgacggcgggttgttttcgttgttcgagggtcgtttttgcgggtattggaggcgttgtcggggttgggatcggggtcgg

SEQ ID NO: 7451 - DNA, 693 bp, synthetic construct
  misc_feature 1..693: note = Description of Artificial Sequence: Synthetic polynucleotide
  source 1..693: mol_type = other DNA
cggattcgttttatttgaggatttcgggtttatataggcgatcgtttcggttttagattggaagcgatattttagggattaaagtttttagttcgcgttcggttttagtttttgttttcgttttagagtcgtagcgagtagggttttgcggtatcgtttagagattggtttaggaggttttagtttttagcgttagtatatatttatcggttgtagtagttttattagttttgttttttttttcgggtttcggttatattaagagtttcggaaacgtcgagaattttgcgggtttagaacgttcgcgcggacgttttttttacggcgtcggaagtcggcgtcgagtttgttatcgggtatttttttgttgttttgacgacggcgggcgttgtaagagtggagaagttgtaggtgttgaggcgcggtgaaagaaattttgggagttaagagtacgaggagttggtgtttgtgttatatttgtatttgcgggtaagaaatcgttggtgtagcggcgggttagggtttgggagtcgatttagggtttaggtgtacggagcgggtttttcgggaattttgagagtggtcgtttttcggagatgaagggacgagggcgtagcgattttcgtatttatttcgttttacgaatattcgtttcgtattcgtcggttattcggggataaaacgtttgttcgt

SEQ ID NO: 7452 - DNA, 1496 bp, synthetic construct
  misc_feature 1..1496: note = Description of Artificial Sequence: Synthetic polynucleotide
  source 1..1496: mol_type = other DNA
cgttttcgaattcggagaaagtagttcgttcgtttttttattcggtagttagtttagtttattcgagagttgagttcgagaagtcggtttttgacggtgttggcgtggcgtttgttaaaatatgttttttgtattttaatttttttcggttattttttttgtacgtatagttcgttcggggttatttcggttttttagcgtagttttttcgatttttgtttttttttttttcgatttatgtttgtttaaggtcgaatgtaaaatttatttttaagaaagcgtagcgggtacggggggtatttagcgtgttatgtttcgtagtttttttttagttaagattagagttttagattttagattacggaaatgagtgttatttagattaaggattgcgcgtttgcggtttcggttttcggttttgggtgtttttttggggtgtttgtgcgtttcggtatttttcgtcgtcgttcgtgagtttgcgttttttatttatttaggtttgggagcgttttttatttaaggtttgggagtattttttaattattttcgttacgtttattttattttttatcgcggttcggattgtagtaaaatcgggtagcgcgagggttaaaaagtggaaaggagagcgttttttcgtgtcgtgtagttagttcgttaattttttttttttagtttcgattttcgtaattttaaatgtaatttttttttttcggtttcggtttttttcgggttgcggttagcgggcgtcgcgttgcgaggcgtggagcgggcgggttgtcgcgaggttgcgggtggcggtgtcggttatagtcgcgagttggcgagtgggtgggtgggtgggtggggaggagggagaggataggcggggagagagacgggtgtggggaggggagggagggggagatttcgtttttttgtcgtttttagttcgggcggggggcggggggaggaggtcgcgatgagggaggggaggagggagggaggaagggagggagggagtcgaggaagacgtttcgataattcgtgcgtttcgtaaggttcggagtatttgtatatttttgtagtcgcgcggcgagttattcgcggcggttgttgtagtttttattgtatttttttttttttttttttttcgggtttcgggtgtgtgtatgtgtgagagtgagtgtgtgtgttttgtaggtgcgtggtgtgttcgttttaattttgtttagtaggtgggatttggtgattttagtattattttttttttttttttttttttttttgtttttttatcgtttgttgtaattttgtaaagtttcggagtcggagagcgcgtttcgtttttagagttttcggattcggcgagttagcgatcgtcgagtcggttattatgttcggtagatcgcgttattaggcgtttttcgcggtttttattcggcggcggcggcggcggcggcggcgttcgcgatggttttagacgttgaaggattttgtatttgatcgttcggcgt

SEQ ID NO: 7453 - DNA, 5820 bp, synthetic construct; identical to SEQ ID NO: 7206
  misc_feature 1..5820: note = Description of Artificial Sequence: Synthetic polynucleotide
  source 1..5820: mol_type = other DNA

SEQ ID NO: 7454 - DNA, 699 bp, synthetic construct
  misc_feature 1..699: note = Description of Artificial Sequence: Synthetic polynucleotide
  source 1..699: mol_type = other DNA
cgtcgcggtttttaaaggtcgttgttgtgggtgcgtatattcgggttggagaaatttcggcggttttgtatcgcgcggtttcgtttgggttttggagggcgtattcgtttcgtttgggttgtttcgcggtttatggttaagcgttttttgtttagttcggaatcgggcgttcgagttagcgaataggtcggttcgttttagttggtcgagttcgattcgtcgcgcgttcgggttaggcgagcgcggcgcggcggattagttttgagttcgtagtttcgagggcgcggggcgggcgcgtttggggtatgagggcggggcgggcggcggtcgcgtttttaatttcggcgttgcgtgtgggagcggtcggattagggaattagcgttgtaatttcggattagtaacgttcgttaaatgagtgtttaatttcgattttttatgttttttagcgtcgcggttgagttttaggaggttttttggttaggtttttttcgcgttttggttttatttttcgggaggttcggtcgcggtcggtagagaatttttcggtttgtggagattcggttttaggtcgcgtcgtagttttttttcggtagcgtattttattggttcgggtagaggtttatgtagttttatagcgttcggagttgggagttcgtggattagagaaaaggaagtttcggatgtttcgtttattacgg

SEQ ID NO: 7455 - DNA, 1845 bp, synthetic construct
  misc_feature 1..1845: note = Description of Artificial Sequence: Synthetic polynucleotide
  source 1..1845: mol_type = other DNA
cgtacgcggcgcgggattcgagaagagcgtttggtagagtataaattttatagaagaagagattttttgttttttttgagattttattttttttttgtttagggttaggaagtttttttcgggtttttttagaatttcggttgtttttttatttgtcgtttatcgttttttggaggtttcggagaggggttcggttcggcgagtcgaaggttgcggggcggggcgcgagttttagtttttgggatatatagtcggtgcgtttcgcgttttaagtgcgtattttaggaagttcggagtcgggaggattcgggttcgcggttttattttatttttggcgaggtcgggagaaaaaaagcgttagatcgttcgtttgagggtttagaagtttatcgggcggcggtatagattttttcgaaatgttttcgttttcgcgttgcgagcgtataggaatttagggtcgtcggggttgtcgtggtttggttgaacgtttaaagttaggcgagggcggggggttttagtttagttatgcgagtttttttttagtggtgttagtttttacgtcgggttttcgggtcggcgggaggcgcgtgtgtttgtttgtgtgtgtaggggatatttcgttttttagtagtttatgtagaatttcgtttttcgtttcggttttaggaattttttttttagtttagagatttttgcgcgttttttgtttattttgttaaggcgagaaagcggtcgtgttggagataaagaaatttttgtttttttttattttcggttttttcgttcgttcgagatatttttcggcgttttttttcgatttcggcgatattgcgtttggatacgttaggtaggggggtagggtgggcgagttcgtttttcgacgcgggttagttgggggtttttcgtgaatttcgttcggggatattttatagtagtcgcgtttttatttttttttttttaaatcgtttcgggtttttgtcgtcgttattttttgttaaatcgtttttatttttttagcggagttatagcggggcgcggcgtatataaagggggtcggagggtggagagtatagaaggagggagagatttcgttagggttcgtggtacgggtttgggagtagttatttattcgatttttttttcgatttttgagatgtttgcgaagatgaggaagattacgagtagcgtgagcgcggttagtatttagtttcggaattgtagttgtatggtgggttcgcgttcgtcgggatttacgcgggtcggcgcgaggagtaggggtcggagggcgtagcggcggacgtcggagttttcgcgcgtcgcgcgtagttgggtagatattttgcgtttcggacgagttcgggtcggcggcggtagcggtagcggtagcggtagcgataggtaggggttgtttaggcgcggcgagttcgttcgttttttttcggttttcgtttgtttttttttttttttttttttttttttcgttttgcgttcggtttcgcgcgtagtttgatagttttgtttcgcgtttttgttcgtttttttttattaattttagcgtttaggcgttagtttttgtttttttcgtttggttttatttagttttcgagggcgcggggatgtagtcggacgttatttttggtttagagagattgggttttggttatcgcgagcgatcgggtacggagttgagtttagggaagtgcgcgtatcgttcggcgtattttttaggttggtaaacgttttttttcgttcgttttttgtttagttttttcgttttttcgtaaagttttttcgatataaagattaatatttggggatagtttttagcgcgcggcgagaaggcgg

SEQ ID NO: 7456 - DNA, 1844 bp, synthetic construct
  misc_feature 1..1844: note = Description of Artificial Sequence: Synthetic polynucleotide
  source 1..1844: mol_type = other DNA
cgattagagattcggcgtacggagcggagtttttggtttttatttgtattaatttagttcgcggtcgtagtttttgttaaagaagtggggtttcgtgtttaaggttcgtacgttcgggtgtattcggataaattttagtacggttcgggtgttttttttttttacgtttataatgagggtttggggtaatcgtttggtatttagtttgggtgagtcggagtggttggaatcggagaggcgaggggcgggtacggcggcggcgggcgcgttgggagcgttgggttcgttgggcgtcggttcggagggattataggggcgggatttttggagaagtttttggtcgttcgcgttggggtcgcggaggtagcgaggcgcgtcgaggaggcggtttcgatttaggtcgtcgtagtagtataggaagttgtaatataggtaagtgtaggagagcgagagcgtgaaggcgaagagtagtttgcgcgtttttcgcggttgaggtggtttcgcgcggtttaggattttataggttatggttttatgggttcgcgtcgggggttatggttttcgagggggtatcggcggttgagttgttgtggttttgcggtcgtttagagggttcgcgtggcgttgttacggttacgcgggtcgggcgttgggggcgtcgtttttttcgggggttgttgattagggtgcgtatagtgttagggggtttcgggggtagcggtttttcggggaataggcggttgtatttttagtatttttcggttttaggcgatggggtttcgggtagtcgggcggttcgggcgtttttaggtttttacgtgcgtcgggttcggagcgcgtttagcgttcgaagttttatttttgattttcggagcgtcgtttacgaaacgttcggcggcggcgcggttgtgcgggttggcgggtggatcggacggtggcgttggcgtcggtcgcgatttggtttttcgggaaatgtcgagcggagcgcgttgtcggttttatttaaggagtggtttgacgttagtcgcgcgggtttttcgagttcgcgtcgcgtttagggatttggttcgttttttgcgtttttatttttttattttttttagaaatatagtacgcgggttttttttatgtaggttattttttacggagttttaggttagttttggggcggtgaaacgaaggtgttaaggtatagtattttttcgggaggttggatatttttattacgttggtttttcgatatttagggatacgaatttaggtcgagatcgcgtcgatatgtagattagatagatttagacgtagacgtaggtattttgttttgatgcgcggttttattattttgattcgtatacgtacgtataggtatagaagtatacgcgttttagttcggatatatttttatatttacgcgggggtggggaggagaagttttttaatttgggtttagatatatcgataaggatatttttttcgttttcgatatttcgttaaatggatatatatagttcggaatcggatatcgagcgtacgtacgttttggattgggatacgcgttgtagacgggatgggtggaggagtcgagcgtgagtgagatttcgtgattatttatttagttttttagtttttagcgcgttgatttatatttcggcggttcgttttgtttcgtatttatgaggtacgcgcgtattttaatttattgttattttattttttttcgggtttgtcggagagcgagtttcggagcggtagatttcgcgttaggagggttttttttttagtagtcgtcgtttagcggtagattgtttttcggggagttgtttagggtattagagggtcgtcga

SEQ ID NO: 7457 - DNA, 1480 bp, synthetic construct
  misc_feature 1..1480: note = Description of Artificial Sequence: Synthetic polynucleotide
  source 1..1480: mol_type = other DNA
cgttttcggcgggttttgttgttttacgttcgtcgtggggatttttttttaggagcgttttgtttgggattttttttgcgttttagatttttattttggttcggatttttttcgggggcgtttttttatttttaggttttcgttcgcgttcggcgtggcggtttttttttttcgtgcgggcgggtttcggaatagtgtcgtcggtcgtttgtaggtgtttttttacggaggggcgcgcgtttttgcgtcgtggtcgttgttaggcgttagcggtttttagtcgaggtgtattcgcgtttcgggtttcgggcgcgtcgtagtcgtttttttatcgtcgttcgtttcgttagttcgtttcgtacgtttttcgcgtcgcgtttttatttcggggttggggggggtatgggttcgcgtcgcgttcgtcgtcgtcgattttaggtattcgagtttcggggcgcggcgggtagcggtcgttgacgcggggcgttagttgttaatttcgcgcgcggagtttttcggcggtgtagtttcgtttcggcggcgcgggcggtatgaagattagtcgtcgcggtcgagcgtttttggtcgtggttttgaatttgttggcgttgttgttcgttattatcgttttttttattacgtattggtgttagggtacgtagcgggtttttaagtcgggttgcggttagggcgggcgcgttaattgttttaattcgggcgttaacgttacggttaacggtatcgtcgttttcgtcgtcgtcgtcgtcgtcgttatcgtttcggggaacggtttttttggcggcgcgttttatagttgggagatcggcgacgatcgttttttttttaggaatttttatatcggtatttggtattcgtgcgaggaggagtttagcgggtttggtgagtgcgcgcgggcggcggttagttcggtttcggttttttcggggcggcgcggttatcgaggttcgagtttcggattcgttcgtttttttttcgtcgtttgggtttagtttttagcgtttcgtttggttaggggcgacgtttcggggtagggggcgcgcgtcgtttcggggtcggggattagtatggggggacgtgcgggacgtttcgtcgtggagaggtgtaaggtagagtttttattcgttgcggacgtttcgcggttttggggacgttttcgcgtttcgggaaggcgtttattttcgttgtcggtcggaggggcgcgcgttgtttttcgtttttgaatttatttttacgttcgttttttttttttttttttttcgcggggtattagatgtttttatttatttcggaacgtttttgggggtgggggtgatgtagggatttttgttattagtcgttttttttgtcgtagatttatagattcgggagttttttatttttatcgttaatttacgtcgaattttttagacgggagtggggagtgggggagtttcgcgggttttcggaaagtcgtattcgt

SEQ ID NO: 7458 - DNA, 5065 bp, synthetic construct
  misc_feature 1..5065: note = Description of Artificial Sequence: Synthetic polynucleotide
  source 1..5065: mol_type = other DNA
cgttaagcgtttttttcgggtgcggttttttttcgttagtgaggtcgcgatttcggcgtagttgtcgttttatttcgggttatttttattcgttattgcggattagtttttaagtattaggttttttggcggaatttgtaagtttaaatttcgttattcggattttttagtagttttttttttattttatttttatttagagttaggagggtgttatcgtacgtagagcgcgtaggtttttggggtgagtagggcgcgtggagggattttaggagtggtattttattttcgttcgtcgtttattttcgattcgtataaaaataaagaataatttttattttgtttttgtttttattgatgtatttttttgtatcgcggtacgcggagtttcgttagcgttttgatattgtagcgttcgtattagcgaattacggaatttgggatcgagataatggttcgtaattgatgtattgttattaataataaagattaattttttttttttcgttatttcgattatttttttttttttattttttttttttttattttttattttttttttcggggttatcgagggaaagaaaataaataagaaattagcgggggacgttaagcgtagatcgaaacgttcgtttttacgtcgtcgaggacgtaaaaaaacgaaaaaagttattaaagtttggattttttaatttattcgtttttgttcgtttatttttaattaagtatcgcgtagttgtttttcgtatgtttatttcgtttggttgtttgttgtggtgtttttttggggggggggaattttttttttttttatatttaattttaaattatacgtagattaagtaataaatacgtgtgaagttattttcgggagttttttgttgcgtacgcggcgcgtattaggagaaaagttttgcgggatcgttagtttcgttaggtttttggttgtatgcggtgttcgggaggttcggatttttaagaagttaagattgttagagaaggatgcgggcggttttaaatacgggtatatttcgggaaaggagtgtgtaagtgtatataaacgcgttcgtgtatttgggatagtgtggattggtgggtgtgcgaggatttttgtttgtgagatggaggcgggtgcgggatttatacgtgttttcgtatacgtttttcggggtttgggagatgcgagtcgtttatattttaggagtgcgtagatttatttttgtcgagggatttttttaaatatttagtgagaaataatggtatttgaagtattatttatggaaatattattatttttattttttaatattagttttattgatagtttcgtttgtttttttattaaaatttattgtatttattaggatttggcgagaacgggagagcgaggcggagagggtgtgaatgtgtgtgttagggagtgagcgagggtagaagataagtaagagaaaaggtggaaaacggacgagtagggagagagaagggagaagttatattaataaaaaaaaataaagttagtagatgaaaaatagaaatatttatcggtatatatatatatttatattttaaaagaaaagatttaagaagttaagagaaagggaagggttttttatcggagcgtagtataggttcggagtatacgaagtcggttcgggagatcggtgtttatttcgcgcgaatcgatcgtggtatcggttagatttaagggcgttcgcgaattggggcgtttttatgagttttttttttttttgatcgtgagatagggtagggattgtgtatttgtatttttttttttttttattatttagtcgaagtttagtttagtttagtttttcgggcgtaagatttcgagaattttggagcgaggagatttcgaggcgcgaggggaaagagttaggttgagtcgcgtatcgagttttaggttcgcgggcgtttgagttcggtagagggatcgggtttttggttttgggttttggggcgagggtagggaggttgtattttagtttgagggagatggtgatagagcgaaaagttcgggcgtcgcgttcggtaagtgtttaaaaagtggaggcgagtttcggcgtcgttaggtagtttcggatagaatatttttttatcgttttttttttatttcgtttttcggttttgcgtcgttatttcgtttcggaaggttggggcgcggttttttttttagggcggggtgtttaggggttttagggattggtttagtttagtgtcgggttcgttcgggttgtgtttttttaggtcggtgttcgttgttgcgtttagtgtgagtcgtagtttttttttttttttcggtcggagttgaattcggagtttaggtcggttttcgtttttcgttcgttcggggttttgcggcgttatcgttgtcgtcgttttttcgcggagtgacgcgttttgtagttaatcggggtagtcgggggggaggttcgggaggggttttgggcggagtcgggtcgtttttttattttacgggttcggggttgtttttttcgaaaattttagttttaattgttttgggaatgttcgaggtagagaaagggagcgagggagtaagtaagaagttggaggattagtgtttttggcggggaggggatggggtggcgggagaattgtttttttttttagttataaatttattaggtttttaaattttttttggattttttttttcgcgttttcgcgagttcgggatttaggggatggagaattcggggcggaggagcgtcgagttaggcgggagggaggtcgagtcgtgggcgggaggcggatcggcgtggggttggtttttttttattcgtttatttttttttttaatgggggtgggggtgggttgttttttggtagtttttaaagaaacgaagaaatatttacgaaacgggacgtttttttttttgatttcgtcgcgggatttttttttttcgcgggtcggcgcgtttcgttttcgagttgggaagttcgtagcgcgtcggtagttcgggtttttagttttcgtcgttcggttttattttttattcggggcggtttaatttcggggagggtatgttaatttgggtcggtttagttcgggattgtgggggggggcgaaggagggagggaagagggaggggagagggagagagcggggggcgtttgtcggggcgtcgggttcgtagtggagaggaggtcggttttcggcggtcgggtcgcggagtttcgggcggtcgtaaagagggttaatttagtgtcgggcggcgcggcgcgtagagttagtttcgcggtcggtttattgggttagcgcgcggagagataggggtttgtagtaaattacgaattaattgattaaggcgagcgggtttgaatagcgttggttcggtgttaatcgttttttaaagagtttttttatgattaatcgtaatgtattattgataattataattatagtaggatatatgcgcgttgcgttcggggtcggggagtcggggagggggcgggcgggtcggcgggcggggggagtcgtcgtcgtcgtcgtcgttcgattttcgtaattttgagaagatttttttttagtaattttttattttgttttagttgatgtttgagttagtatgtcgcggaggaagtaagcgaagttttaatatttttaattcgatttcgaagtggtttcgttttttcggcgagatggtgagtgtttcggttcgcgtcgtggatatatatatacgtatttatatttacgtatattcggatttatttatacgcggttggttttcgcgttttttattttatcgtcgtcgcggtttcgattgttttttttattcggcgtaattttttttttttttttaatttttaatgtgtttttgttgggttttttttcgttgtttcggggaaagcgagtatatttttcggtaggattttttcggagttgttgggttttttcgggggaaggagggcgggtatgtcggtttggttttttcgtttttgttttttcggggattttagtcgcggttaagattcgggagttttatgaggcgtgggtgcgggtggaggtcgtttcggtttgatcgtacggggtttttagcgttttcggcgtcggttttagggtattcggttcggttttcgtcgttcggttttgttgttagcggtaaggaagtttatttcgggcgttgggttgaatttcgagcgtgggggagttcgttgcgtttttttgtttttacgtatattttttttcggtttgcgaggtagaatcgggtgtttttggaggtttagagttgtaagaagatggggattggtgtcggggcgttagcgtttgattcgttggggttgcggtcggggtggagagtgttgttggtcgttagttgtttcggagacggtgtaaacggacggggaaagtgtcggggtttggttcgtaaaatttattttcgtatttttttttataatatttgtattttttgttttttaaaatttttttggtcggtatgcgttttttgcggatcgtggtgttttttatttttaggggggttagggaagaagttatagaatagttttttaggtttgcgggtggttagttagagtggaattttttttgaaataggggtatttgtttttttcgatggaggcgataattgtgggtttcgaaggggttgaataagtttagaataaagtttgtgtgtgggggttatggtagagagtggaagagattcgggtagggagttggggtataaagggaggatatttggaatttttttttgtttttaaaggtgttttacggtatcggttttaaagtttttaggtttagcgttcgaggcggtgtagcggcgttcggattcgggttttcgggtcgtttcggtacgatgttggtttttcggttgtgggaggacgtataaggagtaatttcggcggggttttagcggtttcggatgttattcgggatgtttacgttttaggcggtattttggggtgtgaaggagggagttgggtttcgatagagtttcgaagcgtgattttgatcggtattttagtttattaagttgcggtcgttcgggtttttaggttttcggttcgt

SEQ ID NO: 7459 - DNA, 2372 bp, synthetic construct
  misc_feature 1..2372: note = Description of Artificial Sequence: Synthetic polynucleotide
  source 1..2372: mol_type = other DNA
cgagggacgtaggatgaaagaagttaagagtgtcgttagggtttgcgttagcgtcgttagattttcgggatgggggagttttagggtacggcgttagcggatttacggagaaggagaaaagttttattgtcgtgtagaagtttaggttcgggtgagacgtttgcgaaggttgttagtagcggaagagaaggggcgtttttcgtgttgcgtagtattcgttcgcggtaggtgggcgcggagtttagagttgggagttaaacgtaaacgttggcgagaagttttagtttttttcggtagtttattcgttgcggggaggggttttttacgtttttagtttttgggagattgtatcggaggtcggaagtaagtcgggcgaggatgaattatttcgtttaatttttttttttcggttttttagttttcgtacgtcggttttttttagagattttgtagtcgcgagcgaagattgttttatttttagattttatcgaattttttgtggtttgcggagacgaggagacggacgggtttggtggttaatgagagtttcgattttttgtttttcgtttaatgggtcgttgtttatgggtcggggcgggattaggagggtaggtaggggcggttcgggttggcgcgcggcgcggcggttacgcggttgcggtttatagagttagcgtttttttgggtgttcgtgttagtgttgcgcgggaaggtattattattatagtcgtcgtcgttggttagggtgttggataagacgggttcgtcggttatttcgttagtttaggtattcgttgtagtcgtcgttgtttttttttagatcggtttttatggaggagatggaagaggagttgaaatgtttcgtgtgcggttttttttatcgggagtttattattttgttttgtttttataatttgtgttaggcgtgcgttcgtaatattttggtgtagattttagagtttgaatttttttagagttatcgggtcgcgggtttcggggttttcgattatgattatttggatttggataagatgagtttatatagcgaggcggatagcggttatggtttttacggggggttcgttagcgtttttattatttcgtgttagaagttttttaacggcgttcgcgtgtttttttcggttatgtcgttatcggttatttatttgttatcggttttggtttcggtgtttcgtaatttttgtattatttgtttttagtgttatcgtagttttattttggatgatcgggggtttcgcggtttttttaagaatcgcgtattggaaggggtaattgatcgttattagtagagtaaagtcgcggtttttaagtgttagttttgcgagaaggcgtttaaggaagttatcgttatgtgcgaatagtgcgatgttttttattgcgattcgtgtcgtttgcgttgttattcgtttcgggggtttttagttaagtatcgtttggtgttttcggtttagggtcgtgtgagtcggaggttgagtttacgtaaggtttttatttgtatagattacgagttggagaattatagtatgtattgcgtgtaatgtaagatgttcgtgtgttattagtgtttggaggagggtaaatattttagttacgaagttaaggttttgggggttatgtggaaattatataaggtgagttttaagaaaatttatttttaattttttgcgttttcgattattcggttttgtagtagacggttttcgttttttgcgtatagcgtattttagtgggggcgtaatgtaggtgttttcgatgtttatttttttggtttggtgtattgtaggaggtatgggggaattttaatcggcgtacgggggagttgaatgtttttatagagttgttgcggggatgttttagagcgggtttttcggggcgcgttgtttgcgagcgggatttagggcgtttttttttcgcggcgggtttgtagttagtggtcgcggttagtgtgtgggaaagtattgtatagttgggtagagtcgcgttagtgtttagggtcgttaggtacgttcgagggtagggcgggttgcgaattttcggggagggattgggatgggggcggtggggtcgcgcggacggcgggagtttgtcgttgttggataggcggatttggtgaggtacggcggagggtcggggagacgtcgtaggcggaatattgatgagttcggttttgggttagatttggttttcgagttggagagaacgcggggttttggtgttacgtgtttaaaagatagagcggagagggtagttagcggtcgttatggtaacgcgacgtgtaggtttgggtttgaattttttcggagttgggatttgagattagagtgttaggatcggagtttgcgtagtcgcgg

SEQ ID NO: 7460 - DNA, 2372 bp, synthetic construct; identical to SEQ ID NO: 7459
  misc_feature 1..2372: note = Description of Artificial Sequence: Synthetic polynucleotide
  source 1..2372: mol_type = other DNA

SEQ ID NO: 7461 - DNA, 2372 bp, synthetic construct; identical to SEQ ID NO: 7459
  misc_feature 1..2372: note = Description of Artificial Sequence: Synthetic polynucleotide
  source 1..2372: mol_type = other DNA

SEQ ID NO: 7462 - DNA, 2142 bp, synthetic construct
  misc_feature 1..2142: note = Description of Artificial Sequence: Synthetic polynucleotide
  source 1..2142: mol_type = other DNA
cgtagttggtttcgaggttgtgcggtttttagttttgcggagtagtttaggttatcgttttcgtggtcgcgggggagggtattttcgacggtcgtagtaatgggtaagagattagggtttttttattttcgcgattcgtttttttttgtttggtaattaagcgggatgttttattttattttttaaacggagcggattatatatagtagtattttatggttttttttgttgcggttttttcgggggaaggtatttttagagggtggttaagttttttttagcggtcggttttcgggagggggatagaatttaggagttagttttttgttttcgtataaaggttcgtttttttttagggcgtttttgggtggagcgaagcggtcgaggggattacgataatgtttttttgtttttcggatcgatggttaggtttttagagttaggagcgttcgggattttagggtagggagtaaagtttatatcgtaatttcgttattcgttcgcgttttgttagtttgttggggttatagcgcgtaggttagtagtcgtattcgtcgttgcggggttttttttgcgttgagtttattttttgtaacgtcgttgttttaaattttgcgggttatttggtttcgggggtggggttttttgggggtcgcggggtagttcggatgagaggatgattcgggagttttttgggggcggagtggaaggggtagttttaggtagttttggttaggagtttttatttcgttagtttcgttgttttagcggtcgttgttttagaaaagttaacgagaattagatgtggtggttattgtcgaatttttttagagtcggtgattggtttttagtcgagggttttagttaattagtttgttgggtgggtttggagtttcgtttcgtttaggcgttcgcggagatttaggttcgaggttggcgcggcgcggagagtgggttggaggtcggggcgggacgcgttgtgtagcgggtaagcgtacggtcgagcgagtatggagggggatcgggtggtcgggcggtcggtgttgtcgtcgttattagtgttattgttgttgtcgttgttaatgttgcgggtcgcggcgttgtatttagacgagttttttttatacggggagtcgtggggggattagtttttgtaggaaggcgacgacgaaagtttagtcgtggtgaagttggcgaattttttgtatttttacgaagttcgatttagtaatttttacgtaagtttagtttttttttggtatttttttcgtagttttttttttggggtcggttttacggaaattttgtttttagaggggaggaaatagattttatttttggagttttttagtatttttgcggtggtattcggttagagagcgatgtcgttgtttgtttcgttgttgtaggggagtaagaatgatttggaggggagagtaagaattgttcgtagttacgtacgcgttttaggtagaaaaggtggcgttgttagggcggttagcgggttttgtagttaggatcgcgagaaggttgtgttcgtttgcggagttggggtgttttttttttagatttggaggtttttttttcgaggatatggggtttcggggttgtgaggggagtgagaagataggtgaacgagttttagggtttttggatttattgtagcgcggagttgggatagtcgtaaaagttgcgtttgtttttttgaatttagattttttggttagtggggaaggagagagaggttttttgtttaagttagtttttttttttttttgcgcgaaagggtagcgtttttgggtttgagcgattgttatttttttgtttttttttttttttaggtgggtattaacggtattatttttatttaggatttttttagggaaacgtagtatgtggattatgatttttttatcgatttttcggttatcgttttttttttggcggatatcgatacgagttacggtagaggtcgagttttgtatcgagaggatatttttttcgtagtgttgggtttggtcgttcgttatgtgcgcgttggtttttcgcgttttgcgcgttttatttttatttacgtttttttggttatttgggagtaggtaggcgtttacgaggaggttaagcgcggggcgttgttttcgg

SEQ ID NO: 7463 - DNA, 544 bp, synthetic construct
  misc_feature 1..544: note = Description of Artificial Sequence: Synthetic polynucleotide
  source 1..544: mol_type = other DNA
cggtttttagtcggttttgtgttgttcgttgcgaatatagttcgtgggttatcgggtagtcgagttatgtaagttattttgatttttaaaaggtagacgtataaattcgatttagaattcgaggcgaattttgaatttatagcgttaaaaacgcgtagtgttttcgtttgttcggttcgttgaaggttggttttgggtttgggggtagtgttcgcgaagggttgcgatggtaggtttcgttgttatacggtatcgagggttttttcgtttcggcgttaggcgtacgtttttttgttatatttttcgcggggcgcgtcgttagggttatttgtttttttaagtttcgttaggtagttaagggtgaggagcggagagggattcggtcgttgttgtcgcgagttagtataaaggtagcgtttgaaatcgaattttttattttgggtatcgcggtttttttttatttttggttttcgcggtcggagcgtatttattgttagtcgttatggtcggacgagggggttgttcgacggtcgtttaggttcgg

SEQ ID NO: 7464 - DNA, 2002 bp, synthetic construct
  misc_feature 1..2002: note = Description of Artificial Sequence: Synthetic polynucleotide
  source 1..2002: mol_type = other DNA
cgttttcgtttcgtgttaagcgggtttaaggttcgaggttttttcgtttataatttcggtgttcggaatacgttttcgaggggtcgtgttgtcggggttattattcgcgattggatttcgcgtcgtgttgtttttttcgggtttcgagttcgtttagcggtttgtacggtttaggtttgagttgcgggttttttttgtggggcgcgttgggagtgagttttatttttaaagtttattttaacgttttaggtatgattacgacggtagaggtcggtcgtttattttcgttttttttttcggttagagcgtttttgtcgggagtcgacgatcgcggtttgatttcgggttttatcgtttattttcggttttcgttttttttttacggttaggggttatatatagcggacgtttcgtttttagtcgtttttttgatttttgaatttgggagttagcgtgttcgttggggtatgtattgttacgggtattgggatttttttgttgttgcggggaggagtttcgacggtaggtgggaagatttagtttgttcgcgttttcgttttttagtttttgcgattcgggtcgaggtttttagtttttgggttttttcgtttcgggtttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggggttaggatttcggttggagtttggttttttatggcgaggaagtcgattgggaagggttttttggcgaggtttttttgttgtgttattttttttcggtagcgtcgggcgcggggaacgcggggttgtatcggggcgggggagggggttttattcggcggtttcgaggattcgattttggggtcgggttcggcgggtaggtttgtttaggagttagttggtaaatgtagcggattgttacgttattttattgttattatttattgtaaattattgttttaagttttcgggagaattcgtcgaatttgagaggggggagggggatgggggtgggcgcgtaggaagttttataggtattagggattggtgatttaggatattagtttttcgagttttttttgggaatttttagtatttagattgtttttgattgtagggattacggtggggcgttttttttttaagtttttttcgggatatcgggcgcgtttttttcgtttttgggttagcgtatatttttttacgcgatgattagtatagttattgtgaggttcggttttggtcgcgtttgttttttgcgagtgataataataaaaattattggaattgtaaggaagtttttggtttcggttttttagtcgttgttgttttgggtgtttcggttgcggaaagatttcgtagtcgggttcgatttacgagtggaatatcgggttgcggatttagtcgggtttataggattggcgcggggtttcggggataggtttcgtagggtttttttgcgtatcgtttgggacgtcgattttgttaatttggaggataatttttgtttttattttattagtagatttttaaaaatttagtcgtcgttgaaacgtgttttttattcgttcggtttgtttgtagtttttgacgagtttcggtatagttttcgg

SEQ ID NO: 7465 - DNA, 983 bp, synthetic construct
  misc_feature 1..983: note = Description of Artificial Sequence: Synthetic polynucleotide
  source 1..983: mol_type = other DNA
cggtgtcgcgcgttcgtttgttgtttggagtttttaattcggcggaatttaggttaggacgcgtcgtcgttttgacgtgttgtcggtcgggaggcgcgggcgttaggttttaacgattagggtgggtggtcgcggggtaggggttggatttgaattcgtttttcgggggttttggatgcgggatgcgggatgcgggatgcgggttcgattttttcgttgttggtcgaggagcgttttgagagtttttttttcgcgcgcgaggataaatatgcgcggtttgttagttagtgcggcgttgttttttagttgatagggtgacgtttcgtttggaggtttggagattggttttttgatttggtttttttcggtagtttaatgggtaaagtttttcgttcgtttagaaattagttttttcgcgcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagattttagttatcgttttgggtcggggtttttttttttttgaaattcgtgcggaaggatttttttcggggtttttcgttttggttttagatatttttttttttagatttcgcgttttagatgcgttgtttcgtagttttttgatagttgcgagtttacgaatttcggcgggagggcggcggcggcggattgatatgtttcggacgcggttgcggtcggcgggtagttcgcgggggcgatgagtcgttgcgatcggtgaggcgtcgggcggcgggggtatcgcgtattttttttattttttttttttgtttatttcgttcgggaggtcgagaggaaacgg

SEQ ID NO: 7466 - DNA, 947 bp, synthetic construct
  misc_feature 1..947: note = Description of Artificial Sequence: Synthetic polynucleotide
  source 1..947: mol_type = other DNA
cgttcggtgtttattttcgggattttgaatttcgttttttttttattttttgttagattcgcgagggttaggaagggttttgggaggaagcgggagcgtagcggcggggtatggaagaagagggttgggggcgcgcgttatttgtaaaggttttcgaggtttttttttagttttggtggtaatttcgtttagcgtcgcgtttttttttagatttaaatttttgttgggtttttcgggtggcggcggcggcgacggcggcggttgttggagttaagttttgtcgttcgtagcgtcggggcgcgggggtgcggaggtcggagttttagagcggcgcgcgttttttcgtagcgggtcggggtcggggcgtttagttcgtttcgtttgttttcgtttacgttttttacggagttgcggtatcgttttttttcgtttttcgttattatcgtttttagggttcgggtatgttatttttttttggtttcggtcgtcgcgattttcgtttttttttttttttcgttttttttttttcgtttcgttaagttaacgaattttaaaagaagtatagcgagcggggaaggcggtagaaagttgtttcgcggcgtcggagtttttcggatttggaggatttcgggattcggcgggagagttaggcgggttttttttcgacgcgtgtgtgcggatagttcggagtcgggcgtgcggcgttgcgcgggggcgggcgtagggttcgttttaagtgttgcgttcgttcggcgtgggtttggaggttgtttagattatattattgttttaattcgacgcggtcgggttaatgtaggcgtcgcggtttttatttttattttttttgatattttcggatatgtttatagtaatgaattcgcgggatcgttttcgtagttttcgcgtttttttttttttttcgtttttcgcgttttggcgcgtttcgt

SEQ ID NO: 7467 - DNA, 1362 bp, synthetic construct
  misc_feature 1..1362: note = Description of Artificial Sequence: Synthetic polynucleotide
  source 1..1362: mol_type = other DNA
cggttttcgggttttgcgaagggagttttgttcgcgaggcggagggtttggtttatcgagaagcgtattcggaggcggttgaggggcgcgcggggtacgtagtagagtcgtagttcggttcggattcggagcgtcggagtcgtaggaaggcgaggagaaggaaaaaaaggaggttgtcgtcggtttttgttttattttttcgggtagcgttgattcgttggtcgtcgtcggatagggttggtcgtcgggcgcgggatttcgtgcgcgttgtttatgttttcgtttgtcgttggttaggtgtgcgcgtagtttgttggtttttgggcggtattcgggggttttttatgtttcgcgtcggggttcggcgggaggatttcggagaggtagcgcggagggaaagagagagagatagtatgagaacgcgtagagttgtatttcgcgggggtcgggcgttagtagtatcgcgttgttttatttacggcgcgtttgtttttcgcgttgcgcgtttagcggggcgtcgagttttagaaattttagtatatggtcggttcggcggttacggtggtcgtagttgttttgtttttcgagcgttttttattgttttttgttttaagttttagagcgtagtttattagcggcgatcgcgatcgtagcggcggggcgtttattcggtcgtaagtatagtagtgcgtatttgcgggaaaggaggaaggggttggcggcgtcggggtttttataggggaggggtatttcggcggtagtaatcggcgtaggttaaggtattttgggtcggggttgcgcgcgagttaggtggtggtaggtcgggattggggagggtttttgcgtttttcgtttcgcggcgtcgttgttgatgacgcgcgcgggttttttcggtttcgcgtttgcggagttagtttcgttatttagcgattcgtttcggggagttttcgttgacgcgcgttgcgagtcgggttgcggtagtcgaggggcggggagggaggggagggggagttttagtgcggggagggtcggcggttgcgggttaagttttttttttcgttttttttttcgcgttggggagggggttcgggaaagacgtggttttcgtttggttttggaggatgggaggttttcgcggggcgggggggacggagggaggtattgagtgtttttgttttcgtagtggggatgtagtagtaggtggcggttatgtggtttgtggaggttcggtatttagaggcgcgcggtgagttcgtttcggcgggagcgtggcgaatgtggttttgggcgcgcgggtgtgtgggatacgtttttatttacgtggcgtatatggggatttggggacgcgggtgaaagaggcgt

SEQ ID NO: 7468 - DNA, 1092 bp, synthetic construct
  misc_feature 1..1092: note = Description of Artificial Sequence: Synthetic polynucleotide
  source 1..1092: mol_type = other DNA
cgatcgcggcgcgtcgacgtttggcgggttacggttataaagcgggttttagagttttttttaggcggcggtaaagggggcgttcgaggttatcggtaagagatagattattggcgtttcgggaaaatagagtggggaagggcgagattgtgtgtttatttacgttcgcgcgggtttgagttggttcggttttggagggtttcgggattttagaagggggatagtagtgggggatgggtagaagggggcgattcgggttgtttaggtttttcgtagtttttttgttaacgagaggggttcgggcgggaatagttcgagtcgcgggggtgcggggcgcgtagttcgttttatttcgggagagtcgcgatcgtcgttttcgacgcgtgtattaagtgggggtgttcggttcgggataaaggatcgggacgcggatcgcgggcgggcgttattgtttagttttagcgtggagggcgagatcgtggtttcgaatttttttaaatttggcggttcggggcgcgtgggggggacgtttcgttatttgcgcggttataaaggagagatttatggtgtcgttgtagttagcgttcgagttttcgttgttgtcgttgtcgttgcgggttagtcgtttgtatagttggcggggatcgggttgagtagcgagcgttcggagatcgtacggcgtattcggttgtttttgggtttttggttttagatttttattaggcggagggtttcgagtgcgggggcgggcggggcggggtggggcggggttcggcggacggggcgtttttttacgtgattatttttcgttttattttcggggcggggttcgttagaaattttaagcgttcgtaatcgttttttttcgtgggcgggatggggaaattgaggttcgaggtcgtttcgttggttggtgtaagaattagtttgtaatttaagttttgagttgttggcgtttcgtttcgtgtagttgaatttaatttattcggggttgtgggtagcgtttttttggggttgatacgttatttcgagtttgaggattaagatcggagtgatttggttttttacgttaacgttttttttagagttcgg

SEQ ID NO: 7469 - DNA, 1092 bp, synthetic construct; identical to SEQ ID NO: 7468
  misc_feature 1..1092: note = Description of Artificial Sequence: Synthetic polynucleotide
  source 1..1092: mol_type = other DNA

SEQ ID NO: 7470 - DNA, 1092 bp, synthetic construct; identical to SEQ ID NO: 7468
  misc_feature 1..1092: note = Description of Artificial Sequence: Synthetic polynucleotide
  source 1..1092: mol_type = other DNA

SEQ ID NO: 7471 - DNA, 580 bp, synthetic construct
  misc_feature 1..580: note = Description of Artificial Sequence: Synthetic polynucleotide
  source 1..580: mol_type = other DNA
cgtgtttaggggagttcgatagagtacgcgggaaaagtcgggtgtttacgttttcgcgatttaggttgtagagataagagaaggttaggttttgggaggacgcgaggtcgtttaggaatggtagggaggttcgttggggtttgattttggttttaatggattaaagtttcgacggagtaaggtcgggtgttcgtggtggtattttttattagtggacgttggcgaatgattatggaaataatatttaatagtagtgttttttatgttaggtatataatcgttttggcgtgggttgataattatgtttattttatcgcgtggtattgagtcgatcgtatatttagggtttcggtttttagggttcgtttattcgtttattgcgtgaagtatttattttcgtaggagtcggagtaggaatagggttgggttttggggcgcgcgtatgcgtaggtcgtgttttaggaagggcggggtattgagtcgagggtcggcgcggggcggagggtagggggtggtcgtattttttagggtatttgtgcggtgattgagaatcgattcggtaattcgcgggttcgggcgg

SEQ ID NO: 7472 - DNA, 888 bp, synthetic construct
  misc_feature 1..888: note = Description of Artificial Sequence: Synthetic polynucleotide
  source 1..888: mol_type = other DNA
cgattcgttttttggtcgtttttttcgcggttaggcgtattttgtagcgtttagatcgtcgcgtttttattcgcgtttttaatcgcgagcgttcgtttgggtcgggtcgggcgttcgagattcgggagagattaggggttcgtaaagtagaagagtagatttagaaagaaaaaaaaaaaagcgagaagtgcgagaaaaatatattgaatttagttaaatatacggtagatgaaaaaaatattttgtttagaagttaaaaacgagttttcgagtcgtgagatattgttgcgttttcgttaggcgtgtaggtcggatgttaggggggtaatttcgaggttcgatggtggtttcgattttagggcggatttgcgtttatttttagtttttgtaattgcgggttaggagaaagggatttgttatggcgaagaaaatcgaattttttttaattaggtttttttttaaagagagaaaaagtaggtagttgggtaatttaatttaatttgggattcgggacgtgtgtttgggcgtttttcgggtagttggtcggagcgtgtgggttcggagtttttagcgttggtttcgcgttgtttttcgatgttattagtaaattcgtagggcgttttggcgtaggttcgcgtttgtagagtcggtttgggaagcggaatttttttcggtttcgatgattaggtttttttagggttttggtttaggttgtttttgtgggatagagttttatgaagggatatagaaatagagatagtttttgggcggcgttttcgggatgtggcgtttttgtgtttcggggagggggtattatttttgtttatgcggagcgattcggacgttgtaggggtgacgtcgggtagcgttcgttttgattttttacgg

SEQ ID NO: 7473 - DNA, 1483 bp, synthetic construct
  misc_feature 1..1483: note = Description of Artificial Sequence: Synthetic polynucleotide
  source 1..1483: mol_type = other DNA
cgcggttttgggcgttggtagggggaggtttcggtaacgtttgggggttttaggttagtttttttcgggttggaaggtatcgtataggggttttcgttaatttcggttttcgcgcggtcgggatacggttatatttgttcgcgggggtttgttttttaggtcgtcgtaggtttttcggagtttaagaggattttataagtagttaaagttagcgtcgtttgttttttgtagaatattgttttttataagttttgtagattttttcggttttttagacgtttttacggttttcgcgaagttattttcgcgttttgaatgttttcgaatttttgtagagttttcgcggttttttggaagttttcgcgttcgtggagtttttttttcgttttcgggggtatcgcgggtttttagtttagttttttcgacgttggtcgttgttattttttacgaggcgtcggtttcgatttattttattgtcgttgtcggggacgggcgcgtcgggttaggggcgattcggcggcggcggcggcggcggcggggcgcgggacgcgggcgttagcgggggagtcggtttcgggcgcggcggtttcgcgtttgattgggttgcggggggtagcgggggtttatttttttcgggtgggcgtcggggtcgttagttgcggggaagggtcgcggcggcggcgattgatagttgggtttcggtttttgttattttggcgggcgcgtgttcgggtcggcgtgtgcgcgggcgcgtgtttgggggtcgtcgtcgggggatgggggggcggggggcgagtcggttggggttcgggcggcgggaacgcgtgcgcgttcgtttgagattcggggcggcggtttttggcgagtgcgcgggcggtttcgagttttcgagggagaggcgcgcgggcgcgcgggttagttttagtatagtagttaagagttagggtacgcgcgttgttgttcgttttatcgtttttcgaggggattgcgcgcgcgtgcgttttttcgttcgcggtcgttgaggtgaatgagcgcgcgcggcggttaaagttcgatataaaaggcgcggggttttatcgttcgcgttttcgggagcgttgagtttgaggttgcgaggggcggggcggacgagagtggcggggttgaggggcggggttttgagggaagcgcgaggggcgtggtcggggtgggggcggggcgtcgggcgggtacgtggcgcggtgcgttttttttcggcgcggacgtttttttagttttcgtttgattttagagtttatagaggttatcgggggagttagggttcgtgttcgatggttttatgatttttattatttggttttgttgagtattttgttcgttcggattcggggtatttttgattcgagggtcgtcgaggttatcggcgattgattttttttttttgtatataaggagtcgtggcggggtcggagagttgtagttttggggcgatattagtattcga

SEQ ID NO: 7474 - DNA, 3714 bp, synthetic construct
  misc_feature 1..3714: note = Description of Artificial Sequence: Synthetic polynucleotide
  source 1..3714: mol_type = other DNA
cggcgtggttttgttcggaggggtcggtttaaggaagtgttatttattcggagggtggtttcgggttcgttgattagtttttacgtttgtcgtttgagttttattagtttcgtgtggtagtggcggtattagtcgttttcgtcggtcgagtggttttgttttgggtcggtttcggcgttttcgggagtagggcggttgtcgtatgggttttggtcgggttcggcgggtagtttttttcggggggatatttttagtagcggcggcggttcgcgggtcgggtcgttttcggttatttgtagggtgtgggggcggaagcggatagtgagtttgggacgttcgtcggatttagatttttgcgcgttttgttttagcgtgacgtttttgttaaagttaggagttttgggtacgattttggcgtttatttattttttttattttcggaggtttcgtttgcgggttcgttatttttagtaggaggttcggtttttagggatttagcgtatatcgcgagtattttcgtcgtttcgggttttcgtcgttcgtttttttttttaggtcgggtcgcgcgtatcgcgggttgcgtagcgtatagagggacgtcgcggtcgattatggtcggggcgcgggaagagttcggtaggcgttttcggttacgttggtttttcgggggcgtcgcggttacgtgattcggtttcgaggcgtttttatggttcggtttagtcgttcggaagttcgtagagtttgcgagtgtcgcgaggagcgcggtggtttcggtgggcgcgttcgggaggcgagggcggggtcggggaagggcggggttcgggttttcggggcgggcggcgaggggcgggagtttagagagtgtttcgtttttgtttagtgttgggcggcgcgtggggggggtagggttttcgtttttttacgcggtttcgcgtattttaaggattttaatttgttaggtgagtttttgtttcggggaggggcgttgggggcggcggcgaggatttagttgcgcgcgcgtatgcgtttttcgtttttttttcgggatattagggttgcgcgttttttaggaggcgtcgacgtttttttttttataggcgggaaaattgaggttgcggaggggacgtttttgtttaaggtttacggcgaggtgggtcgaggaaggggcgggatttcggtttcgagatttttaggcgtttttttagtaagtttagcgtattttgtgtgtcgcgggttattttaggtttaattgtcgcgcgtgggttagtgtcgtcgcggtgtgcgtttcgagtcgggtagcgatcgcgtcggcgtatttgtgtttcggcgcgtttgcgaacggtacgtgtttttatagtcgcgcgtgtgttcgtaagtgggtgtgcgcgtcgtgtcgttcgggaagcgggaggttttgcgggcgtgcgtcggatttgttgttagtaggtttggtagatgggaatttagtttcggaattaattgtttgtttgttttcggttgggaggtcgttttttcgtttttttttggcgattagttgttttgtgtttagtcgggttttaaatgtcgtcggtattcgcggtcgtaggtagtttcgggttaggtttcgggttagttttaaagttcgggttaagttaggcgggcgcggcgggcgggtttttcgtgacgcgagtgttttttgtcggtcgttgcgtatacggtttcgagattggggagatagcgtcgcgcgttttaggtttgaggcgtattcggaaatttcgaaggtcgtgattcggcggagattaggatacgcggttgtcggtatatacggtgaggttttcgtagagatttagtacgttaaagtgatttttttcgttttgtttatttttttttatttggataagttttttcgtttacgtacgtattttttagaaagtggggtgggtgattttttttcggtttttcgggtcgttgatgattttaggggttcgaaaacgtaagggggtatggaataaagtggtaggggttttttattttttttgagattcgtaagtttgtagtcgttttttatttagtttggggggtcggaagcgttttttttattcgttttttcgtagtttggagaatgaaaacgggcgttagtttatatttggatttgggtattgaggataatatttaaattttatttcgtattgtcggtagatagtatcgtttttcgtcgttttattgtttcgggatatatattttttatatttcgtttttttatttatatacgtaatatagaagtacgtagcggtcgggagtatcggttttgcgtttttggttagttatattcgtaattttagcgtttttatcgtcgcggcgtttcgggaagtataagtttatattttatattcgtagaatacggggtgtataaggttggagttatttcgggggtttacgattagttaggggtttcgattttttatttcgtttattttagtaaggcgtaaggtgagttcgagaatttttgcgttgcgtttttcgttttagttatagttttcgggtgggttcggttgggatatagttttgaaggtagagggagatttggataacgttaatgggggaaagtgcggtagcgagttttagttcgggttgcgggacgcggtttcggatttgtcgtttttttttcggcgtagtattttcggtcgcgcgagtcgcgcggtaaagtaacgggacggcgtttacgtcgttcgtttttttttcgatagtttttattttgtttcgtcgtcgtaggaggtggttggtgaagtttaggatgattttcgagtttaggtagagcgtttttatttttagtaggttgggagttttgcggggcgcgtcgcggggcggttcgggcggttggggtagcgttatggaagagggaagcgcggggagcggtttttagtgtttttcgttatcgtcgtttcgttcgcgcgtttattggtcgcgcgttcgtcgtcgtcgcgtttcgtatcgcgtagggtcgttcgttaagttttcggtttttcgcgtttcgcgttttcgagttttgcgttcgtttcgcgtcgcgcgttttcgcgtttcggtttcgtttgtttgcgtcgatagcgtttttttcgtttcggcggcgagttagatattagttacgcggattggaggtgtggggcgacggtttcgcgcgttattgggcggaggttggaagttagaatcgggtcgcggttcgcgtttatttgtttcgttagtttttagacgtcggtgtttattgtcgggtattcggtagggagagggtagcgcggttgttgtaaaattttttcgattggggtataatcgtagttttttttttttttaatttgttttgaggatacggcgcgttggggttttggtttatggaaacgtttagagtttagtgatttgtgtattttatttcgtttacgttttagagttttcgtttaattttggtttatggatttttaaggtttattttaatcggattacggagcgtgcgtagcgggattcgtagtttgcgtttttattttaggatttcgattgtgtcgttattcgtggttttttttgtttcgatttcgattttttgagggttggaagattcgggttggttgtcgggtacgacgattttatttttagggttcgaagttaggggcgggggtgggcgttttgtttgggtgtaaatttaagttcgggtttcgcgttttttttgtgggttgttttagtttcgcgcgt

SEQ ID NO: 7475 - DNA, 1266 bp, synthetic construct
  misc_feature 1..1266: note = Description of Artificial Sequence: Synthetic polynucleotide
  source 1..1266: mol_type = other DNA
cggttcgggcgttaggtagaattttagttcgatgttgtcgtcgtcgggggagagggaattcgttgggagggatagtcgggggttggggaaggaagagcgggtgttgggagggtttaatattggcggagttttaggtggcgacgcgggcggcgagagttgtttcgaggcgggggtttcgggtaggtcgttttttacgtagtatacggagtagaagatttgttttttggcgagggacgggcgtcgttgatttagtacgtttaggattagttcgtcggcggtttttacgcgggttttgggttttagtttttcgtcggggggcgttttttgttgtttatttttttttttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgttgtttatttagtcgtcgggatttttattcggcgttcgcgggtagcgggggtagtggttcggttcgattcgcggtttcgtttttgttttcgggtttttttttttgggttgggacgttttaagtttttttcggggagttcgtgtttcgaggttgcggcgcgtggggagtttggttcggttcgtcgttttttttcgtattttggcgcggcggggtatcgtttcgggggcgtcgagggtcgttcgttttgggttcgggcgcgttcgttttatatgtagttcggggcggcgtcgtagttttagcgagttttaggcgggatagaggggtttgggaggagacggtcgttagtttcgcgttattatcggtttcggttgtcggacgcgcggttcgagggcggtggttaaagggtcgaggggtttgtggcgtcgtcgcggcgcgtattaggaggtgtagtcggagcgttggttagtcgtagggtttttgggggagaggtcggagcgggcgattttttttttttcgcgttttatttatagtttttttcgtcgt

SEQ ID NO: 7476 - DNA, 1316 bp, synthetic construct; identical to SEQ ID NO: 7353
  misc_feature 1..1316: note = Description of Artificial Sequence: Synthetic polynucleotide
  source 1..1316: mol_type = other DNA

SEQ ID NO: 7477 - DNA, 10783 bp, synthetic construct
  misc_feature 1..10783: note = Description of Artificial Sequence: Synthetic polynucleotide
  source 1..10783: mol_type = other DNA
cgagtcgggataaaggtttttaacgggagcgggatatttgtttatatttcgtttattgttcgtagtttagtaatcggtttgtatttgtgtttgttcgggttcgattatttaggacgcgtcgacgaggggtttgttttaatttgggttattgttatttacgttatatattgggggcgaggtagttagggttgtagaaagtcgtcgagcggttcggggagaggtgtttttatttagcgttggtaattcgggggtagttggggcgcggcggcgttcgttgtagttgcgcgcgaggaggattcggtgttcgcgcgtttagtttggttcgcgcggaggagtttaggttgtgggaagattagatttggatttcgtaggggtggttttttgtgttttttttcgtttttagataaagtttttttttgatatttttttggggcgaacgagtattaggtagttaatttatatttttgtattttttttttaaaaaagttttaattagaagaaggggtggtaaatgcggcgtggttttttttaattttagcgtcgaggaggaagtgtaagtttcgggaaagtttagtttttagagtcgagagtggttggaaattttatattaatttgatttaatttggaaacgtggagcgcgtatttcgaacgtatttaaggcgtttaaaaagagattatattaaagaattcgcgtgggagaagaaaattggggagaaaacgaggtatcgtcgggttatttagcgatttttttttttcgtagttttttgggtttttatttaggttggagatataatttttatttttattttcgtaatttcgtttcgtcgttttttcgttgttttatttttagttagaggttggagagggagggggtcggagagggagggataatagagggtaggaaagagtagggtcgtttgtttttttttttattcggggaaagaggttcgtagagtttagaggtagtagggttagggttcgattttagacgaagttggagttttttatttttatttcgtttttttcgggatcgttcgtaaagtagaaagtgaattgcgcgttttttttggtcgtagagaggtggaggcggggggttgggggtgggaggtggggggaggcggagtgaaggaaataaatgagtttttagtaaataaagggcggttggaagggggcgggtcgtttggtggtggttttggtcggttcggagcggagtttttttttgggttttgggttttttcgcggttaattggaattaattatttgttttgttatttttagtatttatttttaagttttaattaaaatattgatttaggaggtttatagaagttgggtttttgttatttgaatcggattttgtttaggtaattattaacgatggaaaggagagattttcgtagttcggttttcgtttttttttttttttttaaaggcgttataaatcgttaatttttcggtttgtcgggggtgggcgcgcgggggcggggaggtaggaatcggtgaatgttaaagaggattttttttttttttttggtttttgttttgtttttttttttttttttttttatttttattttttttaagatgtaatttgttaaaacggtttttttaagtgtgtggattcgcgagcgacgcggtggttttttgtatgtaaatattgggtttaaaaaaaaaaaggttcgtttcgtttttgtaattaattgatacgttatattttttattttgttttagagggtcgttggttgggagcgcggagttttttaaaatttataattttatatttgtaaatattgtttttatttatttgatttttaagattcgtttatacgtggttaatttttgcgtttttaatgtttttttttttttttttttatttttttttcgttttttttttcgtttttttttttttttttttttttttttttttttttttttttttttttttttttttcgtttttttaggttcgtgagtggagtttagttttatatggattgatcgttcgggtaatggtttatttttttttcgttattagtcgttatcgcgcgtcgagcggtcgtcggagttcgagttgacgtcgttttggtattttttttggagttagaaattaaggtcggggttcgcggcgttcggcgcgtaggtcgttcggttttttgcgtttattttcgcgtgtttttaaagaagatagagagaggtattgggttgggttttattttttttttttttatttttagtttttttttttttttaaaaataataattattttaataattaaagttaatttttttttttttttttttagtttttttttttaatttttttttttttcgttcgttggggtaggggagcgttacgaattgattaagtgaagttataattttgcgatataaattttggggtttcgaattatgtcgttgattaatataaagacggggttttcggttaaggatattttagatttgtcggatattaacgatgaggagggttttgtggtcgaaggttcggaggaagagaacgaggggttcgagttagttaagagggtcgggtcgttggggtagggcgttttggacgcggtgtagagtttgtttttgaagaattttttttacgatagtagcgataattcgtatacgcgttggttggttagtatcgagggtttttagtattttcgtaagtagtaaaatttggttgtcgaggtcgtggttttttttatttttgtagtcgtagttcgggttggacgttgggagtgaaaggggaaggggttatgtaagttcggatttttttattcggattcgtagaaagatttttaatatttgtataggatgttttttgtttttttttttaagtttttttagtttcgggaaagaatttggtttttaaaattttttttaatgcgagaagttaaggagaaagagggagaagggttatattttttaggggttggtatatgatgttaattcggatcgatggttttagtcgtagttttcggatttcggtcgttgggagggattggtttggcgttttggaggtagttagcgagtttcgttcgggtacgggtggagggtggggaggtttcgggtggttcgggtataaatagtttattttgttttttgcgcgattatagaggacgttttgtgtagtgtagggggtgtttagaaggttcgaaagtagaaacgaaagtttttaaaaatttgttttaaatggtcgagtcgattaatgttgggattgtggggtattttttttaaaaatttgtttacgtttcgtcggagaggaaatcgtttaagggcgtcggagtttttaattcgcgatgatttttagtgttatttttttttttaaatttttatttatattatgtgagttttttgaaaggcgagtttttagtttttatttttacggatttttttttttattttgggaggtttcgacgttttcgttaggcgtagaggaaggtaggggttatggtaaaggtagcggggttgggttgttaggcgcggaggtttagggtcgtacggaggatttagggtgtttcgagtttggtgtaggttgcgcgcggtttttagacgtttgacgcgtttttttttttttttttttttagtgtacggtttggttgtcggggcgtttttttaggatttaagttttaagttttcggagttttcggtcgacgagttatcggataatgataaggagatttcgggcggcgggggggacgtcggtaagaagcgaaagcggcgagtgtttttttttaaggcgtagatttacgagttggagcggcgttttcggtagtagcggtatttgtcggcgttcgagcgcgaatatttggttagttttattcgttttacgtttacgtaggttaagatttggttttagaattatcgttataagatgaagcgcgttcgggtcgagaaaggtatggaggtgacgtttttgttttcgtcgcgtcgggtggtcgtgttcgttttggttagggacggtaaattatgttacgcgtttaaagtttaggatttggtagtcgttattttttaggcgggtatttttttttttgtttatagcgcgtagtcgttgtagtatatgtagtataacgtttagtatagttcggttagtattttttagtattcgatagtatattttttggtttaggtttagtagtggatttggtgagcgtcgttttaacgagattcgcggttttaggtttaggttttatttcggcggcggtggcggcgaggaggtttcggtttttatggtggttattattattattataattattattatggagtcgagttgattttcggttttattagggaggcgtcgggaggttgtttgcgtttttttggagtggtagattttatttatttagttttgtttatgtttttttttttgaattttgggagagggttgaattttacgtcgtgtttatagaatgtttgcgtagtttcgtttttttgttttttttcggggggattaaatcgttttagcgttaatgtcgttatttgaaaacgagaaaaagatcgattttttatttttgttttcgtgtattttgtaaaatatgtttgtgtgagtagcgatattgttagtcgttttttaaagtaagtggagaatattttaaaaatatagagaatttttttttttttttaaaaaaaaataagaaaatgttaaatatttatggttatgtaaacgttttgataattggtggtagatttcgtttttcgttgtaaatatcggtggtgattgttgttaaaatgatttttaggatcggtttgtttttcgtttgggtttaatttttttttttgtggtttgtttgggtttgttttttgttttgtttttgtttttgcgtttttttttgttttttttttttttttttttattttattgtgtaaatattttttaaatatggaaaagaaaattttgtaggtagggagttttttgttttgtttttcgggtttttagtttcgaatttggagtttagttattcggcgcggttttttaatagcgtcgggcgtagaaagttttcgattttttaaataagaattttaataaaaattttgtgtttaaaaaagaaaaaaagaaaaaatttttgttttttcgtttgttttattgcgtcgggtcggaggtttgggtttgggagtcgggttcggtcgttcgcggggtttttataggcggtttttttcgggcggggaggtcgggggtatcggggttttggggcgggcggggttttcggtgtaggttttttcgattataggttgtatttcgcgtttaggattggggcggggaggagaacgttcggttttcggtttgcgagcggtcggtcggaagtttagggtcgtttattttttttcgtattttttttggtttcgcgcgttgtttgaatttcgggcggtagcgttcggttacgggaggaaaagtgatttcgggagtcgtaaaggcgaggagagtaaatttttttcgttggtttaaatttatgagtggtttttttagtttgagaagttgttgaagttattatattcgatgatttttattttgttatatttgatttattttacgttaagaaagtgggtgggtgggggtttgaggttaagattggttgttttttttttattttttatttttttttaaaatttgcgggttggtgttgatttaggagatcgttaaggttgggggtgggaacggttagggcgcgcgaggttttggtttagggggtttgggggaagtacgcggggttttgggttcgggggagggaggggatattgtagttttttttaggatttttggttttaggaagttagggagcgagaatttttggtaattttagtaaattatgtttttttttttttttacgtttttatttttttcgggtttttaggttttttttcggggattggatttcgggtttttttttttttagcgttcggcggttcgaattagggtgtgcggtttttttaggttagtttttgagcgtggaattgggtggattgttaggaagtagaggtttgggggtggggtgagtttttcggatgggaagtgggtatatagtttcgggtacgttcgggaagggcgtatttattttttcggcggggaacggatttcgttttatttttgttgttggaggaagatttttttggtagatgttggcgtatatttggttacgcgggggagcgttttaggaagtttggttaattggaggatgagttttttttttttatttcgcgggtttttaaaaatatttgggattttagtttagagtttagcgggtgttgtagacgttgagggattgaacgtcggcgtatttggaaattgtatttttgtttttttcgaagttgtattattaaggttggggggttgggtggtagtgaggaggtcgggtaaaaggagcggttttagttgattttttcgttttttgtagttgatgattaggtttaatttaatatttaaagtaaatatgattattcgtgcgattaaatttgtgcgtcgatagtattttgcgtagtagtttagggacgcgatgatattttattttcgcgttttatatcgtttttggataattgagggttcggaagtttttttaatattttagtaaaggtttttttttattttcgggtttattttcggggaaagggtagtttttttaaatgttaaaaggtttttttttgttttttatattagtttggtaatgtttgggggtttatgttttattgtttttaaaggttaacgaattttttttaaatagtttgttgtgtaataattgaacgtttaatttgttttggtattaattatttaatatttatttgtaattttttttaattttaaaatttttttgggaggaaaggtgagggttttaagttttttggagcggagttgttagaaggtttgaggttattttgatttttttaggttttagggtttttagggtgagaatgattataagagatttttaggtttttagagaggaagggggaagcgtggaaggtttttattttggtaggtttttattatttgtttattgaggataaatttggagttgtggttaggatcgcgggtttgtaatttgggtgtgcgtttttgtggtcggtcgggagttcgggaggtggattcggcgttcgtttttttttgttttcgggtttttatggagttaataaaagcgtttgcggagttttgtgtggttttaattttagcgttttgggagcgtattcggcgcggggttcgttttagtagtttattttcgtttaatttatagcgggcggtataaaatcgtataatgggaaagttgggagtcggagatgttagaggcgtgtatattaaaaagggatagagaaaggatcgcggggatagagagaggggaagaaggagaaggggttcgttttttatttttcgttttatttcgtattatttagcgcgtttatcgtcggtagtgaatttcggagttaggtagaagtttttttggggttttgttgggtttgttattgggtttttttgttatttacgggttttatgttggattttatatggttagttgggtcgagggagcgcgaggagggattcgtataaaatttaaattgtgttcggtttttaaattttgtattgttgtttgtgaaaggaagacgtattaaaaattcgtgttatatttattggggaggaggttggaggaggggagaaaaagttatttttgtttttgatggtttcggagggcgtttgtttcgtttaggtttcgtgatattgaaagttggattttttttattttgttttttttttttaaaatttttttttttttttttttttataatttcgtttttataatttttttttttatttttataattttttttttttataattttttttttttttttatttttttttttttttttttttgtttttttgattttaacgttgggatgggagttcgcgaatttgcgtttttagggtttggtttatttgtgcgtattttgtttattgttgtgtgtgtattaggaaattaatttttgtttgggagttttgtattatcggatcgttttggggtttaggaggtaatttagggtatttagggtttgggtgatgttcggttttttacgggtttagcggtttttgggtagatgaaaatttattttttgatttcgtaatcgatcggtttcgaagcgttcgcgcgcggagtcgtttttttatttatcgcgagaaaggttttgagaggttaagggtgtcgtttagtttcgggtttagttagatttgggttgtagtcggttttaaggcgatttgcgttcggtcggattatttggttattaatttcgaagagttaaagacgcgcgcgtttttttgaattatgcgcggggatttattttattggttttttggtgcgatgggaaattattttagaaattttttttaatagcgtttttttttatgttggaggagggagatattttttttttaatttttaatgttttttgtatcgcgtgtttataaaatttagtattagggagatatagtagggtttttaaggaatttgtttattttttgttttttttaagcggtttaaattggcgcgaggtagtcggaaataatttgggttatgtttttttttttgtaattgttaggttaaaatttttataagtagtttttaaataaattatatgtattaaataaaaatagtttatgttgagttttgtggaaataaaaattggaatttagatatgttttttataaagttattcggtttttaatgagtagaattgagttggtggaaatttcgattaatgggaaatttggatgcgtttttttttttatttagtataacggttatatttagtagaattagataatttggtaagagtggaagtttttttttttaatattttttattttagatggggaaataatttatttttttatttattgattgttgggtttagttgagatttggtgtgtatttttcgagtttttttaagagtttggttattgaaaagttaatttaatatttatcgagtataaggatagtttttagacgtatttattaaggtttatcgttaagtgattatttggattgaagataaaggttaggggagggggcgtttaggtatattagattttttttatttgggttttttttatttagaattaggaaatcgggagcgcgtttgtgcgttgttgaagtttttttttcggtgttaagtggcgggcggattagatattgtgttgggcggtattttaggaaatatgtatttgtggttttttgagaggttaagcgtagtgatattttaaatcgtgtcgatatattattttttatttaggatttgtaaataaatttttgattttttcggcgtattatagtcgtcgttatttcgttaaggaagcgatttgagttttattgtttttattaacgtttcgagatatatatatatatatatatatatatatatatatatatttttttttcgtattttgatttttaaaggttttattttttttttttcgaggtatcgttattaataaagaggcgaataggttttagcgtcgttattcgagtaagcggggaaatgtgggttagtagtttaggttcgcgcgcggatttcgcgtacgttttacgcgttttttcgggtcggagaatcgagcgtgtgtcgcgtgttgtcgtcgttaggaggcgttcgagtttagcgttttcgagcgtttttgcgcgcgggttcgggtagagttcgggagtcgtcggaggtagttgcgtattagcggattcgcggttcgggtcggagttcggtgagtggtgttaagaggtggcggcgagtcggaattttggggagagtcgcgagttagacggcggcgggtgtttgggaggtgcgagtcgatttgtgttcggttgtggttttttcgttatgtttttttttttttacgtgcgtattatcgttcgttttagtttcggtttttatcgtgtttgggtatagattatagtcgattggtttaggagcgttttggttattgggagggttttattaggcgttagggcgcgttgttttcgcgattttagggtttttggcggcgtcggtcgcgcgggtggacgcggagagggcggtgttgcgagggttcggagagtgggtgttcgcgtggggaggcggttcgggagcgcgggagcgatgcggaggagggattcggtttggttgtaggttttcggggcgggggtttcgggaaggagagattttcgtttttcgttcgttttggattcgggtttcgtcggattttcggtttttgtcgttcgtcgtttggaagcggggtaggcgtatagtttagacgttagggagagacgtttcgtcgatttagatcgtggggttagggttcgggaggtaagaacgttttatatatagtagggtattttaggtaatttttatttcgtgttgaggtttcggttagggtgtaaaggtgttcgggaatggaagggatacgagggtgtggacgtttcgtattttatttacgtttggtgttttttgagaggttgggcgtggggtagagggtaggggataagggggtgatattttttaaggttttttttttaataaaagtagggtttgtagttttagtttgattcgttgattgttgggtggaatcgttttatattaaaggtatcgtggttttaaatattgttttttttatttttttaagttttcgttttaaaattagttgtcggtgggtcggtgagggcgtttgtagtatttaggtttttcgcggggcggcgcggttggataagaaaaggtttttcggttggggcgcgtagcgtagtttagatatttgcgggattcgagatgttttcgcga

SEQ ID NO: 7478 - DNA, 810 bp, synthetic construct
  misc_feature 1..810: note = Description of Artificial Sequence: Synthetic polynucleotide
  source 1..810: mol_type = other DNA
cgagtgtcgattcgtttgggcgggattttttgagcgtatttttttcgagcgcgttagtgtttttgggagaggtttgtttgggtgagggattggacgtcggttttttcgtaagtcggtcggttgagggtgggggtcgaggcggggtcgggaatagttttcggattagggtttagataatttcgttcggcgtttgttttttcgcgcgtatttgtcgggttcgggggttgttagaagaggtcgtagttcgcgtttttcgggtttttacgtttcgtagcggcgttttttttttcggcggtacggattggttgcggcgtcgttttaagttcgtttcgcgttgtcggcggggggcgtcgcggattagagcgcgttgcgtcgttatcgtcgtcgttatcgtcgtcgtcgtcgtcgtcgttagtagtatagcgcgtttcgggtttcgcgcgtcgttagtttttggttcgttcgtcggtttcgtcgcgttcgttagtttcgtagcggagtttcggttcggtttcgggtcgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcgttttttagattttcggggtgtttcgggatttaggttcggtagtttttttttcgattcgtgcgt

SEQ ID NO: 7479 - DNA, 1142 bp, synthetic construct
  misc_feature 1..1142: note = Description of Artificial Sequence: Synthetic polynucleotide
  source 1..1142: mol_type = other DNA
cgcgtggagcgcggtttcggggtagcggagagtggggttttaatatttagtatatgtagattttggggcggtgttgttaggggcgcggattcgggattatcggagtatttgtatcgcggggaaagttgatagggcgcgcgattttaggaggttgtcgcgtcgtttggtgcgtgaagttttagggtagcggagcgcggggattttgaaggttgtcgcgtgtaggcgaaggggtcgtagggtggtcgtttttgggagagtagacggggaagaaggtaacgggagggagggcgtagcgcgagtagtttcggacgcgggtttaggaattggtcgcgaggagcgtaatttagtaggcgcgttagggttttcggatttaaggtgcggggtttcgattgggcgtttggacgtttcgtgacggtggcgtcgttgttattgtttcgaagcgaggcgaggttaggcgttgcgttttcggttgttcgtttttttttttcgtttcgcgtttagtttttttttttcgtttcgttttttgtttcgttttttttttcggcggttgttgcgtcgcgttttcggcgtattcggagttcggcggggatcgggaggtagagacggggcggtcgtggtttcgagggcgggagttgagtcgggtttcgggatcgaagtttggcggcggtttcgggaggtagagcgggtttttcgggcgatttttaggtttttttcgcgttttcgtttcggattcgtgggtagtcggggggaacggaagtcgcggtcgggttaatttcgaggcggggacgtcgcgacgggaatttgaggtgggaattttgcgcgttgtagtttcgtcgggcgttattaaagcgcgaatcggatttcgagtttgtaaattcgggttcgggggcggttgtacgtggtcgtggttttgaattttttgcgggggtttcgaaattcgtttgcggggaggttagggcgatagaggattcgggagttatcgttggtgcgtggcggcgtggagcgcgtttgttacggttaaggtgcgggttcggtttcggtttattttaaggggttatcgggatgcgaagttcgggacgttcgtcgtcgcggtgatttcggcgggggcgtatttcggttgtgggtcgaggtttttttttcga

SEQ ID NO: 7480 - DNA, 2885 bp, synthetic construct
  misc_feature 1..2885: note = Description of Artificial Sequence: Synthetic polynucleotide
  source 1..2885: mol_type = other DNA
cggaggtttcgggaaagtttattaagttttacgcgtttcgttgatagatgtttaggaagcggttggtagggaagaggcggttttgtagtttatagagttttttttttattttcggggagttttaggtcgcgttgttttttattttttcgtttttttcggtttgtaacgttcgtggcgttttttaataggttttagaaatttttttttattttgttttttaagtttggttatagggcgtttcgagtagggagtgtgcgggtttcgggtatacgttgcgtcgcggttgtattagagcgtttacgattttgatttcgattcgaagcggttttttagcgggatagggtgttggcgttggcgttgttgttattgcggcgcgttttttcgttttggtttttgcgtgtcgttagggatttttgcgttagggttagatttaaagacggatcgaggcgggtgtttatttgggacgcgtgcgtttggtggcggaattttcggggcggtcggaggcggcggtcggggagtcgagaagtaagtattagcgttttaggatcgcgcgcgtcgtttcgcgtcgtttcgcgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgtagagtcgggagttttatcgtagcggtagcggtagcggcgggttcgggtcggtttcgggggttgtttatttatatgagtattcgtttattcggcgagttttcgagtttaggcggcgcggttatggtcgagtttaagtcgttgtcgggggacgcgtatttggtattaagttacggttacgcggcggcggttgcgggtttcgtttacggggcggcgcgagaattcgaagcggttcgcggttacggtatttcgggttcgggcggcgattttttcgcggcgtttgtatttcgcgttttagtttaggcggcggagagtagcggcgaatagagcggggacgaggacgacgttttcgagtagcggcggcggcggcgcgggttagggagcgcggcggacgggcggcggcggtcgcgagagtagcggtttttgcggtttagtattaacgcgcgcgagcggcggcgtatgtacgatttaaacgacgcgttggacgggttgcgagtcgttattttttacgcgtatagttcgtcggtgcgtaagttttttaagatcgttacgttgttgttcgttaagaattatatttttatgtaggcgtaggttttggacgagatgcggcgtttggtggttttttttaattagggttagggtttggtcgcgttcgtaaacgtcgcgtttttgacgtttttcggttaggttattgtgtgtttttttttcgtaggcgtcgttttggggttttgttttgataagtgcgtcgtttttttcgggacgtttttcgcgttttgtaaatattgttacgagaagtcgtgatcgcgcgggttttcggttttttcgtacgcgtttttcgatcgtttttgtgattgtttttttgttcggataggaaaggtttggagggattttgtagattaggaggagggggttcgatttcgtttttagtttgtgcgcggtggatagtttagcgtagcgggaagcgttaaggtcgtcggggcgcgggattgagttcgagagtcggacgttggattttgcgttcgggaattcgcggtatttattgggtattgtcgggatttagtaagtttaggaacgggggtgggtagagtatttttcgggtattgtcgttcgtttttaaaagaagattatcgcggggttttagggttacggcgaggacgggtattggttagatttcggataggcggttttggtttcgggcgtacgaaaggtggagacgaagaaaagtcggatttattggtttttgatttttttgtagtgggtttcgcgttttcgttttagtcggtttttcgtgttaaattgtagggtagtgttttgtttttgaggacgcgcgtggtcggtattttttatttcggtgatttcgagatttcgtagttttgcggagagtttacgatggtcgtttgtagaggagttggatcgcgggcgtaggaagatttcggggaaggttttttttaagtaggagtttgttttatttatttgggaattggacgtcgtcgtcggttgtttcgaagtttgaggaatttgttttttaaatgttttttggtttttttttttcgtcgttattcgttgtttgggacgttcgcggggtggagttggatggagatcgttttgcgggttttttgtttcggggggttgcgtggaggagggtttttatagttcgcgttttatttaattttgacggttaggggagggtttcgtttagttttggtgtttagtaaattttttttttatcgattttttttttttttcgagggaggaggtcgggttacgggtgagtaagttgttgcgggtttcgtgtttcgtcgggtgtgaacggagatgcgttgcgtagtgttcgttttgcgtagtttttagttttgttattattcgggatttagggagtcgggtagggtgttttcggggatttatttgttcgcgtcggtttgcgtttcgcggtttcgtcgtagtattcggttttattaatttaattttttcggttgtcggtaatgttaaggggagagggtcgtcgttttgtaacgcgtttgtttatagcgt

SEQ ID NO: 7481 - DNA, 1460 bp, synthetic construct
  misc_feature 1..1460: note = Description of Artificial Sequence: Synthetic polynucleotide
  source 1..1460: mol_type = other DNA
cgcgtttagttggaatgtagagatcgtcgttcggttacggcgtataggacgattcgttcgttcgtcgcgattgtgtatgggtttcgggatacggggtcgtcgttgatacgcgcggtttcgtcgtcggtttcgtcgttttcgtcgcgttcgtcgcgttcgtttcgtcgtttagttcgtagcgtagtttttcgcgtagtttcgagtcggggcgttatggttttagttcggtcggtcgcggggaacgttaggcggtagacgagtcgcgtattcggcggtttatgaacgtttttatggtgtgggtaaaggacgagcgtaagcggttggtttagtagaattcggatttgtataacgcggtgtttagtaagatgttgggtgagcggcgggagggcggtagagaagggggagagggcggggggggttcgggtcggggtggggcggggggggtaggggtttcgggtcgcggggtgcgggggttgcgttaaattttcgcggggcgtttcgggcgtacggagggttcggcgtttattcgttcgacggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcgtagttatcgttcgagttttttttcgcggcgtttggttcggttcgcgtttttcgcgagttgttttcgttgggcgtcgagttcgacggtttggggttgtttacgttcgagcgttcgtttttggacggtttggagttcggcgaggttgttttttttttatcgttcgcggcgttcgaggattgcgcgttgcggttttttcgcgcgttttacgcgtttatcgagttgtcgcgggatttcggcggttgttacggggtttttttggcggaggcgtttaggatcgcgtttttcgcggcgtcgttcgttggtttgtattacggtattttgggtacgttcggttcgtatttcggttcgttgtcgtcgtcgttcgaggtttcgtcgttggagagcgtcgagtcgttggggttcgtcgtcgatttgtgggtcgacgtggattttatcgagttcgattagtattttaattgtagtcggattcggttcgacgttttcgggttttcgtattacgtggtattggttaaattgggttcgcgcgttatgttttgtttagaggagagtagtttgattttcgcgttgtcggacgttagtagcgcggtttattatagcgcgtgtattttcggttaggtcgtcggcgtcgttcgggtttttgtagcgttttttttcgtagttttcgcgatcgattcgatcgcgtcgttgtcgttttgtttttttatacgcgt

SEQ ID NO: 7482 - DNA, 1560 bp, synthetic construct
  misc_feature 1..1560: note = Description of Artificial Sequence: Synthetic polynucleotide
  source 1..1560: mol_type = other DNA
cgttttttaatcgaatttttttttttgggaatcgtagtttagcgcggtaattgagttatcgtaatcgggcggtggggaggaagggtggtttaggaaatcggcgagggagaaaagcggtggaagggagagttttttttttggagcggttttagtagtataaagtgttggttatagcgtttttttcgtttttagattgacgagtagtggcgtggagttagcgcggaggttgttttttttttttttcgagttcgtagcgcggagcgcggtttagtattaacggagtcgggggcggcgtttttgggatggaaaagggttaaaggggaggagtggggtgggggtgggggttttattggtttattataaaaggatcgttcggttgttcggtttttgtattcgttggaaagcggtttcgagttaggggttattgtaaagttagggtgcgttatcggacggagaggggagagttttgagtagagtgagtaatatcgtagttaaggcggaggtcgaagaggggcgttaggtattaattttcgcgttgttttagtttcggaggcgttttagagcgttttttgttttagtagagttattttgtttgcgtttgttttttagtgtttttaattttgcgttggaagaaaaatttttcgcgcgtcggtagaattgtagcgtttttttttagtgatttcgggagtttcggttgtagtcggttttgcgcgtttttttaacgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgtaaattcgggttcgagacgtcgttttcggaaatcgatttggcgtattgtttttatttcggtatcgtgaatggcgattttagttcggttgtcgtttttagtttttgcgagggcgtgcgcggcgttttttatttgttgggggaggcgtattttatttagtcgttgttcgtcgttagcgagcgtttcgttatcgtcgttttaggggagaagtcgtcggtattattatagttttattttttgcggcggaatcggtagggcgacgtcggcggtacgtgcggggtcgtggacgacgagtttcggtcgattgggaaagcggagatcgaagacgaggacgaagggattgagggcgaggacgaaggggtttagtggtcgtcgtaggattcggtattgtaaggcgt

SEQ ID NO: 7483 - DNA, 5118 bp, synthetic construct
  misc_feature 1..5118: note = Description of Artificial Sequence: Synthetic polynucleotide
  source 1..5118: mol_type = other DNA
cgttttttttcgcgatagagttttcgagtttagcgtaggttagttttcgttttttcgcggtttttggtttttttgtcgttagaacgcgtcggcgttagtcggtttatttggcgtcggaggtgaggcgcggtaggttgtcggcgtttatagtcgatacgtggtggtgcggcggcggtatttggtatatgttgtaggggtagggtatgtcgttttagtgttggaagttttcgttcgttttattgtcgtcgttttcgttttttagcggggcggtcgcggtagtagacggagatttgagtaggtcgtgcggtggacggatggagtcgatcgacggtagttcggattcgggtagagaggcgttggatatagtcgcggttgtagcggcggtagtagtcgttgcggcggcgggcggtaggatggggtggtgtatcgcggggtgatgtgcggcgtgcgttgttgttgtcgggtgcgcggtggcggcgggtaggggcgcggagtgcgttaggtcgtcgtaggtcgacgggtggaagttagcgtggtggttttcgtagatttcgtttattagtcgttttattttttttagcgagttggtgagtatgaggatgtagttgcgcgttagtagtagcgtggcgattttggaaagtttgcgtatcgaagggtcgtgtgcgtacggtatgatttcgcggaggttatttatggcgatgttgaggtcgtgtatgcgtttgcgttcgcggttgttgattttgagacgtagttgttgtagtttcggttttgttatttgttttttgttttttttggtggacgacgtagtcgtcgacgacgtagacgacgaggtgttggacgaggatgatttgaagttattgttttttagtttgtttttaggatgcgcgttcgtagagtttatagcgtcgcgtagttcggcgtttagtttcggcgggtagttattcggggtggacgaggatacggtgtttttagtgaaggcgttgtcgttgttgtttttatttcgggtcggtagaaaaaggttatcgggttttggcgacgacgggcggttggatattaggttggcgttcgagtttatggttttaggggaagatagtcgtcgtagttttcgtagggttttttttttttcggattcgaaaatttttaggagaggaggagaaaagagagagaatgagagagagagagagggagagagagagagagtgagttagtgagagatagaaaagttgttttcgtttgtatcgtagtattatagcgcggggtttcggtataggtggttcgtggtttttcgtttttttcgttattatttttggttttttttttagttgtacgcgggtatttataattaagttttttttattttttttttgtttttatgtaataggttattttagggagcgttggtgattttcggggtgcgggtggtattttagaggtttcgggtttttagttaggtgtgggaaaattgagttttcgggttggaataaacgagtgggaagtgagggtttttttttggggagaatggagatttagatagagaattaatgatttggttttttaaacggatttattttatttttatcgatattacgtagtaaatatacgtatacgtatatgtatttagagtcggcgcggggtttagagtttatgtgttgtatttggagattacggggagtttattagttgattggggtttgggtagaaagagttgttgtcgtttcgatttttcgtttttggtgagggagatgtagcggtgagtgtggggaggatagaagagtaaagtcgttttggagaaatggttcgtagagtagggatttagattttttgtatcggagtattttgggttatagtcgagttgaggagagtttgtttttgggatttaggttgcggttgttgtggggcggggatatttattttggatgcgatttgaggagttcgtttcgaaaagttttaggggagaatttggtatcgggcgttggtgtcgcgtcgatttataataagtattcgtatttttaggggttcggtcggtttttatagttcggtggtagcggcgacggcggtagcggtggcgggggcgggggcggggaataatgtgcgtgttttggaggggttgtttcgttaatgagttgggttcgtcggggggttgggaagttgatgttattcgggttaatttcgtttaatgaaattcgttaggtcgggtatacgttttttttttgcgtataattaatgggcgttcgtggtcgggagatttttggggagggattggaggagggattcgaggaggcgagggggaggagaagggcggtttaagggggatggagggagggttgagcgcgtttgggattaagggagaaagggaacgtggttaaatttttgtaaaaaatacggttattatagagttaggttgggggatgggatggtttggagattttgtagagtttaataaattaatttgatgttttacgtagtcgtattttttgggatgcgcgcggaaaattttggcgatttaggattcggggttggggttttttttttagttttttttttgtttggtttttcgtcgtttgtttttattttattggttttattaatacgtgggtatttggcgttttaaatgtaaacgatgtttaggtataaagtttttattattttggtgttttattcgcgcgtttaggagatggtcgtggttgtagtttcgacggtagtcggtagcgtttttagttgggggtagggatttgaggggtagagggcgggtaaggagggaggggacggattttagaagagtgttttgaaagaatttataatttttttttaggttgaggatggtgtgggtatagggacgagttattttcgtacggtaatcgcgttagtataagggtagggtcgtgtttgtagttaaatatttttttatttattagtaggggagtcggatgatagtaagtatttttagtgtcgtttttgtgattattatacgttttggggtaggggtaacgttggtatttgtagtttaagtagggtttcgttgtaaaaggttagtaaagagtttttcgttttagtcgtttgttttttggaattgtaaagagaagttttaggtttgggtaaggtttttttacgttgtgggttagatagcgagatggaattattcgcgatcgcgttgggatatgttttatcgattgtaggttggttttgaaatttgaaaatttttgacgatgaggaattaagttcgaattggagaagtattttacggaggtagttgaggtacggatgtatttatttattttatagatgggaaaagttagagatcgtgtgtagtaagtttatagaaaaaattgttaagtttttatagagtagttttgtttggattatagatgttggcgttggcggttttttatagtataggtagttatttgttttttttagtttttaatttttttttcgagttgaattttttatatttatatatttcgaatttagatatttgtttttgtagatttcggatgttagtatttgatattgtgagcgtacgcgcgggtatatacgtatatagttttttagggagtgtgaggaacgtcgggttattttcgttgttggggaatttttattgtgtaagtacggttttaaaaataagtaaataaattagtatagtaaataattggtttttaagtagtaaagttataaaataaataaatataaagagaaatttacgttattgtttttagttttgagatatgtttttttttgcggttttcgttagaagtttagttcgttttcgttttcgttttagtttcgtgttttttggagtattattttttaattcgcgtgttttttagttggttttgtagttattcgttaaatatgtatttaaaatatgaagaattgaagcgtggtgttatgtcgtttaacggttataaggatgatttataatcgtttaattagtagaatttgttattcggacgacgtagggagcgggggggtggggattagaaagggttcgggtatttgtagatgtttttttcgggtttatttcgttaatagtagcgaggttatgtgtggtgcgcgttgtggggttattagtcggggcgcggagttgtgcgtttgttagtgtagttaataaatattagtaggcgtaacgtgcgcgttttttggttgtagtcgttgaggttagtttagtcgtcggtacgtgtttcggaattcggtttttttttttgttgttgtttattggtgtttgttttgcgatcgatttgcggcggtgagagtaagcggttttaggttttttgcgcgttcggtttagtggttggagttgggagttaggggtgaaagtcgaggggttcgttttggtatggcgcgagtttagagtttggaaggtaaagtcggaagttttgtgttgttgttggttttttttttatttggtaggttttttttaatattttttcgtcgtcggagtagtttgggaggtcggggaggtttgtgtcgtttttgggtttttttggttttggtgttaatcggatgttgagtatttttcggtgtgttttttatgtttttttatttcgttttaggaataattagaaattagatttcggtgtttaagtttgttttggtgcgttttggaggcgtttttaggatttgttcgggttttgcgttcggcgttcggggtgggcgatttgggcgggttttaggtattgcggtttttattagcgcgcgtagttggggtttttttttggggaatggagtgtttatttgtagaggttaatgggtttcggtttcgggagtttttggttggttttcgcgttttggtgttgttggtttttttcgtgttttttttttttttttgtgttttttttttataaaagatcgggtgcgtgtcggggtcggtttttgttggatcgtcgggcggttcgggaggagttcgtgttaaatcggcgggttttcgcggggttttagggcgtagattttttattgtttttcgggtttttttcgggttttttttttgatttttttttttttttttttcgagtttttgtttatatttaggttgcgtttcggtttggttgttaaatagaacgacgtttttgcgtagagttgattaggggtggcggcgggaggtaaggttttcggtatcgg

SEQ ID NO: 7484 - DNA, 1423 bp, synthetic construct
  misc_feature 1..1423: note = Description of Artificial Sequence: Synthetic polynucleotide
  source 1..1423: mol_type = other DNA
cgttgcgggataggtttttagagatcgtttcgggacggtcgtgacggttttcgagggatatgagagaagaggagcggcgtttaggtaagttggattttgcggtcggaattcgcgtagaaacgaaaatttttggaaggggtttagtttcgagtttcggaggcggataagttgagttttttggttgtattttttggaggttgttggttgtagacgtcgtcgttttttaagggcggttgttatcgcgtgcgtcggttagattaggtcgcggtgttttcggtattttcgcgtttcggcggttgtattcggtttttttttacgatcgaggtttcgggtatcgcgttttttttttcggacgttttgcgcgacgtcgttttagtttttattagtatcgagggtagttcgcggttattttataaacgttttagtgtcgtaatcgtttttatttttattatttttaatgtttgtaacggtttttaatgaggttggaaaaatattatttttcgttaaaagcgatttcgagttaggaggagcgcgtattttcgcggtttttttttttatatttttttttttttgattttttttttttttttttggttttttttttgtttttcgtttttttagtagtcgcgtgttgggttttttttttgttggggtcggattttttttttcggtcgttttagtttttgttttttcgttttttttttttttttttttttttttcgtttttttttttttttttttttttttttttcggagtcgttagtcgcgttttaaattcgagtagggcgcgtagtgtttaaatttgttcgcgcggttcgcgtttttggtttcgagggcgcgcgtacggatacgcgagtatatttatatttacgcgtatacggatacgcgcgtattcgaagattttcgcgcgttcgtatttacgcgtatttggttacgcgcgtgtattttcgtttacgcgtttttgtttcgttttcggcgcgtatttcgggttcgtaagtcgcgcgtcggggcggtcgttttgtttcgcgattggcgggagtcggagtttttttgaattcggcgtttatattatgggttgagttcgtcggcgtcgagggagttagtgcgattcggttcggcgcgtacggttaaggtacgcgcgttggtatacgcgggcgcggatacgcgcggatatatacgtgcgggatacgttttttttcgacggcggcgttaatttttcggtaagtttagcgttttacgcgatttgttcggtttttacgttggttatagcggttgcggggacggggaggaaggtagcggggtggttttaggggtttattttgtagggttttttcgacggcgtcgggataggtggggcgtttagcgtcgggagggacggttcgttagtgcggggttttagggaggcgcgtgtagtcgggtgcgg

SEQ ID NO: 7485 - DNA, 1384 bp, synthetic construct
  misc_feature 1..1384: note = Description of Artificial Sequence: Synthetic polynucleotide
  source 1..1384: mol_type = other DNA
cgagcgttttttgaagtgacggggtcgggacgcgtagggaggcggtttaagaagcgcgttttaggttagtttagaatgcgttcggtcgcgattaggataacggcgggtggggttgggggcggttgtcgggcggggagcggtttcgcgtttttagttattttttaagagtcgttgtttttttaattttagttgttagaggttttgtgattggttgcggtacgatgattcgcgtacggattggttgtttcgggtcggggggtcgggttcgggggatagaattcgttttcgaatttttaaagagggtatttttcggtaggagttggtagatttaggaggtgcgatagattcgcggggtaaacggattggggttaagagtcgggagcgcgggcgtaaaggtattagggttcgtttagggcgtcgcgtagtacggttttgggggttttgcgggttttcgggtgcgcgtttcgtttttagttatggggttcgtagcgttggagattttgggtttggtgttgtgtttggtgggttgggggggtttgattttggcgtgcgggttgtttatgtggtaggtgatcgtttttttggattataatatcgtgacggcgtagattatttggaaggggttgtggatgtcgtgcgtggtgtagagtatcgggtatatgtagtgtaaagtgtacgattcggtgttggttttgagtatcgaggtgtaggcggcgcgggcgtttatcgtgagcgtcgtgttgttggcgttcgttgcgtttttcgtgattttggcgggcgcgtagtgtattatttgcgtggtttcgggttcggttaaggcgcgtgtggtttttacgggaggcgtgttttatttgttttgcgggttgttggcgttcgtgttattttgttggttcgttaatattgtcgttcgcgagttttacgattcgtttgtgttcgtgtcgtagaagtacgagttgggcgtagcgttgtatatcggttgggcggttatcgcgttgtttatggtaggcggttgttttttgtgttgcggcgtttgggtttgtatcggtcgtttcgattttagttttttcgtgaagtatttagcgtcgcggcggtttacggttatcggcgattacgataagaagaattacgtttgagggcgttgggtacggtcgggttttttttgttagttacgtttgcgaggcgttggataagtttggggagtttcgtatggatcgcggttttcgtcgggtagcgcggcgcgtaggtttttcggaacgttcggttttgcgtttcgacgcggtttttggattcgtttttgtttgcgttcgtagttgatttttttttgttattagttcggttttgtttttaatagacggaatgaagtttttttttttgtgcgcggcgt

SEQ ID NO: 7486 - DNA, 1361 bp, synthetic construct
  misc_feature 1..1361: note = Description of Artificial Sequence: Synthetic polynucleotide
  source 1..1361: mol_type = other DNA
cgtcgaggatgtggttttcgtttttcgtagtcgtcgtaggagtttttgtttttaaagcggtaggtaggggttttagcgggtttattttaatttgggaaggtcggtgcgtttttttatagatttcgtagggcgttttttttggggattattgaagttttggtatttttaattttagttttttcgcgttacgggaaacgaagacgatatttttttgaataatttcggatgtgttattatagaggggtattttatattggtttttattttaatttttatttagtatattgtttgtttattttttaaatttcgtgcggattgcggtatttagtttcgggggattttttagttttgttttttcgattcgcgtaggtgcgttcgtttatttaagggtagggaggtatgttttttcgggttttttcggtcgtatggtttgtttgtttttttggtttttttttttcgtattaggaggggcgtgagatagttaggtcgatttttatttcggtagtttgcggcgatcggtcgtttcgagcgtagcgttagatatttgggttggggggtgttagtttgacgcgtaggaagggcgtagcggcgggagggggttttattttagatttgggaggtttgtttggcgtcggttttcgttcgtttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgagtcgggttttcgcgtttgtgtggtcggttggcggtcggggttcgtgtgtttttgcgcggcggcgtgtgcgtgtgcgtacgcggggattacgttcgttcggagtcgtcgtcgtcgtcgttattttttgttcggggtcgagcgtagcgttttttttgttcgtttcgcgcggcgcggtagtttagtttggtttcgttttgcgggagaggcgtcgttttcgtcgcgaagttaggttgggcgttggagggaggcgatcgattatcgtttttttttgtttattttataggttggggagggggtgttgtaggttaatgagcgttcgggggcggggttagatcgagggcggtgcggtggggggcgcggtggggggcgtcgggttgtttaattcgattttattcgtagtatagattggagtaggagttgcggcgggaaattttagcggcgggggtcgggggcgt

SEQ ID NO: 7487 - DNA, 1175 bp, synthetic construct
  misc_feature 1..1175: note = Description of Artificial Sequence: Synthetic polynucleotide
  source 1..1175: mol_type = other DNA
cggagagtcgggatttcgaagtttttattgtttttgtcgaggcgtcggcgtcgttttttgtgtttttgattacgttagttttcgtcgaggaggcgatattttttttcgcgtttttcgatagcgagcggtcggcgtttagcgtggaggggttcggaggggttttgtacgcgcgcgtggttcgacgcgaggttcggtcggttcgggttcggggcgagattgggggtttgtcgttgtcgttatcgttcgagcgtaggaaatcgtcgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcgaatacggtagttttcggattcgcgatttaacgtcgcgtttttcggggttgttcgaggaggcgatagttttcgttgcgttttcgtcgtttagggttcgagcgcgcgtcgcgtttcggttttttggagtttacggacgtcggcggtttttcgcgaagcgcgtcgaggttgtttttatgttggtcgttgacgtgcgcggtaagattcgtagtttgggtcgcgtcgaggtggttttgggcgcgtagggttttagggaaaagtcggcgtttttatagaaagttaagcgtttcgtgtcgttagtttcgttcgttcgcgcgtttttagcgatcgaaatttcggggtttgagaaggcggcgatcgatttgttcgcgtttgagatttttcggaagaagatttttatttagaagtcgtcgcgtaagaagagtcgggaggcggcgggcgagttgggtagggcgggcgtatttattttgtagtaggttgtggttcgttcgcgcgtagtttttttagtttcgtagcgtcgttcgttattttatattttttacgttatcgggtacgggcggttttttattggtcgggtatcgcgcggttagcggaggttgcgttttattggtttaggttttgtagtcgtttttggattggagtagtgtgttttggcgggaagggtttatttcgttggtcgaggtttgataggcgtttagcgggcgattttttttttattggtcgagttatggagcgtttcgattagatagcgt

SEQ ID NO: 7488 - DNA, 1087 bp, synthetic construct
  misc_feature 1..1087: note = Description of Artificial Sequence: Synthetic polynucleotide
  source 1..1087: mol_type = other DNA
cgtttgtagttcggtcgcgtggaggtgatcgggcggaatttcgagggggcgcggggagagttgggcgggtttatcgttttagcggttgttgttaggggtcgcgaggttttttttgaagatgtagcgtagtatattttgtatatgagtttagaggaagaggaagtgtagtcggcggacgcgcggcggcggcggcgggggcgcgtcggggttggagtcggagcgcgtcgggcgttgggcgtagcgagcgagagcgcggcggtcgcgggtttcggcgagggatagacgtatcgatcgtcggagggatagatatacgattacgcggcgttatcgtttacgtttttatttatcggcgtttaagtttttttcgcgtcgttttttttgtatggtataaatttttttttcgggacggaatacgttgttttagggagttcgcgatcgcgttttttttttcgtcggttttatacggtaggcggcggggggggcgcgatagggtttggggtgtcgatcggtataggttttttcgtttggttttatggatcgggtttttggcgggtagtgggaatcgcgcgtggcgtttttttgtaggttgttttttgtcggggtttcggagttgttagagtagtattttttggttcgcgtcggatggggatttgggttgatttttgggacgtttggattttgggttaatttttttttgcggggaacgggtgtaggggagttatttttggagcgatgtagggagaggtatttcggagtagtttgttgggggtcgtaggttttgtaggtttagaagcgtttaggaaggacgtagaggtgggggagtttggaggttataggtgggtttaggatatattgtcgttggggttttcggaaaagaataggagggagttggtcgcggagtttaggttttcggggtgcgcgcggtttgggtggggtagggtggaggcggtgtttgattgtttttttgcgtgtgttttgggaggtgggtttgttttggggatagaggtgttggacgtgtaggagtagatatgtcgcgcgtttcgaggaagcgtcggaattattagaagtatagggacgcgggtgtcga

SEQ ID NO: 7489 - DNA, 693 bp, synthetic construct
  misc_feature 1..693: note = Description of Artificial Sequence: Synthetic polynucleotide
  source 1..693: mol_type = other DNA
cggtttaggtattcgggtagagggatgatttcgcgttttgcgaaaagtaataggcggttgtattttattttgcgttagtttcgggtcggggtggttgttttattttcgtggtttagggaggaggcgttgggtgcgtatgtttaggggtgtgttcgttgttagggttgtagcggtcgttatttttaattagttgtaagtcgagttgtttatttgggatcgggtcggttcggcgggtttggttttcggcgaaggcggcggcgttggtgcgcggcggttggggcgcgggacgtaggtagtgcgtggcgcggttggcgttttcgggcgtcgttatcgagcgagggtgcggtttcgggcggtcgtgcggggtacgatttggttcgcgttgttgcggcggtcgttgtagattttgttttaggcgtcgtagttttgtaggaagagtagataaagataggagagaggtaaagcgtcgtttgtttagagatgtagtcggtttagttaatagagggaaatcgtttttaaatttaggttgggaatgagggaggaggggcgaggcggttggggattagaaaaagtagtagggaattaacgtgatagttagagtttagttagtgtttcgtcggcgttgttttttcgtttcgcggttgcggggttcggaatggagagaggaggcgggggttgagcgttggttgtcgg

SEQ ID NO: 7490 - DNA, 5065 bp, synthetic construct; identical to SEQ ID NO: 7458
  misc_feature 1..5065: note = Description of Artificial Sequence: Synthetic polynucleotide
  source 1..5065: mol_type = other DNA

SEQ ID NO: 7491 - DNA, 307 bp, synthetic construct
  misc_feature 1..307: note = Description of Artificial Sequence: Synthetic polynucleotide
  source 1..307: mol_type = other DNA
cgttttgggggcgatatcgtcggggaatttgatgatgggcgacggcgcggcggcggcgtggtttagtaggtagtttaggagatagagcgtttttaggggattcgtgagcgcgtttcgggttattagcgtttttatcgtagcgttttttggtttcgcgcgtcgttcgggggtcgttggttcggtgcgtgtggtcgtttcgtcgtttggttggagtttgtttcgcggcgtagggttgcgtttcgagggttcgttggttcggtggtttggggtttgttcggtttagcggtttatggttcggttttcgcgt

SEQ ID NO: 7492 - DNA, 1563 bp, synthetic construct
  misc_feature 1..1563: note = Description of Artificial Sequence: Synthetic polynucleotide
  source 1..1563: mol_type = other DNA
cggtgttttcgtagttcggacgttagcgttagggattcgttataattttaagttttttttcggggttgggtttcgtatataaataggtagtataaaattaggatttagttggggttcgtatttttttttgtttagattcgagtcgttttagttttcggtcgtcgcgttcggagttcgttttaattcggaaagtggcggtcggttgcggggtaggcgggcggtatttgtgagtagttttagtcggtgttttagtatttttatttcggcgttcggcgcggttcggttttgggtggcggcgtcggggtagcgcgttcggtcgagtcggggagaggagcgcgggagattcggagcggagcggtaggagagcgcggagcgaagcggtaggagtagtttatagttaggagcgttttttcgtttttaacgtcgcgtttttttttttaaaacggtttaaaaaaatttattaattgtatggtcgcgtatttttaaaaaggtattcgtcgttatttggtttcggtgaattttaggaggcggaggaagggcgcggggtgggtgcggtgatatcgtgggaggtggtttttcgtgttcgtcgttcgaataaagagatttcgtcgttttcgggcgtcgcggtggggggtcgcggacggcggttgggggtttttagcgcggtcgggaaggcgaggaaggagagcgggagtcgcggggaggagggggcgtcgttttcgcggaggcgaaatggggcgggagcgagtcggtgcgggattcgcggggttagggtcgtgcgtggggttggggtcgtgttcggggttgggttgggttgggcggggacgcgcgtagtagtcgcggcggcgagagaagttggttttgggtttaggggcgagggcgtcgtcgatttatcgcggagatgcggacgagatagacgcgtaggcggggagcggggtttcggcgtcgtcgacgcgcgggtgtaggtgcgggtagttaggagttttttcgcgtgttcgcggttgtaggggcggaggtcgggttgggggcggtgcgtcgcgggggcgtgttcgcgtgggtttggcgggtgtgggcgttcggttcgcggggcggtgtcgggtttggggttagtttcggacggatcgcggtttttcgcgcgtggttttcgttttttgcgcggttggggtgttcggtgggcgggcgggagggcgagcggggatcgcgacgcggagtttgggggatatttcggtcgattcgcgttttcgtcgattttttattcgtttcgtcgcgcggattgtgttgggtgcgttgcgaggttttgttcgtttttttaggttttttgtggtcgcgcggcgtcgggttttcgggggaggggacggcgttgtcgtagtttttgtttagatttttaaggggaattttagatttgtagagatatttttattttagcgtttttgcgtttgttgtttcgcgttattcgtcgtcgtcgtttgggaatcgagggagaaaagtttttagggtcgggaagaattaggggtttaggggtttttggggcgtcgttttttttttttcgttttcggagttcga

SEQ ID NO: 7493 - DNA, 512 bp, synthetic construct
  misc_feature 1..512: note = Description of Artificial Sequence: Synthetic polynucleotide
  source 1..512: mol_type = other DNA
cgattcgaggttgtttattcggtttggtatgtttcggcgtttttggggtttttgtatttcgttggtttttcgttgtggtgtttcgtagttcgattatttttgtgtttttaggagtttattttgggcggtagggaggcgttgcgtggggtttacgagttttacgttgttatttttattagtttttattttttaggcgtttgttttttcgtattgttaggttttgttttcgtagtatttggtagatttgagttcggtttttgttattttttcgcgggagttttatagtgattttggaggagaagtagtaggagtttataggttatcgcgttcggtcgcgcgtgaagtttgtgtagtcgtatggtcggttcgttggtttcggttttttgtcgacggatacgttgttgtttatttagaggttgtttcgggtcggtttagtcgtggatttagtgttttgtttagtttcggagtttggattgggtagggagtcggcggggtgcgttgatttgggtcgg

SEQ ID NO: 7494 - DNA, 1070 bp, synthetic construct
  misc_feature 1..1070: note = Description of Artificial Sequence: Synthetic polynucleotide
  source 1..1070: mol_type = other DNA
cggcgttcggggttcgattggtgggaggggttcggtagaggtttcgtttcgagattttagtacgtttcgtttcgttttacggtgtagtatagatttcgcggagaacgcgagtatggtcggaaattatcgtttttattttttggcgggtttcgagggaaggtcgggaacgggcgggttttgttggtttagagggcgttaggggtagttatcggcggttcgggatttttttcgtcgcgagcgcgggggagtttaggttcggtttgtcgggggttgggtgaggttgcggattaggtttttacgtttttcgcgttcgttcgcgtttgttttaggtttttatcgcggttttttttgttttcggggtcgttttgttttttatagattttattttcgggggtcgtttttaggattttcgttcgtttttttttgattcggtttttgttcgtttcgtttttttttttcgggttttttatttttttttcgtcggtttcgatttcgggggcgtttcggatttgtttttcgaatatttttagtttcgtttttagtttgcggagaaggggtcgaggagataggaggaagagagcgagagtttaggggacgaggaggaagttatcgagacgcggagattcgacgacgtcgagggaggtataggtcggggaagcggtagtcgggggcggagcgggggatttgggcgggttttttttcgttttgtttttgtttttttcgtttattttttttttttttttttattcgttatttatcgttatggcgttttcgattttaggcggcgagtgtagtcgtcgttttatttttcgtagtttggcgcgtattagtttttttgtcggtgggcgggcgttaggggtagggtcgaggttcgggtatattttttttttttcgtttatttggcgcgggaggtttatttttcgagagtagttgttttttgtttttttttagggtacggatttttcgggttagtcgttgttttagtatttgcgaggataaagaggaggttttttcgtttggtcgtttttttggttatacggttcgtttttttttttttgtgtttttcgcga

SEQ ID NO: 7495 - DNA, 766 bp, synthetic construct
  misc_feature 1..766: note = Description of Artificial Sequence: Synthetic polynucleotide
  source 1..766: mol_type = other DNA
cgggaattttacgtttttgtattagttcgggggttcggacgagttcgggagtcgttggtcgttaattatcgcgcggtggagaggcgggcgttcggtttcggcgcgttgggggagttagttggcgttgttttttttatcgttttagacgtttatatcgatatagatagacgtatagacgggcgggtagatatcgatagttttttaatcgtttgcgttttagtttcggtttagggagtttttcgtattttttggggtgtcgtaaattgtagttcggtaggttcgcgtcgggagaagggagggcgcgtaggcggtcggaggaggggaggttttagcgcgttttcgttgcgatgtgaacggcggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggtggtagggggcgttcgacgttagtttcgtcgcgttttttacgcgcgatgttatttttttttttgtaggcgttttagttgtgttgtttttgttgtgcgtcggtcgtcgcggttttagttagtgatagtagtagcggcgttagcggattaaatgatggttcgt

SEQ ID NO: 7496 - DNA, 363 bp, synthetic construct; identical to SEQ ID NO: 7269
  misc_feature 1..363: note = Description of Artificial Sequence: Synthetic polynucleotide
  source 1..363: mol_type = other DNA

SEQ ID NO: 7497 - DNA, 2919 bp, synthetic construct
  misc_feature 1..2919: note = Description of Artificial Sequence: Synthetic polynucleotide
  source 1..2919: mol_type = other DNA
cgagcgcgtaatatgagttttaaaggttaaatttcggttagttaggagtcggaaggttgagttcggttgatttgattttgagttttttcggagttatttcgtataggcgttcgttttgtttaagggtacgcgacgttagcgggtagtcggttttcgtgaagaatggtttttaaataatttattttatttcgttgtaaagagagggataaaatgggttttttttttttacggatgtttagttttttgggtaggcgtatggtcgggcggcgtttagttcgtagtttcgattcggatattttattgtattttttttttttcggtttttttttcgtacgggcgttcgagagacggataaagagttggggttaagtttgagcgtcgggtacggttaggtttagggaaggaaggttttcggtagatatttgggtattagagttggtgcgaggaggaaaagttgggaggcgaatttataattttgggggtggagggtaggtaggggaggggaattaggttaattttagtcgagtgagtttttagcgagttggggtttcggatgggaggtttgtttcgcgttttaaagaaaagtaaatcgtttttttaggttcgttcggattgtcgaagtttttttggaaaaattttttttttttttatattaaattttgcgtcgggtttcgttttttttcgggtaggtagcggcgtaggaagggttaagttagttcgttttagttgatagttagttgattgggttttgattgatagtttcgaaaagtttttttgtttttatattattatgttaatcgcggtcgttttcgtcgttttttattggttcggagtgttagttaattttttatttggatttgacgttacgagtgttataaaatttagtaattgttttaaattttttttgttggattagaggttttaaaatttttttttattttttagttgtagttcgggttgtttgtcggtttggttttttttttttttttttgttttttgtttcgtttttttttaggatttcgttattttgtttttttaaaaaaaggtaagaaagaattaaattttttttttttttttttttagtcgggttgtatttttgttttgtattttgtatagaggtagagagcgcgcgagggagagagaggaaagaaaaaaaataataaagagagttaagtagaagaggaggcgagaagtatgaagtgttaattttttcgtgttaaggttcgcgtcgttcggatagacgttcgtcgcgtttttagtttcgagcggacgtcgcgcgcgttttgtttgtagttcgggtcggcgaggcgagtttttttttatgtaaagcgcgtagcggagcggcgagcgggggacgtcgcgtatcgggtcgggtttttttagtttcgtcgtcgtagttattatcgtcgttatcgtagttcgcggaggattttttcgagtttgaagtcgtcggtttggcgcgtaaggaggcgagcgagtaaggaggggtcggggcgagcgagggagtatattggcgtgagtaggggggagggagggcgggcgcggggggcgcgggtagggcgggggggtgtgtgtgtgagcgcgttcggaggtttcgggttagttatcgtcgcgtaagttagaagcgttttagttcggtaagttggtttattcgttggttatttagtatagttcgttggttttttttttgtagtttatttggcggagcggcggcggcggcggcggcggcggtaggagaatggtattagaattggtaatgagtaatttcgatttgtttattagttttttggttatggaatatgttaatgatttcgatttgatgaagtttgaagtgaaaaaggaatcggtggagatcgatcgtattattagttagtgcggtcgttttatcgtcgggggttcgttgttttttatttttatgagtacgtcgtgtagttcggtgttttttttttttagtttttcggcgtttagttcgggttcgggtagcgagtagaaggcgtatttggaagattattattggatgatcggttattcgtagtagttgaatttcgaggcgttgggttttagtttcgaggacgcggtcgaggcgtttattagtaatagttattagttttagggcggtttcgatggttacgcgcgcggggcgtagtagttggtcgcggcggtcggggtcggtgtcggcgtttttttgggcggtagcggcgaggagatgggtttcgtcgtcgtcgtggtgttcgtcgtgatcgtcgcggtcgtcgcgtagagcggcgcgggttcgtattattattattattattattacgtcgtcggttattattattattcgacggtcggcgcgttcggcgtcgcgggtagcgcggtcgtttcggtcggtggcgttgggggcgcgggcggcggtggttcggttagcgttgggggcggcggcggcggcggcggcggcggaggcggcgggggcgcggcgggggcggggggcgttttgtattcgtattacgtcgtcggcggtttgtatttcgacgatcgttttttcgacgagtagttggtgattatgtttgtgcgcgagttgaatcggtagttgcgcggggttagtaaggaggaggtgattcggttgaagtagaagaggcggattttgaaaaatcgcggttatgtttagttttgtcgttttaagagggtgtagtagagatacgttttggagtcggagaagaattagttgttgtagtaagtcgattattttaagtaggagatttttaggttggtgcgcgagagggacgcgtataaggagaaatacgagaagttggtgagtagcggttttcgagaaaacggttcgagtagcgataattcgttttttttcgagttttttatgtgagtttgatacgcgattttagttagttattttgataagtgtttcgcgggggttcggttcgg

SEQ ID NO: 7498 - DNA, 2267 bp, synthetic construct
  misc_feature 1..2267: note = Description of Artificial Sequence: Synthetic polynucleotide
  source 1..2267: mol_type = other DNA
cgggcgggggagggggtttgtcggtagagaaagtgcggagagggtagagtagcggttcggggcgtttttgtaggtggatatgaaacgtacgatatgtaaatgaatgtaaagtgtatgtaaatgatttggtttcgggattcgcgggaagcgagggtttcgtatcggattcgttcgggaggttgagcggggggagcgcgatttttgtcggttacgtacggaggtggttttgggtcgggttaggcgtcgcgttgggggcgagcgcggggtagggggcgggggcggcggtcgaaggagcgattttttttttaattttttatttttttattttttttatattttttaattttcgtttagtttttcgcgcggtcgttagaagtcgcggttttaaagttgcgaggttcgcggtcgtcgattgttgcgaggtgggtgtgcgcggtttgcggagggggagagggtgggcgtaggcgggggtcgttttttagagtcgcgttttttttacggcgttcgtattttttaattttttcgttcgttttcgtttgcgttttttcgcgtcgtttttcgtaggaggcggcgcgttcgtcgtttttttttcgcgttttttttttttttttttgttttcggcgtttcgtatagtttcggtttttatggttagtttttagggcgtcgtttcggtggcggaggcgttgggggcggttttcggcggcggggagtttttttttaggtcggcgtttcggggcggagttgagcgttatgggcgtcgggcgggaggtaggtggcgtagcggcggcggcggggggtaggaggcggaggcggagcgcgcggggcgggggtcgcggggtttcgtgagattttcgggcgagcgcgcggcgttggagttataggcgcggcggttggattcggcgcgggtcgcggaggtcggagatcgtttcgggcggggtgcgcgttttgttttcgcgcggggtggtcggagtcgagttttcggtatggtttaggcggtcgtttcgcgcgttttagtttcgtcgcgcgtttgagttcggtgcggcgttagaagatagcgcgtagtcgtttttgagtcgtggaggcggggattaagttggaaggagtagcgattttcggatcgagtcgcgagtgtgcgtcgttcgtcgttcgtcggatttttcggatttttcgatcgtaagtgtcgtgttcgtttcgcgcgtcgtcgtcgttttatttcgatttcgttcgcggttgtcgttttcggatttgcgtcgtagtcgcgtcgagcgtacgggtcgtttttaaagttggtgtttacggtagggtggagttaattcgtttagcgtttatttattcgggttgagcgtagtttttcgtgagtagagtttgatttgcgggggttgcggcgaaatttcgaggggaacgacgcgttcgggcgttgggagtttcgcgggtttttttggggtcgttcggtttttttaataaaggtttcgcggttcgcgtgacggagattcgggagtggggaggtcgagggcggttttgggagaggtagaggtggcggcggtcggtttggggaggggggtttagagtttttttttgttttttttttttttgttcgggttttcggcgttgtttcgtaggttaaaggtggttcgcgttgggggttttggattttgtttggtatgcggtttttggggttttgacggtcgcgggtttcggtatagtcgggtggtagcgatggcgcgtatagtttttgggaagcgtttatttgtgttgggtaggtttcgagttaggttgtgggaatagcggggagggaggtgtgagtttttgtggagggatagatggttggaaacgtagttttagacggttgattttatttacgtggagtagaaggcggttaggttggtggcggcgatttagagtcgttgggtttcgaatatattgcggggttggcgttttttcgtttttgcgttcgttcgtgtgtgttggggtcgcggtcgggttgtgtttattttttatttattttgtgggttgaggtcggttgattttaggtttattttagggtttaggaagaaaaattttttttttgaaaagagagtacgtcgcgtgtttttgtgggtgggggtttgtcggtagttgttaggtttgtggttttagttagggtgcggtttttgtgcgttcggttcgggtgtgcgtttttttttttggacgaggaataggaggtttttagggtagttatttcggcggacgggtcggtcggggataaggggcgggggtcggtttttcgg

SEQ ID NO: 7499 - DNA, 265 bp, synthetic construct
  misc_feature 1..265: note = Description of Artificial Sequence: Synthetic polynucleotide
  source 1..265: mol_type = other DNA
cgtagtttgcgatcgatggagtaggaggcgcgggtgttgagagttgcgggcggttttggtcgggttcggcgtttgttggttttcgtttcgtgggtattttgtatagtgttggggttggtgttgagtttcgaggagttgtttatcgcgtagttcgcgttttattgtcgatcggattttacgttgttgtttttagcgttgcgcgttttgcgcggattcgcgttgttggacgtcgttatttcgcgtttggggtttacgcgagtcgcga

SEQ ID NO: 7500 - DNA, 374 bp, synthetic construct
  misc_feature 1..374: note = Description of Artificial Sequence: Synthetic polynucleotide
  source 1..374: mol_type = other DNA
cgaatagcgttttgaaacgtagaaacgtgtttattcgaattgttaacgcgagcgtagagtttattgataaagtaaaataagataaatcgggagttagaaaatttagcgatttataggatttatcgtgatgttttttataaatgttatcgcgaaaatagtcggatttgaaaataaacgcgatttatttggttttcggaaggggagaaggattcgggcgaaaggcgttagttttttttcgttcgtttcgtagacgtagcgtaggtttcgagttttcgagcggcggttttagaattcgcgggttattcgggagtttttttcgtagtattagtcgaaagtttttagcgtcgaggagggcgggcggttgtttttttcga

SEQ ID NO: 7501 - DNA, 1133 bp, synthetic construct
  misc_feature 1..1133: note = Description of Artificial Sequence: Synthetic polynucleotide
  source 1..1133: mol_type = other DNA
cgaatagcgtttttaaatttagaaacgtgtttattcgaattgttaacgcgagcgtagagtttattgataaagtaaaataagataaatcgggagttagaaaatttagcgatttataggatttatcgtgatgttttttataaatgttatcgcgaaaatagtcggatttgaaaataaacgcgatttatttggttttcggaaggggagaaggattcgagcgaaaggcgttagttttttttcgttcgtttcgtagacgtcgcgtaggtttcgagttttcgagcggcggttttagaattcgcgggttattcgggagtttttttcgtagtattagtcgaaagtttttagtgtcgaggagggcgggtagttgtttttttcgatttcgtttcgttcgcgcggacgttttcggttttacgcggggattatttcgggattttcgtcggatttcgcgcgttcgcggttaatttgcgtgtatttgcgtttcgcgttacgttttcggcgttttacgtttagtttttattgggtttcgttttttagtggttttaagtttcgttttttcgttggttatcgtaagtttcgtttttcgaggtttcgtttttgtaaggttcgtttttttacgatttaggtttcgtttattacggttagttcgggtttaggtttcgtttcgatacgatttaggtttcgttttcggttagtttcgtttttcgcgcgtttcgtttagtaattttcgttgaattcggcgcggtttttttagcgttgttttacgtcgtagtttagcgtttggagttcgcgcgtttcgagtttttgttcgtttatgcgtagttgggttatttaggtgtatttatttttttgttgtttcgtcgttttttttgtttttatttcgtttaggttttgggtgttttttttttattttttttggcgtttttgttttaggttatttggtcgtttttttgggtttttcgttcgggggcggtttttggttcgacggtgtcgtagacgcgcgcgtataggttagtttcgcggagaggttgtttttaggggttaggcggggggttgagttagaggttggggtttgttaggagcggggcggtttggggcgtagtagtattggagttgaaggcgagggcggttcgcgtcgg

SEQ ID NO: 7502 - DNA, 2358 bp, synthetic construct
  misc_feature 1..2358: note = Description of Artificial Sequence: Synthetic polynucleotide
  source 1..2358: mol_type = other DNA
cgggattcgttttttaagcggcgttttttttatttttcgcgaatttttcggcggggtttgtgtggattaagggagattagagatttttcgtcgttattttatttaggcggagacggtttattcgaattcgtacgggtttttttttttttttggaatttgtagttggtttttttcgaatgtttgttttttttttttttttacgaaagaatagtgttttgggattcggggtgcggggtagtcgggttcgttggagttgtttagtgcggggaagagtcgtcgagattgggagaaggggcgttggttagggaggagacggggtagggagcggattcgcgattcgtattttgggcggcggttttcgcgttttagtcgcgtttttcgatgatttttagtcgcgaagggcgagcgggcgggggttgggttgcgggttcgggttttaggaggtttgcggggtcggggaggggcgtggagtggttcgaggatcggtttggggattgggggtaggtgtttggacggacgcgggtcgagtatttttttcgggggcgggcgtagtgaaaatattttgggaggcggcgtcgcgcggttgagcgttgttgttttgggaataggacggcgttcggtattgcgagttgagagtatttttataaattttgtatgggaggcgtttcgtgagcgggggcggggagcggagcgagagggagggagttagagagtaagggagggagggaggaggagaggagggggaagtcggggggaggaagggaggcgtttcgtttcgtcgatcgttcggttttgtaaacgcgcgtcgggcgtttttttcggagttcggcggtgcgtgcgagcgtttttttgttgtagtcgcggcggcggtggttcgagggggcggagaggagggggttgcggtcggtcggttagggggcggcgtttttttttaaaatcgtttgcgaagtgtttcgggtggtagaagtaggtcgtcggtttcgcggagtaagtcgttcgtttcggggttgagtaagcgcgcggggttgtcgggtagtattacggttgtttgcgggcgtcggtgttttcggcgcggggttggagtttattatgtttttgcggggtcgggttatcgggtacgagcggattttcggtttgttttcgtttcgacgcgttcggattagttgtagttggcgtttagggatttgaatttggatttcgggagggagtgcgtttaggtcgatttcggagcggcggtttcgtggttaatatgtttcgtaaaggtgagttggagtcgtaggggtaagttgaagttgaatgcgtttcggaaagagtcgcgagttcgggcgtcgttcggcgtcggggttttcggtttgggaagtagttttcggcgggttggtgggttttgtcgggcgtattcgtcgaggggttgttgttggggtttagttttcgttagcggttagttgtgagatacggggttttttttatggatcgagtggttaggtttagagattcggttcggaggggttagtcggagattagagtgagcggtcggtggtggaaggggagtcggttttttgggatttttgttttgttgggataaagttttgtatttgtagtttttattttttgcgcgggtatacgtttttgtttttgtcgttttgtggaggtcgagttcgtacggcgttttcgtgtagttagcggttagtgatcgcgcggttcgggcgtttttcgcgcgttttagttttttagacggggttcggacgcggacgttttttttgtagttttgttttgatcgttagggatgggttttgggtatttagcggttgagggtggggagcggttagcgtttgatgtttagttttttaaatttttattatgttgggagcggagggacgcgaaagtcgtgtcgttagtgtgcgcgatcggtgtatagtttaatttgaggatagttggtttcgcgattatcgtagttagacgttttagtagttcggttcggtacggagcgcggtaaagttggtgcgggtatcggggaagtttcgtcgcgtttttacgtggttgttacgcggggcgtcgtttttcgggttttgggagggtaggtgattacgtcgggagtttacgggtttcgttattagttgttttagtttttgcgtttgtttttttttttttaggttcgagtaggttgtggcgtttcgtcgggatttttttcgcgtttggttcggttaggaggttgagaagtcgcggcgtttgcggttggttgtttcggttttgcgggagcggttgaggcgggagtttaggtagtcgaggggtttgatttttgcgttttacgttttagttttaattcgtttttgtttttatggtaatagatcgaggtgtcgt

SEQ ID NO: 7503 - DNA, 1050 bp, synthetic construct
  misc_feature 1..1050: note = Description of Artificial Sequence: Synthetic polynucleotide
  source 1..1050: mol_type = other DNA
cgggcgggtagttgcggttgttgaggttcggtggggtttttttaagacgcgtgttcgtatttgttcgtcgggcgtttgcggggtgtagcgtttattggagcgcgatagtttttgggatagaggaggatagtggtttcgtttttttgtgcgatcgtttaggagtttcgggtcggagagtgcgagcggggaaaaggggttttgtatttagagtggggcggacgtggcgaggaagttaggggggatcgggaagcgaggttcgcggtgcggagggcgcggggcgtggggggatatttttcggagagatatcggaggggcggaagtaaggagatggaaaggagagggagatcggggagatagatttgagagatttagaggtttgtagagagttttattcgggattttttagagtttaggaaagagtagatgcggacgcgggagggcgttttacgttaaagcgggtagtattagtgattaaaatacgtttcgtttggtagtttcgggacgtatttttgtttcggtagcgtaggagaggtttggatagcgcgagatgttagggtttaggttgtttttagagggttggttcgaagcgttggagtttaaagacgttttttatcgtcgtcgggtggtagaattgggggtaggcgcgttttatagatttcgaggggtggtttcgttttagggtcgcggggaggcgttttcgtgcggggcggagttgttatcgttttttttttaattttcggggattgtggtttttttttaagttcgcggcgtttttagttgttttttattcgtttcgttcgttagtttttttttcgcgcgatggtttcggcgttgagttatgtttttaagtttaagtttttcgtgattttgttcgttatttcgtttttgttgttgttattcgttattttgatgttcgttaaggttagttgtatttttaggtagtttttcggatattcggcgttttgtgtttattaacgggtatcgatttcgggagttttgagttggagcgtacggatttcgcggggagtatagttttttcggggcgcgcgt

SEQ ID NO: 7504 - DNA, 1731 bp, synthetic construct
  misc_feature 1..1731: note = Description of Artificial Sequence: Synthetic polynucleotide
  source 1..1731: mol_type = other DNA
cggtcggttttagttgttatttaggtaatttcggagtcgtcgtagatatcggatttattggaagggggcgaagtcgcggggaggaatgggggatattggggaaggggcgtcgtttttgtcgttttcgttttttttagtgttattgggcggttgttgcggagttcgcgttattttttttttattttatttcgttcgtttggtttcgtttggtcgttggttcgcgtttcgttgcgttcgttcgggggttggttcggttcgggtttttgacgttattagtaagtttgttgttttcggcgttttacgtgtggcggcggttagcggcggtttaggaggtagtcggtgagcgtttgcgagtagagtggcgggggtcgttgataggtttcgcgtagtttagtttagtttagttacgcggtttataggtggggtttaagagtagtttggagtaattcggcgttacggagaggggtggacggttttgtacgggttttttgtttttcgttcgggtagagggattcggggggatttcgttttttggttgagagaatttgaattcgggcggagagaacgcgtttaggcgggtaaggggattagagaaagtcggggttggaagttattgtcgttcgttattgtttggagcgtacggagcgtagaggttcggtagtcgcgcgtgtttttacggggatcgagttagtgatgtaggatcgttgagcggagattcgcgtcgagaagtttttcggggtcggggttgagacgtacgttttcgatatcgttgttaagatttcgatttcggcgatttttgcggggaatcgaggggttaaggttgttttaagtttaggatttgggcgagtttaagacgatggttttttaagtacggattcgcgttttttttttcgttttttcgattggaggtagggattttgcgcggggttttcgggatttcgttttttcgcggagtttcggtcgttgtttttcgggatagttcgtacggttataggggcgtacggcgatgtggttttcgtttagcgcgttggttcgtcggggggatgttttggtatttgtcggggtttaggtttagtatggtcggcgcgttgttcgacgtcgttttcggttaggatggttttttcgggttcggttagtgttttttttatttcggtcgagtcgttgtttcgtagtatttttcggaagtttttgttgatgttttgttttttgtttacgtttttttacgttttttattgtttggtcgagcgttgttagattttgttcggtttcgtcgtggggttgttcggcggcggcgaggaggcgggggtttttggtggcggcgttttggtcggaggttcgagggagttggcggtgtggtcggcggcggtatagagaaagcgttttttgtaattgtcgtagtggcggaggcgtcggtcgttcgcgtttcgcgacgacggcgaggaggcggtttgggaagaagagttttttggtttgttagggggttcgggcggtttcggggtcggaagtatcgtggtcgaggtttcgtcggggattttggcgttgtttttggacgaaggtagtaagtagttgtcgtaggttattattatcggagtgaagaagggcggtacgcgggcgttgttggagtttttgcgcgtgtatttcgacgtgcgcgtcgtgggcgtcgagttttattttttcgatcgtagttacgataagggtttcgtttggtatcggtgagcggggcgggttcgg

SEQ ID NO: 7505 - DNA, 3535 bp, synthetic construct
  misc_feature 1..3535: note = Description of Artificial Sequence: Synthetic polynucleotide
  source 1..3535: mol_type = other DNA
cggtcgcgttaggagttgttggtgtagtttaggaacgtagtgtttggggttagttgcggtatttatagtgggttttttcggtagttcgattcgtcgggttatcgtttcgggttttgtgttttttggattcgggagttttgtttgttagtttagggagatggttcgggaggacgaagaatttttcgtttttcgcggtttagttaagtttttgcggtcgttcgggtttagtcgttatgcgtggtcgttcgtagcgtagttttcgggcgtaagtcggtagtcgaatttttcgggttgcgttgttcgttgtaggcgcgcggcgagggtttttacgcgatttcgttttttatttagcgttttttagttaattaaaaagaacgtggtaggtggagggtagtcgtttaagagattgcgtgagtttttttgtggggatttttatagtttgttttaggtgttttaaaatcgtttgatattaagggtttagttttttttttgttagttttttttaattcggtttaagtgtgtttgattttagaaaattttaggttgtttcggggttttggcgggttttatttggaagggcgttagttatagtttgtcgtttggttttggaattattattttaggaggagggggagtggtggtggtagaagttataataatataatcggtgataatagttaacgattagagaggtttttacgtgtttgcgaggtattttatcgtattagcgtatttattttttttatttttgtttagaatttgtattatttttattgtatagatgagagtattaaggtttacgcgattagttaggacgtgaatttaggcgtcggattttagagattttatttttatttattagtgtttcgagaatgggttatagttcgggaacggtgggaaagatgattgttacggttggttaaatttcgagatttgggtaatttttgataataataaaaaattattaaggataaaggggaaggggtaggacgaggttgggaagggagtcgttttaattcgcggggttagtttttttttattttttaatttatttaggtttcgatagtggggtgggtatagggagaggggtttagttattttttttttttttgtttttttaagttttgagcgtttgtgaagttaattgggtttggaggggtgtttgaatgtcgtgttggttggggttacgggtggagattttaacgaaaatgtgggggtcgttatttgggtttttagtcgaagatagttatcggaggtcgaaatttagattttttgtttattcgcgttttattcgaagttcgggtaatttaatagtttattttaaagattagtagttgcggaaagtagtgggtagaggtagtgattgtgatttcggggttattgtttttttggaatttgattcgtaattcgattcgagaatagaattttcggaagtcgcgatttcgaagtaatttttattttttaattaatgggtttcgaatattttttgtttcggacgtgtaaaagtttcgcggagatacgcgtttttgttttttttattttagtatcgagggtagggaggcggaaacgggcggcggtgttcggaggttcggacgtttttaaagtttcgcgtcgttttagtcggttgtagtgcgcgtttttgttcgatagggattagtatagttttacgtttcgcgcgtcgttcgttcgttaggcggaggcgtcgggttattcgttcggtttattttttcgagtttaggcggttcgcgagcgaggcgggtttgatatttttggggtttcggtaattaggcggattgtaataaaaagttaatagattttgcggtttcgtcgggacgtcgcggtttttattttttttttttatttgggaagtagaagttgttttagaagttttttgagggcggagatcgattaaaggggtttagaatatttttagcgtttcgggtttcgggaggaaaaaatttaaaacgagttataaaatacgattcgagtcggatatttttatggttagagggtggttcgttttgttgagggcggttttagtcgttgttttttttttttgcggcgaggtcgtttgatgaatttaagggtattagtgtttcgcgagaattttttgtgggttgtgacgagaattaagcggagcgtaatttttatcgtattcggataggatgcgttgcgtaatttgtcgtagtttttttgttttatttcgggtggttcgaagttgtaattttgttaattttttattatacgttatgttttttttagtttagggtttgaatcgacgatggagattttgtttttggtagggaaatttatcggtattaagcgaggtttttgtcgtagttgcgatcgaagaaatggggttcggcgtttacggcgcgtacgtcggggtgtacgcgtagaaattttagtagcgttcgcgtgtcgtttttttttacgtcgatgatgatggtttgcggtagttgtttgtttttagatttattgaaaaagttggagatggggtttggggagttcggtatttcgggattttgttttttcgggttcgtagcgttttcggttatttttttgtttgaagttagtggggtggttggcggcgttcggaacggtagtttggggggcgtttcgttcggagttgtggttagggttggcgggtcgtgtgcggcgcgggatttagagtttaggagtagtagtttcggcgcggcggcgtaggagtcggcgtacgagtataggaatatatagagttagacgtagagtatggcgaagagtagcgcgagttttttttttatcggcggcgggggcggcggcggttgcggtaggagtcggtcggggatatcgaggtaagatttgtcgttatttaggcgttgttttatgcgttgttcgcgggcgcggttagggatatggtttagtatatggcgtgggtttcgtcgggtagtgagcgtagagagggtttttcggtacgttggacgttcgggtggttcggtttattgttttcgtgtgttcgcggtcgtcgttgttgttgttgtttttttttaggtggcggcggtagttgtagcggcggcggtttttgatatgttgttcggtaggagttgtaattggaacggaaagtcgggacggcggtaattgttgggcgagggtttgttttcggggcgcgacgacgcgttcggggttaggaggacgttgtattttcgcgttttggttattttagattgtgcgtatcgtcgtacgtcggggttgtttttttgtagttttaagaattgagtttcgagtagtttcggtattttttcgtagaggttgtagaggcgaattgcgtaggaagagagttgtggatcgaggtggagtgggcggtttcggttttttagagtgacgggttgttttatttattaaaaatttcgaacgttatgtaaatataggcgttttttcgagagtttagtagttaattcgtttttaggacgagggggtgtggaaaggtttttgggcggtgtagggcggttaggggttgttattggtttcggaataaggggcgggtttaaaggggcgg

SEQ ID NO: 7506 - DNA, 2896 bp, synthetic construct
  misc_feature 1..2896: note = Description of Artificial Sequence: Synthetic polynucleotide
  source 1..2896: mol_type = other DNA
cgattttcggtcgcgaatttaagtttgtcgttttcgtcgcgtttattttttagttttttttttgtttcggcgttattttaggtcgacgtttttaattaaaataagttttttttttaggagttttttttttttgttcgaggtttagggttagtagttttaggagggattttttttttattttatttttttcggtagaggtgcgagattttattgttagtttggttattcgatcgcgcgtgagattggggcgtagggtaggggggttattgggtaggttttcgtgcggggagtggggaggggtttttaggggaagtgtttgaagttatttttgtagttttgtttagattcggaagtcgtcgaggaagggaggaaggcgggggtggggagagcgcgattttaagcgttggcgggcggcgaggaggggtcgtagcggttcgaggaagcgtttggaggcgttaggggcgtcgagtttttagggaggtcgcgttttcgggaagttttttatcggttgttcggagtaggatcggacgcgcggatcgtttttttcggttcgattagtttcggggcgtagattgcgaatttgaatagaattttttttttttttggtatttttcgtttttttattcgtggttattagtttcgttattttagttttatgtttttcgttaatattatattcgttaagatcgtttattaatgttttgtggaggaaaggggaggggggaatttttagtataattaaattgtggttaaaagcggttaaaaaaaaaaaaaaaaaaaggaaagaaagaaatttttttttttgagatcgatttttttaattagcgtggaaaatttttaaatatgtaaattcgtaattttagttaagattttggcgtcgcgggaggggtgttcgcggcgggcggcgattttagtttgtagtttcggatttcgggtaggtttgcgcgcggcggcgggtcgggggttcggggagttttggcgtttatagtagttcgtcgaaaatataaagtttcgtcgttaataatatttgcgggttttttttgggtttttcgggcgtcggcgttgcgcgtttcgtcgtttttttttttttcgtcgttttttttttttcgcgtacgttttttttttcgttttttttagaacgcggtggttagatgagatttttgggagaaataaatgtgagcgttcgtacgaattttttttttcgttagtcgtttgtaacggttttaggttcgtttttttttttcgcgttttcgcgcgcgtcgcgtttttcgcgtttcgcgttttttttttagtagtttttgcgagcgtttttagtagttattatttataggtcgtcgggggttaggaggtaattagagacggtttcgtggtcgtatttattcggtaagcgcgatgttggcgcggggcgcgcgcggggaggggcgcgcgatgagggggtttggttgcgcgtagttcgcgttttagatttgggggaagggaggaggaggagggggtagggaaggaggaggcgggcgggggggcgagagatgagttcgggaagggagcgggaggagggggcgtcggggagacgtttttttggtttttatcgcggggtttcggggttattcgttgcgaggtttcgacgcgtttagggacggggggtgtgagtgtaagagtgcgcgcgcgcgtaggcgtgtgtatgttaaagatagaggaggggagggagggaacgttttaatatttttttagtgatttacgagtttgcgggtgaggttttggttgtgcgtttaggttcgtgtgtgtattaatgtggttgtatatttttggtttgttttacgagtgaatgttacggggtttgggggggggggtttggatataagttagtgaatgtgtttttgggttttagtttgattgaatgatgtggcgttgcgtggggttgtgtttgtgcgattgtttataggggggttgtgtgatttcgtgaggtattgcgtgggtgggattgcgtttgtgtgcggttgtgtgtatatgggattgtgtttgcgtggggttgagtgtttagagggtagttgtgtggttatgtgggtttgtttgcgagtgggttggtgggtgtgtggggtcgtggggttgcgtatgtaggggtagtgcgtttgtacggggttttgggttaatttaaagggttgtggtgggtatttgtaggcggttgcgtgtgtggttggatttgcgtggggtttgaggtttggcgggtgggggttagtttttttggcgtcggggatcgtatcgcggtagaagagtcgtttaaggcgttaataggtagcgtcggggtcgcggcgtagcgcgacgtgtagtagcggtggggcgtagagagaaggcggagaagaggggggtttttatcgcgcgttttttttagtcgtattagagacgtagtttggagattttgtcgtttgtcggtttcgcggttttagaagtatagggtttgggggattttttttagttgggggagacgtttattggtcgggaaggtagcgagaattgagattcgatgattttggcgtagtatagaagtatgcggtaaggatcgttaggagaggtgggtcgcggttcggagatagtcgagaattaggtcgagataaagaagagcgggatcggggattttggggttaaatcgcgtttttaggtttttcggcggtcgaggggagcgtatttaaggtcggcgcgtggagtttggcggaggtggcgcgggttttttttcgttgtagttttagtagtcgttttagagttttgggggtacgtaattaggcgttatagggtagggttacggtgaggggggttttgagtgtagttggcgggcgtcgagtttcggggttgtgattgagcgtttagttggttcgtttttttttcggtcgtttatcgtttacgt

SEQ ID NO: 7507 - DNA, 1017 bp, Homo sapiens; identical to SEQ ID NO: 1
  source 1..1017: mol_type = unassigned DNA

SEQ ID NO: 7508 - DNA, 166 bp, Homo sapiens; identical to SEQ ID NO: 2
  source 1..166: mol_type = unassigned DNA

SEQ ID NO: 7509 - DNA, 125 bp, Homo sapiens; identical to SEQ ID NO: 13
  source 1..125: mol_type = unassigned DNA

SEQ ID NO: 7510 - DNA, 508 bp, Homo sapiens; identical to SEQ ID NO: 24
  source 1..508: mol_type = unassigned DNA

SEQ ID NO: 7511 - DNA, 396 bp, Homo sapiens; identical to SEQ ID NO: 35
  source 1..396: mol_type = unassigned DNA

SEQ ID NO: 7512 - DNA, 173 bp, Homo sapiens; identical to SEQ ID NO: 46
  source 1..173: mol_type = unassigned DNA

SEQ ID NO: 7513 - DNA, 97 bp, Homo sapiens; identical to SEQ ID NO: 57
  source 1..97: mol_type = unassigned DNA

SEQ ID NO: 7514 - DNA, 208 bp, Homo sapiens; identical to SEQ ID NO: 68
  source 1..208: mol_type = unassigned DNA

SEQ ID NO: 7515 - DNA, 647 bp, Homo sapiens; identical to SEQ ID NO: 79
  source 1..647: mol_type = unassigned DNA

SEQ ID NO: 7516 - DNA, 282 bp, Homo sapiens; identical to SEQ ID NO: 90
  source 1..282: mol_type = unassigned DNA

SEQ ID NO: 7517 - DNA, 32 bp, Homo sapiens; identical to SEQ ID NO: 101
  source 1..32: mol_type = unassigned DNA

SEQ ID NO: 7518 - DNA, 56 bp, Homo sapiens; identical to SEQ ID NO: 112
  source 1..56: mol_type = unassigned DNA

SEQ ID NO: 7519 - DNA, 44 bp, Homo sapiens; identical to SEQ ID NO: 113
  source 1..44: mol_type = unassigned DNA

SEQ ID NO: 7520 - DNA, 211 bp, Homo sapiens; identical to SEQ ID NO: 124
  source 1..211: mol_type = unassigned DNA

SEQ ID NO: 7521 - DNA, 141 bp, Homo sapiens; identical to SEQ ID NO: 135
  source 1..141: mol_type = unassigned DNA

SEQ ID NO: 7522 - DNA, 25 bp, Homo sapiens
  source 1..25: mol_type = unassigned DNA
cgtgcaccctgaggtctggttggcg

SEQ ID NO: 7523 - DNA, 498 bp, Homo sapiens; identical to SEQ ID NO: 157
  source 1..498: mol_type = unassigned DNA

SEQ ID NO: 7524 - DNA, 186 bp, Homo sapiens; identical to SEQ ID NO: 168
  source 1..186: mol_type = unassigned DNA

SEQ ID NO: 7525 - DNA, 97 bp, Homo sapiens; identical to SEQ ID NO: 179
  source 1..97: mol_type = unassigned DNA

SEQ ID NO: 7526 - DNA, 82 bp, Homo sapiens; identical to SEQ ID NO: 223
  source 1..82: mol_type = unassigned DNA

SEQ ID NO: 7527 - DNA, 51 bp, Homo sapiens; identical to SEQ ID NO: 334
  source 1..51: mol_type = unassigned DNA

SEQ ID NO: 7528 - DNA, 431 bp, Homo sapiens; identical to SEQ ID NO: 374
  source 1..431: mol_type = unassigned DNA

SEQ ID NO: 7529 - DNA, 258 bp, Homo sapiens; identical to SEQ ID NO: 385
  source 1..258: mol_type = unassigned DNA

SEQ ID NO: 7530 - DNA, 84 bp, Homo sapiens; identical to SEQ ID NO: 396
  source 1..84: mol_type = unassigned DNA

SEQ ID NO: 7531 - DNA, 62 bp, Homo sapiens; identical to SEQ ID NO: 407
  source 1..62: mol_type = unassigned DNA

SEQ ID NO: 7532 - DNA, 50 bp, Homo sapiens; identical to SEQ ID NO: 418
  source 1..50: mol_type = unassigned DNA

SEQ ID NO: 7533 - DNA, 1017 bp, Homo sapiens; identical to SEQ ID NO: 429
  source 1..1017: mol_type = unassigned DNA

SEQ ID NO: 7534 - DNA, 166 bp, Homo sapiens; identical to SEQ ID NO: 430
  source 1..166: mol_type = unassigned DNA

SEQ ID NO: 7535 - DNA, 125 bp, Homo sapiens; identical to SEQ ID NO: 441
  source 1..125: mol_type = unassigned DNA

SEQ ID NO: 7536 - DNA, 508 bp, Homo sapiens; identical to SEQ ID NO: 452
  source 1..508: mol_type = unassigned DNA

SEQ ID NO: 7537 - DNA, 396 bp, Homo sapiens; identical to SEQ ID NO: 463
  source 1..396: mol_type = unassigned DNA

SEQ ID NO: 7538 - DNA, 173 bp, Homo sapiens; identical to SEQ ID NO: 474
  source 1..173: mol_type = unassigned DNA

SEQ ID NO: 7539 - DNA, 97 bp, Homo sapiens; identical to SEQ ID NO: 485
  source 1..97: mol_type = unassigned DNA

SEQ ID NO: 7540 - DNA, 208 bp, Homo sapiens; identical to SEQ ID NO: 496
  source 1..208: mol_type = unassigned DNA

SEQ ID NO: 7541 - DNA, 647 bp, Homo sapiens; identical to SEQ ID NO: 507
  source 1..647: mol_type = unassigned DNA

SEQ ID NO: 7542 - DNA, 282 bp, Homo sapiens; identical to SEQ ID NO: 518
  source 1..282: mol_type = unassigned DNA

SEQ ID NO: 7543 - DNA, 32 bp, Homo sapiens; identical to SEQ ID NO: 529
  source 1..32: mol_type = unassigned DNA

SEQ ID NO: 7544 - DNA, 56 bp, Homo sapiens; identical to SEQ ID NO: 540
  source 1..56: mol_type = unassigned DNA

SEQ ID NO: 7545 - DNA, 44 bp, Homo sapiens; identical to SEQ ID NO: 541
  source 1..44: mol_type = unassigned DNA

SEQ ID NO: 7546 - DNA, 211 bp, Homo sapiens; identical to SEQ ID NO: 552
  source 1..211: mol_type = unassigned DNA

SEQ ID NO: 7547 - DNA, 141 bp, Homo sapiens; identical to SEQ ID NO: 563
  source 1..141: mol_type = unassigned DNA

SEQ ID NO: 7548 - DNA, 25 bp, Homo sapiens
  source 1..25: mol_type = unassigned DNA
cgccaaccagacctcagggtgcacg

SEQ ID NO: 7549 - DNA, 498 bp, Homo sapiens; identical to SEQ ID NO: 585
  source 1..498: mol_type = unassigned DNA

SEQ ID NO: 7550 - DNA, 186 bp, Homo sapiens; identical to SEQ ID NO: 596
  source 1..186: mol_type = unassigned DNA

SEQ ID NO: 7551 - DNA, 97 bp, Homo sapiens; identical to SEQ ID NO: 607
  source 1..97: mol_type = unassigned DNA

SEQ ID NO: 7552 - DNA, 82 bp, Homo sapiens; identical to SEQ ID NO: 651
  source 1..82: mol_type = unassigned DNA

SEQ ID NO: 7553 - DNA, 51 bp, Homo sapiens; identical to SEQ ID NO: 762
  source 1..51: mol_type = unassigned DNA

SEQ ID NO: 7554 - DNA, 431 bp, Homo sapiens; identical to SEQ ID NO: 802
  source 1..431: mol_type = unassigned DNA

SEQ ID NO: 7555 - DNA, 258 bp, Homo sapiens; identical to SEQ ID NO: 813
  source 1..258: mol_type = unassigned DNA

SEQ ID NO: 7556 - DNA, 84 bp, Homo sapiens; identical to SEQ ID NO: 824
  source 1..84: mol_type = unassigned DNA

SEQ ID NO: 7557 - DNA, 62 bp, Homo sapiens; identical to SEQ ID NO: 835
  source 1..62: mol_type = unassigned DNA

SEQ ID NO: 7558 - DNA, 50 bp, Homo sapiens; identical to SEQ ID NO: 846
  source 1..50: mol_type = unassigned DNA

SEQ ID NO: 7559 - DNA, 1017 bp, synthetic construct; identical to SEQ ID NO: 857
  misc_feature 1..1017: note = Description of Artificial Sequence: Synthetic polynucleotide
  source 1..1017: mol_type = other DNA

SEQ ID NO: 7560 - DNA, 166 bp, synthetic construct; identical to SEQ ID NO: 858
  misc_feature 1..166: note = Description of Artificial Sequence: Synthetic polynucleotide
  source 1..166: mol_type = other DNA

SEQ ID NO: 7561 - DNA, 125 bp, synthetic construct; identical to SEQ ID NO: 869
  misc_feature 1..125: note = Description of Artificial Sequence: Synthetic polynucleotide
  source 1..125: mol_type = other DNA

SEQ ID NO: 7562 - DNA, 508 bp, synthetic construct; identical to SEQ ID NO: 880
  misc_feature 1..508: note = Description of Artificial Sequence: Synthetic polynucleotide
  source 1..508: mol_type = other DNA

SEQ ID NO: 7563 - DNA, 396 bp, synthetic construct; identical to SEQ ID NO: 891
  misc_feature 1..396: note = Description of Artificial Sequence: Synthetic polynucleotide
  source 1..396: mol_type = other DNA

SEQ ID NO: 7564 - DNA, 173 bp, synthetic construct; identical to SEQ ID NO: 902
  misc_feature 1..173: note = Description of Artificial Sequence: Synthetic polynucleotide
  source 1..173: mol_type = other DNA

SEQ ID NO: 7565 - DNA, 97 bp, synthetic construct; identical to SEQ ID NO: 913
  misc_feature 1..97: note = Description of Artificial Sequence: Synthetic oligonucleotide
  source 1..97: mol_type = other DNA

SEQ ID NO: 7566 - DNA, 208 bp, synthetic construct; identical to SEQ ID NO: 924
  misc_feature 1..208: note = Description of Artificial Sequence: Synthetic polynucleotide
  source 1..208: mol_type = other DNA

SEQ ID NO: 7567 - DNA, 647 bp, synthetic construct; identical to SEQ ID NO: 935
  misc_feature 1..647: note = Description of Artificial Sequence: Synthetic polynucleotide
  source 1..647: mol_type = other DNA

SEQ ID NO: 7568 - DNA, 282 bp, synthetic construct; identical to SEQ ID NO: 946
  misc_feature 1..282: note = Description of Artificial Sequence: Synthetic polynucleotide
  source 1..282: mol_type = other DNA

SEQ ID NO: 7569 - DNA, 32 bp, synthetic construct; identical to SEQ ID NO: 957
  misc_feature 1..32: note = Description of Artificial Sequence: Synthetic oligonucleotide
  source 1..32: mol_type = other DNA

SEQ ID NO: 7570 - DNA, 56 bp, synthetic construct; identical to SEQ ID NO: 968
  misc_feature 1..56: note = Description of Artificial Sequence: Synthetic oligonucleotide
  source 1..56: mol_type = other DNA

SEQ ID NO: 7571 - DNA, 44 bp, synthetic construct; identical to SEQ ID NO: 969
  misc_feature 1..44: note = Description of Artificial Sequence: Synthetic oligonucleotide
  source 1..44: mol_type = other DNA

SEQ ID NO: 7572 - DNA, 211 bp, synthetic construct; identical to SEQ ID NO: 980
  misc_feature 1..211: note = Description of Artificial Sequence: Synthetic polynucleotide
  source 1..211: mol_type = other DNA

SEQ ID NO: 7573 - DNA, 141 bp, synthetic construct; identical to SEQ ID NO: 991
  misc_feature 1..141: note = Description of Artificial Sequence: Synthetic polynucleotide
  source 1..141: mol_type = other DNA

SEQ ID NO: 7574 - DNA, 25 bp, synthetic construct
  misc_feature 1..25: note = Description of Artificial Sequence: Synthetic oligonucleotide
  source 1..25: mol_type = other DNA
ygtgtattttgaggtttggttggyg

SEQ ID NO: 7575 - DNA, 498 bp, synthetic construct; identical to SEQ ID NO: 1013
  misc_feature 1..498: note = Description of Artificial Sequence: Synthetic polynucleotide
  source 1..498: mol_type = other DNA

SEQ ID NO: 7576 - DNA, 186 bp, synthetic construct; identical to SEQ ID NO: 1024
  misc_feature 1..186: note = Description of Artificial Sequence: Synthetic polynucleotide
  source 1..186: mol_type = other DNA

SEQ ID NO: 7577 - DNA, 97 bp, synthetic construct; identical to SEQ ID NO: 1035
  misc_feature 1..97: note = Description of Artificial Sequence: Synthetic oligonucleotide
  source 1..97: mol_type = other DNA

SEQ ID NO: 7578 - DNA, 82 bp, synthetic construct; identical to SEQ ID NO: 1079
  misc_feature 1..82: note = Description of Artificial Sequence: Synthetic oligonucleotide
  source 1..82: mol_type = other DNA

SEQ ID NO: 7579 - DNA, 51 bp, synthetic construct; identical to SEQ ID NO: 1190
  misc_feature 1..51: note = Description of Artificial Sequence: Synthetic oligonucleotide
  source 1..51: mol_type = other DNA

SEQ ID NO: 7580 - DNA, 431 bp, synthetic construct; identical to SEQ ID NO: 1230
  misc_feature 1..431: note = Description of Artificial Sequence: Synthetic polynucleotide
  source 1..431: mol_type = other DNA

SEQ ID NO: 7581 - DNA, 258 bp, synthetic construct; identical to SEQ ID NO: 1241
  misc_feature 1..258: note = Description of Artificial Sequence: Synthetic polynucleotide
  source 1..258: mol_type = other DNA

SEQ ID NO: 7582 - DNA, 84 bp, synthetic construct; identical to SEQ ID NO: 1252
  misc_feature 1..84: note = Description of Artificial Sequence: Synthetic oligonucleotide
  source 1..84: mol_type = other DNA

SEQ ID NO: 7583 - DNA, 62 bp, synthetic construct; identical to SEQ ID NO: 1263
  misc_feature 1..62: note = Description of Artificial Sequence: Synthetic oligonucleotide
  source 1..62: mol_type = other DNA

SEQ ID NO: 7584 - DNA, 50 bp, synthetic construct; identical to SEQ ID NO: 1274
  misc_feature 1..50: note = Description of Artificial Sequence: Synthetic oligonucleotide
  source 1..50: mol_type = other DNA

SEQ ID NO: 7585 - DNA, 1017 bp, synthetic construct; identical to SEQ ID NO: 1285
  misc_feature 1..1017: note = Description of Artificial Sequence: Synthetic polynucleotide
  source 1..1017: mol_type = other DNA

SEQ ID NO: 7586 - DNA, 166 bp, synthetic construct; identical to SEQ ID NO: 1286
  misc_feature 1..166: note = Description of Artificial Sequence: Synthetic polynucleotide
  source 1..166: mol_type = other DNA

SEQ ID NO: 7587 - DNA, 125 bp, synthetic construct; identical to SEQ ID NO: 1297
  misc_feature 1..125: note = Description of Artificial Sequence: Synthetic polynucleotide
  source 1..125: mol_type = other DNA

SEQ ID NO: 7588 - DNA, 508 bp, synthetic construct; identical to SEQ ID NO: 1308
  misc_feature 1..508: note = Description of Artificial Sequence: Synthetic polynucleotide
  source 1..508: mol_type = other DNA

SEQ ID NO: 7589 - DNA, 396 bp, synthetic construct; identical to SEQ ID NO: 1319
  misc_feature 1..396: note = Description of Artificial Sequence: Synthetic polynucleotide
  source 1..396: mol_type = other DNA

SEQ ID NO: 7590 - DNA, 173 bp, synthetic construct; identical to SEQ ID NO: 1330
  misc_feature 1..173: note = Description of Artificial Sequence: Synthetic polynucleotide
  source 1..173: mol_type = other DNA

SEQ ID NO: 7591 - DNA, 97 bp, synthetic construct; identical to SEQ ID NO: 1341
  misc_feature 1..97: note = Description of Artificial Sequence: Synthetic oligonucleotide
  source 1..97: mol_type = other DNA

SEQ ID NO: 7592 - DNA, 208 bp, synthetic construct; identical to SEQ ID NO: 1352
  misc_feature 1..208: note = Description of Artificial Sequence: Synthetic polynucleotide
  source 1..208: mol_type = other DNA

SEQ ID NO: 7593 - DNA, 647 bp, synthetic construct; identical to SEQ ID NO: 1363
  misc_feature 1..647: note = Description of Artificial Sequence: Synthetic polynucleotide
  source 1..647: mol_type = other DNA

SEQ ID NO: 7594 - DNA, 282 bp, synthetic construct; identical to SEQ ID NO: 1374
  misc_feature 1..282: note = Description of Artificial Sequence: Synthetic polynucleotide
  source 1..282: mol_type = other DNA

SEQ ID NO: 7595 - DNA, 32 bp, synthetic construct; identical to SEQ ID NO: 1385
  misc_feature 1..32: note = Description of Artificial Sequence: Synthetic oligonucleotide
  source 1..32: mol_type = other DNA

SEQ ID NO: 7596 - DNA, 56 bp, synthetic construct; identical to SEQ ID NO: 1396
  misc_feature 1..56: note = Description of Artificial Sequence: Synthetic oligonucleotide
  source 1..56: mol_type = other DNA

SEQ ID NO: 7597 - DNA, 44 bp, synthetic construct; identical to SEQ ID NO: 113
  misc_feature 1..44: note = Description of Artificial Sequence: Synthetic oligonucleotide
  source 1..44: mol_type = other DNA

SEQ ID NO: 7598 - DNA, 211 bp, synthetic construct; identical to SEQ ID NO: 1408
  misc_feature 1..211: note = Description of Artificial Sequence: Synthetic polynucleotide
  source 1..211: mol_type = other DNA

SEQ ID NO: 7599 - DNA, 141 bp, synthetic construct; identical to SEQ ID NO: 1419
  misc_feature 1..141: note = Description of Artificial Sequence: Synthetic polynucleotide
  source 1..141: mol_type = other DNA

SEQ ID NO: 7600 - DNA, 25 bp, synthetic construct
  misc_feature 1..25: note = Description of Artificial Sequence: Synthetic oligonucleotide
  source 1..25: mol_type = other DNA
cgtgtattttgaggtttggttggcg

SEQ ID NO: 7601 - DNA, 498 bp, synthetic construct; identical to SEQ ID NO: 1441
  misc_feature 1..498: note = Description of Artificial Sequence: Synthetic polynucleotide
  source 1..498: mol_type = other DNA

SEQ ID NO: 7602 - DNA, 186 bp, synthetic construct; identical to SEQ ID NO: 1452
  misc_feature 1..186: note = Description of Artificial Sequence: Synthetic polynucleotide
  source 1..186: mol_type = other DNA

SEQ ID NO: 7603 - DNA, 97 bp, synthetic construct; identical to SEQ ID NO: 1463
  misc_feature 1..97: note = Description of Artificial Sequence: Synthetic oligonucleotide
  source 1..97: mol_type = other DNA

SEQ ID NO: 7604 - DNA, 82 bp, synthetic construct; identical to SEQ ID NO: 1507
  misc_feature 1..82: note = Description of Artificial Sequence: Synthetic oligonucleotide
  source 1..82: mol_type = other DNA

SEQ ID NO: 7605 - DNA, 51 bp, synthetic construct; identical to SEQ ID NO: 1618
  misc_feature 1..51: note = Description of Artificial Sequence: Synthetic oligonucleotide
  source 1..51: mol_type = other DNA

SEQ ID NO: 7606 - DNA, 431 bp, synthetic construct; identical to SEQ ID NO: 1658
  misc_feature 1..431: note = Description of Artificial Sequence: Synthetic polynucleotide
  source 1..431: mol_type = other DNA

SEQ ID NO: 7607 - DNA, 258 bp, synthetic construct; identical to SEQ ID NO: 1669
  misc_feature 1..258: note = Description of Artificial Sequence: Synthetic polynucleotide
  source 1..258: mol_type = other DNA

SEQ ID NO: 7608 - DNA, 84 bp, synthetic construct; identical to SEQ ID NO: 1680
  misc_feature 1..84: note = Description of Artificial Sequence: Synthetic oligonucleotide
  source 1..84: mol_type = other DNA

SEQ ID NO: 7609 - DNA, 62 bp, synthetic construct; identical to SEQ ID NO: 1691
  misc_feature 1..62: note = Description of Artificial Sequence: Synthetic oligonucleotide
  source 1..62: mol_type = other DNA

SEQ ID NO: 7610 - DNA, 50 bp, synthetic construct; identical to SEQ ID NO: 1702
  misc_feature 1..50: note = Description of Artificial Sequence: Synthetic oligonucleotide
  source 1..50: mol_type = other DNA

SEQ ID NO: 7611 - DNA, 1017 bp, synthetic construct; identical to SEQ ID NO: 1713
  misc_feature 1..1017: note = Description of Artificial Sequence: Synthetic polynucleotide
  source 1..1017: mol_type = other DNA

SEQ ID NO: 7612 - DNA, 166 bp, synthetic construct; identical to SEQ ID NO: 1714
  misc_feature 1..166: note = Description of Artificial Sequence: Synthetic polynucleotide
  source 1..166: mol_type = other DNA

SEQ ID NO: 7613 - DNA, 125 bp, synthetic construct; identical to SEQ ID NO: 1725
  misc_feature 1..125: note = Description of Artificial Sequence: Synthetic polynucleotide
  source 1..125: mol_type = other DNA

SEQ ID NO: 7614 - DNA, 508 bp, synthetic construct; identical to SEQ ID NO: 1736
  misc_feature 1..508: note = Description of Artificial Sequence: Synthetic polynucleotide
  source 1..508: mol_type = other DNA

SEQ ID NO: 7615 - DNA, 396 bp, synthetic construct; identical to SEQ ID NO: 1747
  misc_feature 1..396: note = Description of Artificial Sequence: Synthetic polynucleotide
  source 1..396: mol_type = other DNA

SEQ ID NO: 7616 - DNA, 173 bp, synthetic construct; identical to SEQ ID NO: 1758
  misc_feature 1..173: note = Description of Artificial Sequence: Synthetic polynucleotide
  source 1..173: mol_type = other DNA

SEQ ID NO: 7617 - DNA, 97 bp, synthetic construct; identical to SEQ ID NO: 1769
  misc_feature 1..97: note = Description of Artificial Sequence: Synthetic oligonucleotide
  source 1..97: mol_type = other DNA

SEQ ID NO: 7618 - DNA, 208 bp, synthetic construct; identical to SEQ ID NO: 1780
  misc_feature 1..208: note = Description of Artificial Sequence: Synthetic polynucleotide
  source 1..208: mol_type = other DNA

SEQ ID NO: 7619 - DNA, 647 bp, synthetic construct; identical to SEQ ID NO: 1791
  misc_feature 1..647: note = Description of Artificial Sequence: Synthetic polynucleotide
  source 1..647: mol_type = other DNA

SEQ ID NO: 7620 - DNA, 282 bp, synthetic construct; identical to SEQ ID NO: 1802
  misc_feature 1..282: note = Description of Artificial Sequence: Synthetic polynucleotide
  source 1..282: mol_type = other DNA

SEQ ID NO: 7621 - DNA, 32 bp, synthetic construct; identical to SEQ ID NO: 1813
  misc_feature 1..32: note = Description of Artificial Sequence: Synthetic oligonucleotide
  source 1..32: mol_type = other DNA

SEQ ID NO: 7622 - DNA, 56 bp, synthetic construct; identical to SEQ ID NO: 1824
  misc_feature 1..56: note = Description of Artificial Sequence: Synthetic oligonucleotide
  source 1..56: mol_type = other DNA

SEQ ID NO: 7623 - DNA, 44 bp, synthetic construct; identical to SEQ ID NO: 1825
  misc_feature 1..44: note = Description of Artificial Sequence: Synthetic oligonucleotide
  source 1..44: mol_type = other DNA

SEQ ID NO: 7624 - DNA, 211 bp, synthetic construct; identical to SEQ ID NO: 1836
  misc_feature 1..211: note = Description of Artificial Sequence: Synthetic polynucleotide
  source 1..211: mol_type = other DNA

SEQ ID NO: 7625 - DNA, 141 bp, synthetic construct; identical to SEQ ID NO: 1847
  misc_feature 1..141: note = Description of Artificial Sequence: Synthetic polynucleotide
  source 1..141: mol_type = other DNA

SEQ ID NO: 7626 - DNA, 25 bp, synthetic construct
  misc_feature 1..25: note = Description of Artificial Sequence: Synthetic oligonucleotide
  source 1..25: mol_type = other DNA
ygttaattagattttagggtgtayg

SEQ ID NO: 7627 - DNA, 498 bp, synthetic construct; identical to SEQ ID NO: 1869
  misc_feature 1..498: note = Description of Artificial Sequence: Synthetic polynucleotide
  source 1..498: mol_type = other DNA

SEQ ID NO: 7628 - DNA, 186 bp, synthetic construct; identical to SEQ ID NO: 1880
  misc_feature 1..186: note = Description of Artificial Sequence: Synthetic polynucleotide
  source 1..186: mol_type = other DNA

SEQ ID NO: 7629 - DNA, 97 bp, synthetic construct; identical to SEQ ID NO: 1891
  misc_feature 1..97: note = Description of Artificial Sequence: Synthetic oligonucleotide
  source 1..97: mol_type = other DNA

SEQ ID NO: 7630 - DNA, 82 bp, synthetic construct; identical to SEQ ID NO: 1935
  misc_feature 1..82: note = Description of Artificial Sequence: Synthetic oligonucleotide
  source 1..82: mol_type = other DNA

SEQ ID NO: 7631 - DNA, 51 bp, synthetic construct; identical to SEQ ID NO: 2046
  misc_feature 1..51: note = Description of Artificial Sequence: Synthetic oligonucleotide
  source 1..51: mol_type = other DNA

SEQ ID NO: 7632 - DNA, 431 bp, synthetic construct; identical to SEQ ID NO: 2086
  misc_feature 1..431: note = Description of Artificial Sequence: Synthetic polynucleotide
  source 1..431: mol_type = other DNA

SEQ ID NO: 7633 - DNA, 258 bp, synthetic construct; identical to SEQ ID NO: 2097
  misc_feature 1..258: note = Description of Artificial Sequence: Synthetic polynucleotide
  source 1..258: mol_type = other DNA

SEQ ID NO: 7634 - DNA, 84 bp, synthetic construct; identical to SEQ ID NO: 2108
  misc_feature 1..84: note = Description of Artificial Sequence: Synthetic oligonucleotide
  source 1..84: mol_type = other DNA

SEQ ID NO: 7635 - DNA, 62 bp, synthetic construct; identical to SEQ ID NO: 2119
  misc_feature 1..62: note = Description of Artificial Sequence: Synthetic oligonucleotide
  source 1..62: mol_type = other DNA

SEQ ID NO: 7636 - DNA, 50 bp, synthetic construct; identical to SEQ ID NO: 2130
  misc_feature 1..50: note = Description of Artificial Sequence: Synthetic oligonucleotide
  source 1..50: mol_type = other DNA

SEQ ID NO: 7637 - DNA, 1017 bp, synthetic construct; identical to SEQ ID NO: 2141
  misc_feature 1..1017: note = Description of Artificial Sequence: Synthetic polynucleotide
  source 1..1017: mol_type = other DNA

SEQ ID NO: 7638 - DNA, 166 bp, synthetic construct; identical to SEQ ID NO: 2142
  misc_feature 1..166: note = Description of Artificial Sequence: Synthetic polynucleotide
  source 1..166: mol_type = other DNA

SEQ ID NO: 7639 - DNA, 125 bp, synthetic construct; identical to SEQ ID NO: 2153
  misc_feature 1..125: note = Description of Artificial Sequence: Synthetic polynucleotide
  source 1..125: mol_type = other DNA

SEQ ID NO: 7640 - DNA, 508 bp, synthetic construct; identical to SEQ ID NO: 2164
  misc_feature 1..508: note = Description of Artificial Sequence: Synthetic polynucleotide
  source 1..508: mol_type = other DNA

SEQ ID NO: 7641 - DNA, 396 bp, synthetic construct; identical to SEQ ID NO: 2175
  misc_feature 1..396: note = Description of Artificial Sequence: Synthetic polynucleotide
  source 1..396: mol_type = other DNA

SEQ ID NO: 7642 - DNA, 173 bp, synthetic construct; identical to SEQ ID NO: 2186
  misc_feature 1..173: note = Description of Artificial Sequence: Synthetic polynucleotide
  source 1..173: mol_type = other DNA

SEQ ID NO: 7643 - DNA, 97 bp, synthetic construct; identical to SEQ ID NO: 2197
  misc_feature 1..97: note = Description of Artificial Sequence: Synthetic oligonucleotide
  source 1..97: mol_type = other DNA

SEQ ID NO: 7644 - DNA, 208 bp, synthetic construct; identical to SEQ ID NO: 2208
  misc_feature 1..208: note = Description of Artificial Sequence: Synthetic polynucleotide
  source 1..208: mol_type = other DNA

SEQ ID NO: 7645 - DNA, 647 bp, synthetic construct; identical to SEQ ID NO: 2219
  misc_feature 1..647: note = Description of Artificial Sequence: Synthetic polynucleotide
  source 1..647: mol_type = other DNA

SEQ ID NO: 7646 - DNA, 282 bp, synthetic construct; identical to SEQ ID NO: 2230
  misc_feature 1..282: note = Description of Artificial Sequence: Synthetic polynucleotide
  source 1..282: mol_type = other DNA

SEQ ID NO: 7647 - DNA, 32 bp, synthetic construct; identical to SEQ ID NO: 2241
  misc_feature 1..32: note = Description of Artificial Sequence: Synthetic oligonucleotide
  source 1..32: mol_type = other DNA

SEQ ID NO: 7648 - DNA, 56 bp, synthetic construct; identical to SEQ ID NO: 2252
  misc_feature 1..56: note = Description of Artificial Sequence: Synthetic oligonucleotide
  source 1..56: mol_type = other DNA

SEQ ID NO: 7649 - DNA, 44 bp, synthetic construct; identical to SEQ ID NO: 2253
  misc_feature 1..44: note = Description of Artificial Sequence: Synthetic oligonucleotide
  source 1..44: mol_type = other DNA

SEQ ID NO: 7650 - DNA, 211 bp, synthetic construct; identical to SEQ ID NO: 2264
  misc_feature 1..211: note = Description of Artificial Sequence: Synthetic polynucleotide
  source 1..211: mol_type = other DNA

SEQ ID NO: 7651 - DNA, 141 bp, synthetic construct; identical to SEQ ID NO: 2275
  misc_feature 1..141: note = Description of Artificial Sequence: Synthetic polynucleotide
  source 1..141: mol_type = other DNA

SEQ ID NO: 7652 - DNA, 25 bp, synthetic construct
  misc_feature 1..25: note = Description of Artificial Sequence: Synthetic oligonucleotide
  source 1..25: mol_type = other DNA
cgttaattagattttagggtgtacg

SEQ ID NO: 7653 - DNA, 498 bp, synthetic construct; identical to SEQ ID NO: 2297
  misc_feature 1..498: note = Description of Artificial Sequence: Synthetic polynucleotide
  source 1..498: mol_type = other DNA

SEQ ID NO: 7654 - DNA, 186 bp, synthetic construct; identical to SEQ ID NO: 2308
  misc_feature 1..186: note = Description of Artificial Sequence: Synthetic polynucleotide
  source 1..186: mol_type = other DNA

SEQ ID NO: 7655 - DNA, 97 bp, synthetic construct; identical to SEQ ID NO: 2319
  misc_feature 1..97: note = Description of Artificial Sequence: Synthetic oligonucleotide
  source 1..97: mol_type = other DNA

SEQ ID NO: 7656 - DNA, 82 bp, synthetic construct; identical to SEQ ID NO: 2363
  misc_feature 1..82: note = Description of Artificial Sequence: Synthetic oligonucleotide
  source 1..82: mol_type = other DNA

SEQ ID NO: 7657 - DNA, 51 bp, synthetic construct; identical to SEQ ID NO: 2474
  misc_feature 1..51: note = Description of Artificial Sequence: Synthetic oligonucleotide
  source 1..51: mol_type = other DNA

SEQ ID NO: 7658 - DNA, 431 bp, synthetic construct; identical to SEQ ID NO: 2514
  misc_feature 1..431: note = Description of Artificial Sequence: Synthetic polynucleotide
  source 1..431: mol_type = other DNA

SEQ ID NO: 7659 - DNA, 258 bp, synthetic construct; identical to SEQ ID NO: 2525
  misc_feature 1..258: note = Description of Artificial Sequence: Synthetic polynucleotide
  source 1..258: mol_type = other DNA

SEQ ID NO: 7660 - DNA, 84 bp, synthetic construct; identical to SEQ ID NO: 2536
  misc_feature 1..84: note = Description of Artificial Sequence: Synthetic oligonucleotide
  source 1..84: mol_type = other DNA

SEQ ID NO: 7661 - DNA, 62 bp, synthetic construct; identical to SEQ ID NO: 2547
  misc_feature 1..62: note = Description of Artificial Sequence: Synthetic oligonucleotide
  source 1..62: mol_type = other DNA

SEQ ID NO: 7662 - DNA, 50 bp, synthetic construct; identical to SEQ ID NO: 2558
  misc_feature 1..50: note = Description of Artificial Sequence: Synthetic oligonucleotide
  source 1..50: mol_type = other DNA

SEQ ID NO: 7663 - DNA, 1216 bp, Homo sapiens; identical to SEQ ID NO: 2569
  source 1..1216: mol_type = unassigned DNA

SEQ ID NO: 7664 - DNA, 365 bp, Homo sapiens; identical to SEQ ID NO: 2570
  source 1..365: mol_type = unassigned DNA

SEQ ID NO: 7665 - DNA, 324 bp, Homo sapiens; identical to SEQ ID NO: 2581
  source 1..324: mol_type = unassigned DNA

SEQ ID NO: 7666 - DNA, 707 bp, Homo sapiens; identical to SEQ ID NO: 2592
  source 1..707: mol_type = unassigned DNA

SEQ ID NO: 7667 - DNA, 595 bp, Homo sapiens; identical to SEQ ID NO: 2603
  source 1..595: mol_type = unassigned DNA

SEQ ID NO: 7668 - DNA, 372 bp, Homo sapiens; identical to SEQ ID NO: 2614
  source 1..372: mol_type = unassigned DNA

SEQ ID NO: 7669 - DNA, 296 bp, Homo sapiens; identical to SEQ ID NO: 2625
  source 1..296: mol_type = unassigned DNA

SEQ ID NO: 7670 - DNA, 407 bp, Homo sapiens; identical to SEQ ID NO: 2636
  source 1..407: mol_type = unassigned DNA

SEQ ID NO: 7671 - DNA, 846 bp, Homo sapiens; identical to SEQ ID NO: 2647
  source 1..846: mol_type = unassigned DNA

SEQ ID NO: 7672 - DNA, 481 bp, Homo sapiens; identical to SEQ ID NO: 2658
  source 1..481: mol_type = unassigned DNA

SEQ ID NO: 7673 - DNA, 231 bp, Homo sapiens; identical to SEQ ID NO: 2669
  source 1..231: mol_type = unassigned DNA

SEQ ID NO: 7674 - DNA, 255 bp, Homo sapiens; identical to SEQ ID NO: 2680
  source 1..255: mol_type = unassigned DNA

SEQ ID NO: 7675 - DNA, 243 bp, Homo sapiens; identical to SEQ ID NO: 2681
  source 1..243: mol_type = unassigned DNA

SEQ ID NO: 7676 - DNA, 410 bp, Homo sapiens; identical to SEQ ID NO: 2692
  source 1..410: mol_type = unassigned DNA

SEQ ID NO: 7677 - DNA, 340 bp, Homo sapiens; identical to SEQ ID NO: 2703
  source 1..340: mol_type = unassigned DNA

SEQ ID NO: 7678 - DNA, 224 bp, Homo sapiens; identical to SEQ ID NO: 2714
  source 1..224: mol_type = unassigned DNA

SEQ ID NO: 7679 - DNA, 697 bp, Homo sapiens; identical to SEQ ID NO: 2725
  source 1..697: mol_type = unassigned DNA

SEQ ID NO: 7680 - DNA, 385 bp, Homo sapiens; identical to SEQ ID NO: 2736
  source 1..385: mol_type = unassigned DNA

SEQ ID NO: 7681 - DNA, 296 bp, Homo sapiens; identical to SEQ ID NO: 2747
  source 1..296: mol_type = unassigned DNA

SEQ ID NO: 7682 - DNA, 281 bp, Homo sapiens; identical to SEQ ID NO: 2791
  source 1..281: mol_type = unassigned DNA

SEQ ID NO: 7683 - DNA, 250 bp, Homo sapiens; identical to SEQ ID NO: 2902
  source 1..250: mol_type = unassigned DNA

SEQ ID NO: 7684 - DNA, 630 bp, Homo sapiens; identical to SEQ ID NO: 2942
  source 1..630: mol_type = unassigned DNA

SEQ ID NO: 7685 - DNA, 457 bp, Homo sapiens; identical to SEQ ID NO: 2953
  source 1..457: mol_type = unassigned DNA

SEQ ID NO: 7686 - DNA, 283 bp, Homo sapiens; identical to SEQ ID NO: 2964
  source 1..283: mol_type = unassigned DNA

SEQ ID NO: 7687 - DNA, 261 bp, Homo sapiens; identical to SEQ ID NO: 2975
  source 1..261: mol_type = unassigned DNA

SEQ ID NO: 7688 - DNA, 249 bp, Homo sapiens; identical to SEQ ID NO: 2986
  source 1..249: mol_type = unassigned DNA

SEQ ID NO: 7689 - DNA, 1216 bp, Homo sapiens; identical to SEQ ID NO: 2997
  source 1..1216: mol_type = unassigned DNA

SEQ ID NO: 7690 - DNA, 365 bp, Homo sapiens; identical to SEQ ID NO: 2998
  source 1..365: mol_type = unassigned DNA

SEQ ID NO: 7691 - DNA, 324 bp, Homo sapiens; identical to SEQ ID NO: 3009
  source 1..324: mol_type = unassigned DNA

SEQ ID NO: 7692 - DNA, 707 bp, Homo sapiens; identical to SEQ ID NO: 3020
  source 1..707: mol_type = unassigned DNA

SEQ ID NO: 7693 - DNA, 595 bp, Homo sapiens; identical to SEQ ID NO: 3031
  source 1..595: mol_type = unassigned DNA

SEQ ID NO: 7694 - DNA, 372 bp, Homo sapiens; identical to SEQ ID NO: 3042
  source 1..372: mol_type = unassigned DNA

SEQ ID NO: 7695 - DNA, 296 bp, Homo sapiens; identical to SEQ ID NO: 3053
  source 1..296: mol_type = unassigned DNA

SEQ ID NO: 7696 - DNA, 407 bp, Homo sapiens; identical to SEQ ID NO: 3064
  source 1..407: mol_type = unassigned DNA

SEQ ID NO: 7697 - DNA, 846 bp, Homo sapiens; identical to SEQ ID NO: 3075
  source 1..846: mol_type = unassigned DNA

SEQ ID NO: 7698 - DNA, 481 bp, Homo sapiens; identical to SEQ ID NO: 3086
  source 1..481: mol_type = unassigned DNA

SEQ ID NO: 7699 - DNA, 231 bp, Homo sapiens; identical to SEQ ID NO: 3097
  source 1..231: mol_type = unassigned DNA

SEQ ID NO: 7700 - DNA, 255 bp, Homo sapiens; identical to SEQ ID NO: 3108
  source 1..255: mol_type = unassigned DNA

SEQ ID NO: 7701 - DNA, 243 bp, Homo sapiens; identical to SEQ ID NO: 3109
  source 1..243: mol_type = unassigned DNA

SEQ ID NO: 7702 - DNA, 410 bp, Homo sapiens; identical to SEQ ID NO: 3120
  source 1..410: mol_type = unassigned DNA

SEQ ID NO: 7703 - DNA, 340 bp, Homo sapiens; identical to SEQ ID NO: 3131
  source 1..340: mol_type = unassigned DNA

SEQ ID NO: 7704 - DNA, 224 bp, Homo sapiens; identical to SEQ ID NO: 3142
  source 1..224: mol_type = unassigned DNA

SEQ ID NO: 7705 - DNA, 697 bp, Homo sapiens; identical to SEQ ID NO: 3153
  source 1..697: mol_type = unassigned DNA

SEQ ID NO: 7706 - DNA, 385 bp, Homo sapiens; identical to SEQ ID NO: 3164
  source 1..385: mol_type = unassigned DNA

SEQ ID NO: 7707 - DNA, 296 bp, Homo sapiens; identical to SEQ ID NO: 3175
  source 1..296: mol_type = unassigned DNA

SEQ ID NO: 7708 - DNA, 281 bp, Homo sapiens; identical to SEQ ID NO: 3219
  source 1..281: mol_type = unassigned DNA

SEQ ID NO: 7709 - DNA, 250 bp, Homo sapiens; identical to SEQ ID NO: 3330
  source 1..250: mol_type = unassigned DNA

SEQ ID NO: 7710 - DNA, 630 bp, Homo sapiens; identical to SEQ ID NO: 3370
  source 1..630: mol_type = unassigned DNA

SEQ ID NO: 7711 - DNA, 457 bp, Homo sapiens; identical to SEQ ID NO: 3381
  source 1..457: mol_type = unassigned DNA

SEQ ID NO: 7712 - DNA, 283 bp, Homo sapiens; identical to SEQ ID NO: 3392
  source 1..283: mol_type = unassigned DNA

SEQ ID NO: 7713 - DNA, 261 bp, Homo sapiens; identical to SEQ ID NO: 3403
  source 1..261: mol_type = unassigned DNA

SEQ ID NO: 7714 - DNA, 249 bp, Homo sapiens; identical to SEQ ID NO: 3414
  source 1..249: mol_type = unassigned DNA

SEQ ID NO: 7715 - DNA, 1216 bp, synthetic construct; identical to SEQ ID NO: 3425
  misc_feature 1..1216: note = Description of Artificial Sequence: Synthetic polynucleotide
  source 1..1216: mol_type = other DNA

SEQ ID NO: 7716 - DNA, 365 bp, synthetic construct; identical to SEQ ID NO: 3426
  misc_feature 1..365: note = Description of Artificial Sequence: Synthetic polynucleotide
  source 1..365: mol_type = other DNA

SEQ ID NO: 7717 - DNA, 324 bp, synthetic construct; identical to SEQ ID NO: 3437
  misc_feature 1..324: note = Description of Artificial Sequence: Synthetic polynucleotide
  source 1..324: mol_type = other DNA

SEQ ID NO: 7718 - DNA, 707 bp, synthetic construct; identical to SEQ ID NO: 3448
  misc_feature 1..707: note = Description of Artificial Sequence: Synthetic polynucleotide
  source 1..707: mol_type = other DNA

SEQ ID NO: 7719 - DNA, 595 bp, synthetic construct; identical to SEQ ID NO: 3459
  misc_feature 1..595: note = Description of Artificial Sequence: Synthetic polynucleotide
  source 1..595: mol_type = other DNA

SEQ ID NO: 7720 - DNA, 372 bp, synthetic construct; identical to SEQ ID NO: 3470
  misc_feature 1..372: note = Description of Artificial Sequence: Synthetic polynucleotide
  source 1..372: mol_type = other DNA

SEQ ID NO: 7721 - DNA, 296 bp, synthetic construct; identical to SEQ ID NO: 3481
  misc_feature 1..296: note = Description of Artificial Sequence: Synthetic polynucleotide
  source 1..296: mol_type = other DNA

SEQ ID NO: 7722 - DNA, 407 bp, synthetic construct; identical to SEQ ID NO: 3492
  misc_feature 1..407: note = Description of Artificial Sequence: Synthetic polynucleotide
  source 1..407: mol_type = other DNA

SEQ ID NO: 7723 - DNA, 846 bp, synthetic construct; identical to SEQ ID NO: 3503
  misc_feature 1..846: note = Description of Artificial Sequence: Synthetic polynucleotide
  source 1..846: mol_type = other DNA

SEQ ID NO: 7724 - DNA, 481 bp, synthetic construct; identical to SEQ ID NO: 3514
  misc_feature 1..481: note = Description of Artificial Sequence: Synthetic polynucleotide
  source 1..481: mol_type = other DNA

SEQ ID NO: 7725 - DNA, 231 bp, synthetic construct; identical to SEQ ID NO: 3525
  misc_feature 1..231: note = Description of Artificial Sequence: Synthetic polynucleotide
  source 1..231: mol_type = other DNA

SEQ ID NO: 7726 - DNA, 255 bp, synthetic construct; identical to SEQ ID NO: 3536
  misc_feature 1..255: note = Description of Artificial Sequence: Synthetic polynucleotide
  source 1..255: mol_type = other DNA

SEQ ID NO: 7727 - DNA, 243 bp, synthetic construct; identical to SEQ ID NO: 3537
  misc_feature 1..243: note = Description of Artificial Sequence: Synthetic polynucleotide
  source 1..243: mol_type = other DNA

SEQ ID NO: 7728 - DNA, 410 bp, synthetic construct; identical to SEQ ID NO: 3548
  misc_feature 1..410: note = Description of Artificial Sequence: Synthetic polynucleotide
  source 1..410: mol_type = other DNA

SEQ ID NO: 7729 - DNA, 340 bp, synthetic construct; identical to SEQ ID NO: 3559
  misc_feature 1..340: note = Description of Artificial Sequence: Synthetic polynucleotide
  source 1..340: mol_type = other DNA

SEQ ID NO: 7730 - DNA, 224 bp, synthetic construct; identical to SEQ ID NO: 3570
  misc_feature 1..224: note = Description of Artificial Sequence: Synthetic polynucleotide
  source 1..224: mol_type = other DNA

SEQ ID NO: 7731 - DNA, 697 bp, synthetic construct; identical to SEQ ID NO: 3581
  misc_feature 1..697: note = Description of Artificial Sequence: Synthetic polynucleotide
  source 1..697: mol_type = other DNA

SEQ ID NO: 7732 - DNA, 385 bp, synthetic construct; identical to SEQ ID NO: 3592
  misc_feature 1..385: note = Description of Artificial Sequence: Synthetic polynucleotide
  source 1..385: mol_type = other DNA

SEQ ID NO: 7733 - DNA, 296 bp, synthetic construct; identical to SEQ ID NO: 3603
  misc_feature 1..296: note = Description of Artificial Sequence: Synthetic polynucleotide
  source 1..296: mol_type = other DNA

SEQ ID NO: 7734 - DNA, 281 bp, synthetic construct; identical to SEQ ID NO: 3647
  misc_feature 1..281: note = Description of Artificial Sequence: Synthetic polynucleotide
  source 1..281: mol_type = other DNA

SEQ ID NO: 7735 - DNA, 250 bp, synthetic construct; identical to SEQ ID NO: 3758
  misc_feature 1..250: note = Description of Artificial Sequence: Synthetic polynucleotide
  source 1..250: mol_type = other DNA

SEQ ID NO: 7736 - DNA, 630 bp, synthetic construct; identical to SEQ ID NO: 3798
  misc_feature 1..630: note = Description of Artificial Sequence: Synthetic polynucleotide
  source 1..630: mol_type = other DNA

SEQ ID NO: 7737 - DNA, 457 bp, synthetic construct; identical to SEQ ID NO: 3809
  misc_feature 1..457: note = Description of Artificial Sequence: Synthetic polynucleotide
  source 1..457: mol_type = other DNA

SEQ ID NO: 7738 - DNA, 283 bp, synthetic construct; identical to SEQ ID NO: 3820
  misc_feature 1..283: note = Description of Artificial Sequence: Synthetic polynucleotide
  source 1..283: mol_type = other DNA

SEQ ID NO: 7739 - DNA, 261 bp, synthetic construct; identical to SEQ ID NO: 3831
  misc_feature 1..261: note = Description of Artificial Sequence: Synthetic polynucleotide
  source 1..261: mol_type = other DNA

SEQ ID NO: 7740 - DNA, 249 bp, synthetic construct; identical to SEQ ID NO: 3842
  misc_feature 1..249: note = Description of Artificial Sequence: Synthetic polynucleotide
  source 1..249: mol_type = other DNA

SEQ ID NO: 7741 - DNA, 1216 bp, synthetic construct; identical to SEQ ID NO: 3853
  misc_feature 1..1216: note = Description of Artificial Sequence: Synthetic polynucleotide
  source 1..1216: mol_type = other DNA

SEQ ID NO: 7742 - DNA, 365 bp, synthetic construct; identical to SEQ ID NO: 3854
  misc_feature 1..365: note = Description of Artificial Sequence: Synthetic polynucleotide
  source 1..365: mol_type = other DNA

SEQ ID NO: 7743 - DNA, 324 bp, synthetic construct; identical to SEQ ID NO: 3865
  misc_feature 1..324: note = Description of Artificial Sequence: Synthetic polynucleotide
  source 1..324: mol_type = other DNA

SEQ ID NO: 7744 - DNA, 707 bp, synthetic construct; identical to SEQ ID NO: 3876
  misc_feature 1..707: note = Description of Artificial Sequence: Synthetic polynucleotide
  source 1..707: mol_type = other DNA

SEQ ID NO: 7745 - DNA, 595 bp, synthetic construct; identical to SEQ ID NO: 3887
  misc_feature 1..595: note = Description of Artificial Sequence: Synthetic polynucleotide
  source 1..595: mol_type = other DNA

SEQ ID NO: 7746 - DNA, 372 bp, synthetic construct; identical to SEQ ID NO: 3898
  misc_feature 1..372: note = Description of Artificial Sequence: Synthetic polynucleotide
  source 1..372: mol_type = other DNA

SEQ ID NO: 7747 - DNA, 296 bp, synthetic construct; identical to SEQ ID NO: 3909
  misc_feature 1..296: note = Description of Artificial Sequence: Synthetic polynucleotide
  source 1..296: mol_type = other DNA

SEQ ID NO: 7748 - DNA, 407 bp, synthetic construct; identical to SEQ ID NO: 3920
  misc_feature 1..407: note = Description of Artificial Sequence: Synthetic polynucleotide
  source 1..407: mol_type = other DNA

SEQ ID NO: 7749 - DNA, 846 bp, synthetic construct; identical to SEQ ID NO: 3931
  misc_feature 1..846: note = Description of Artificial Sequence: Synthetic polynucleotide
  source 1..846: mol_type = other DNA

SEQ ID NO: 7750 - DNA, 481 bp, synthetic construct; identical to SEQ ID NO: 3942
  misc_feature 1..481: note = Description of Artificial Sequence: Synthetic polynucleotide
  source 1..481: mol_type = other DNA

SEQ ID NO: 7751 - DNA, 231 bp, synthetic construct; identical to SEQ ID NO: 3953
  misc_feature 1..231: note = Description of Artificial Sequence: Synthetic polynucleotide
  source 1..231: mol_type = other DNA

SEQ ID NO: 7752 - DNA, 255 bp, synthetic construct; identical to SEQ ID NO: 3964
  misc_feature 1..255: note = Description of Artificial Sequence: Synthetic polynucleotide
  source 1..255: mol_type = other DNA

SEQ ID NO: 7753 - DNA, 243 bp, synthetic construct; identical to SEQ ID NO: 3965
  misc_feature 1..243: note = Description of Artificial Sequence: Synthetic polynucleotide
  source 1..243: mol_type = other DNA

SEQ ID NO: 7754 - DNA, 410 bp, synthetic construct; identical to SEQ ID NO: 3976
  misc_feature 1..410: note = Description of Artificial Sequence: Synthetic polynucleotide
  source 1..410: mol_type = other DNA

SEQ ID NO: 7755 - DNA, 340 bp, synthetic construct; identical to SEQ ID NO: 3987
  misc_feature 1..340: note = Description of Artificial Sequence: Synthetic polynucleotide
  source 1..340: mol_type = other DNA

SEQ ID NO: 7756 - DNA, 224 bp, synthetic construct; identical to SEQ ID NO: 3998
  misc_feature 1..224: note = Description of Artificial Sequence: Synthetic polynucleotide
  source 1..224: mol_type = other DNA

SEQ ID NO: 7757 - DNA, 697 bp, synthetic construct; identical to SEQ ID NO: 4009
  misc_feature 1..697: note = Description of Artificial Sequence: Synthetic polynucleotide
  source 1..697: mol_type = other DNA

SEQ ID NO: 7758 - DNA, 385 bp, synthetic construct; identical to SEQ ID NO: 4020
  misc_feature 1..385: note = Description of Artificial Sequence: Synthetic polynucleotide
  source 1..385: mol_type = other DNA

SEQ ID NO: 7759 - DNA, 296 bp, synthetic construct; identical to SEQ ID NO: 4031
  misc_feature 1..296: note = Description of Artificial Sequence: Synthetic polynucleotide
  source 1..296: mol_type = other DNA

SEQ ID NO: 7760 - DNA, 281 bp, synthetic construct; identical to SEQ ID NO: 4075
  misc_feature 1..281: note = Description of Artificial Sequence: Synthetic polynucleotide
  source 1..281: mol_type = other DNA

SEQ ID NO: 7761 - DNA, 250 bp, synthetic construct; identical to SEQ ID NO: 4186
  misc_feature 1..250: note = Description of Artificial Sequence: Synthetic polynucleotide
  source 1..250: mol_type = other DNA

SEQ ID NO: 7762 - DNA, 630 bp, synthetic construct; identical to SEQ ID NO: 4226
  misc_feature 1..630: note = Description of Artificial Sequence: Synthetic polynucleotide
  source 1..630: mol_type = other DNA

SEQ ID NO: 7763 - DNA, 457 bp, synthetic construct; identical to SEQ ID NO: 4237
  misc_feature 1..457: note = Description of Artificial Sequence: Synthetic polynucleotide
  source 1..457: mol_type = other DNA

SEQ ID NO: 7764 - DNA, 283 bp, synthetic construct; identical to SEQ ID NO: 4248
  misc_feature 1..283: note = Description of Artificial Sequence: Synthetic polynucleotide
  source 1..283: mol_type = other DNA

SEQ ID NO: 7765 - DNA, 261 bp, synthetic construct; identical to SEQ ID NO: 4259
  misc_feature 1..261: note = Description of Artificial Sequence: Synthetic polynucleotide
  source 1..261: mol_type = other DNA

SEQ ID NO: 7766 - DNA, 249 bp, synthetic construct; identical to SEQ ID NO: 4270
  misc_feature 1..249: note = Description of Artificial Sequence: Synthetic polynucleotide
  source 1..249: mol_type = other DNA

SEQ ID NO: 7767 - DNA, 1216 bp, synthetic construct; identical to SEQ ID NO: 4281
  misc_feature 1..1216: note = Description of Artificial Sequence: Synthetic polynucleotide
  source 1..1216: mol_type = other DNA

SEQ ID NO: 7768 - DNA, 365 bp, synthetic construct; identical to SEQ ID NO: 4282
  misc_feature 1..365: note = Description of Artificial Sequence: Synthetic polynucleotide
  source 1..365: mol_type = other DNA

SEQ ID NO: 7769 - DNA, 324 bp, synthetic construct; identical to SEQ ID NO: 4293
  misc_feature 1..324: note = Description of Artificial Sequence: Synthetic polynucleotide
  source 1..324: mol_type = other DNA

SEQ ID NO: 7770 - DNA, 707 bp, synthetic construct; identical to SEQ ID NO: 4304
  misc_feature 1..707: note = Description of Artificial Sequence: Synthetic polynucleotide
  source 1..707: mol_type = other DNA

SEQ ID NO: 7771 - DNA, 595 bp, synthetic construct; identical to SEQ ID NO: 4315
  misc_feature 1..595: note = Description of Artificial Sequence: Synthetic polynucleotide
  source 1..595: mol_type = other DNA

SEQ ID NO: 7772 - DNA, 372 bp, synthetic construct; identical to SEQ ID NO: 4326
  misc_feature 1..372: note = Description of Artificial Sequence: Synthetic polynucleotide
  source 1..372: mol_type = other DNA

SEQ ID NO: 7773 - DNA, 296 bp, synthetic construct; identical to SEQ ID NO: 4337
  misc_feature 1..296: note = Description of Artificial Sequence: Synthetic polynucleotide
  source 1..296: mol_type = other DNA

SEQ ID NO: 7774 - DNA, 407 bp, synthetic construct; identical to SEQ ID NO: 4348
  misc_feature 1..407: note = Description of Artificial Sequence: Synthetic polynucleotide
  source 1..407: mol_type = other DNA

SEQ ID NO: 7775 - DNA, 846 bp, synthetic construct; identical to SEQ ID NO: 4359
  misc_feature 1..846: note = Description of Artificial Sequence: Synthetic polynucleotide
  source 1..846: mol_type = other DNA

SEQ ID NO: 7776 - DNA, 481 bp, synthetic construct; identical to SEQ ID NO: 4370
  misc_feature 1..481: note = Description of Artificial Sequence: Synthetic polynucleotide
  source 1..481: mol_type = other DNA

SEQ ID NO: 7777 - DNA, 231 bp, synthetic construct; identical to SEQ ID NO: 4381
  misc_feature 1..231: note = Description of Artificial Sequence: Synthetic polynucleotide
  source 1..231: mol_type = other DNA

SEQ ID NO: 7778 - DNA, 255 bp, synthetic construct; identical to SEQ ID NO: 4392
  misc_feature 1..255: note = Description of Artificial Sequence: Synthetic polynucleotide
  source 1..255: mol_type = other DNA

SEQ ID NO: 7779 - DNA, 243 bp, synthetic construct; identical to SEQ ID NO: 4393
  misc_feature 1..243: note = Description of Artificial Sequence: Synthetic polynucleotide
  source 1..243: mol_type = other DNA

SEQ ID NO: 7780 - DNA, 410 bp, synthetic construct; identical to SEQ ID NO: 4404
  misc_feature 1..410: note = Description of Artificial Sequence: Synthetic polynucleotide
  source 1..410: mol_type = other DNA

SEQ ID NO: 7781 - DNA, 340 bp, synthetic construct; identical to SEQ ID NO: 4415
  misc_feature 1..340: note = Description of Artificial Sequence: Synthetic polynucleotide
  source 1..340: mol_type = other DNA

SEQ ID NO: 7782 - DNA, 224 bp, synthetic construct; identical to SEQ ID NO: 4426
  misc_feature 1..224: note = Description of Artificial Sequence: Synthetic polynucleotide
  source 1..224: mol_type = other DNA

SEQ ID NO: 7783 - DNA, 697 bp, synthetic construct; identical to SEQ ID NO: 4437
  misc_feature 1..697: note = Description of Artificial Sequence: Synthetic polynucleotide
  source 1..697: mol_type = other DNA

SEQ ID NO: 7784 - DNA, 385 bp, synthetic construct; identical to SEQ ID NO: 4448
  misc_feature 1..385: note = Description of Artificial Sequence: Synthetic polynucleotide
  source 1..385: mol_type = other DNA

SEQ ID NO: 7785 - DNA, 296 bp, synthetic construct; identical to SEQ ID NO: 4459
  misc_feature 1..296: note = Description of Artificial Sequence: Synthetic polynucleotide
  source 1..296: mol_type = other DNA

SEQ ID NO: 7786 - DNA, 281 bp, synthetic construct; identical to SEQ ID NO: 4503
  misc_feature 1..281: note = Description of Artificial Sequence: Synthetic polynucleotide
  source 1..281: mol_type = other DNA

SEQ ID NO: 7787 - DNA, 250 bp, synthetic construct; identical to SEQ ID NO: 4614
  misc_feature 1..250: note = Description of Artificial Sequence: Synthetic polynucleotide
  source 1..250: mol_type = other DNA

SEQ ID NO: 7788 - DNA, 630 bp, synthetic construct; identical to SEQ ID NO: 4654
  misc_feature 1..630: note = Description of Artificial Sequence: Synthetic polynucleotide
  source 1..630: mol_type = other DNA

SEQ ID NO: 7789 - DNA, 457 bp, synthetic construct; identical to SEQ ID NO: 4665
  misc_feature 1..457: note = Description of Artificial Sequence: Synthetic polynucleotide
  source 1..457: mol_type = other DNA

SEQ ID NO: 7790 - DNA, 283 bp, synthetic construct; identical to SEQ ID NO: 4676
  misc_feature 1..283: note = Description of Artificial Sequence: Synthetic polynucleotide
  source 1..283: mol_type = other DNA

SEQ ID NO: 7791 - DNA, 261 bp, synthetic construct; identical to SEQ ID NO: 4687
  misc_feature 1..261: note = Description of Artificial Sequence: Synthetic polynucleotide
  source 1..261: mol_type = other DNA

SEQ ID NO: 7792 - DNA, 249 bp, synthetic construct; identical to SEQ ID NO: 4698
  misc_feature 1..249: note = Description of Artificial Sequence: Synthetic polynucleotide
  source 1..249: mol_type = other DNA

SEQ ID NO: 7793 - DNA, 1216 bp, synthetic construct; identical to SEQ ID NO: 4709
  misc_feature 1..1216: note = Description of Artificial Sequence: Synthetic polynucleotide
  source 1..1216: mol_type = other DNA

SEQ ID NO: 7794 - DNA, 365 bp, synthetic construct; identical to SEQ ID NO: 4710
  misc_feature 1..365: note = Description of Artificial Sequence: Synthetic polynucleotide
  source 1..365: mol_type = other DNA

SEQ ID NO: 7795 - DNA, 324 bp, synthetic construct; identical to SEQ ID NO: 4721
  misc_feature 1..324: note = Description of Artificial Sequence: Synthetic polynucleotide
  source 1..324: mol_type = other DNA

SEQ ID NO: 7796 - DNA, 707 bp, synthetic construct; identical to SEQ ID NO: 4732
  misc_feature 1..707: note = Description of Artificial Sequence: Synthetic polynucleotide
  source 1..707: mol_type = other DNA

SEQ ID NO: 7797 - DNA, 595 bp, synthetic construct; identical to SEQ ID NO: 4743
  misc_feature 1..595: note = Description of Artificial Sequence: Synthetic polynucleotide
  source 1..595: mol_type = other DNA

SEQ ID NO: 7798 - DNA, 372 bp, synthetic construct; identical to SEQ ID NO: 4754
  misc_feature 1..372: note = Description of Artificial Sequence: Synthetic polynucleotide
  source 1..372: mol_type = other DNA

SEQ ID NO: 7799 - DNA, 296 bp, synthetic construct; identical to SEQ ID NO: 4765
  misc_feature 1..296: note = Description of Artificial Sequence: Synthetic polynucleotide
  source 1..296: mol_type = other DNA

SEQ ID NO: 7800 - DNA, 407 bp, synthetic construct; identical to SEQ ID NO: 4776
  misc_feature 1..407: note = Description of Artificial Sequence: Synthetic polynucleotide
  source 1..407: mol_type = other DNA

SEQ ID NO: 7801 - DNA, 846 bp, synthetic construct; identical to SEQ ID NO: 4787
  misc_feature 1..846: note = Description of Artificial Sequence: Synthetic polynucleotide
  source 1..846: mol_type = other DNA

SEQ ID NO: 7802 - DNA, 481 bp, synthetic construct; identical to SEQ ID NO: 4798
  misc_feature 1..481: note = Description of Artificial Sequence: Synthetic polynucleotide
  source 1..481: mol_type = other DNA

SEQ ID NO: 7803 - DNA, 231 bp, synthetic construct; identical to SEQ ID NO: 4809
  misc_feature 1..231: note = Description of Artificial Sequence: Synthetic polynucleotide
  source 1..231: mol_type = other DNA

SEQ ID NO: 7804 - DNA, 255 bp, synthetic construct; identical to SEQ ID NO: 4820
  misc_feature 1..255: note = Description of Artificial Sequence: Synthetic polynucleotide
  source 1..255: mol_type = other DNA

SEQ ID NO: 7805 - DNA, 243 bp, synthetic construct; identical to SEQ ID NO: 4821
  misc_feature 1..243: note = Description of Artificial Sequence: Synthetic polynucleotide
  source 1..243: mol_type = other DNA

SEQ ID NO: 7806 - DNA, 410 bp, synthetic construct; identical to SEQ ID NO: 4832
  misc_feature 1..410: note = Description of Artificial Sequence: Synthetic polynucleotide
  source 1..410: mol_type = other DNA

SEQ ID NO: 7807 - DNA, 340 bp, synthetic construct; identical to SEQ ID NO: 4843
  misc_feature 1..340: note = Description of Artificial Sequence: Synthetic polynucleotide
  source 1..340: mol_type = other DNA

SEQ ID NO: 7808 - DNA, 224 bp, synthetic construct; identical to SEQ ID NO: 4854
  misc_feature 1..224: note = Description of Artificial Sequence: Synthetic polynucleotide
  source 1..224: mol_type = other DNA

SEQ ID NO: 7809 - DNA, 697 bp, synthetic construct; identical to SEQ ID NO: 4865
  misc_feature 1..697: note = Description of Artificial Sequence: Synthetic polynucleotide
  source 1..697: mol_type = other DNA

SEQ ID NO: 7810 - DNA, 385 bp, synthetic construct; identical to SEQ ID NO: 4876
  misc_feature 1..385: note = Description of Artificial Sequence: Synthetic polynucleotide
  source 1..385: mol_type = other DNA

SEQ ID NO: 7811 - DNA, 296 bp, synthetic construct; identical to SEQ ID NO: 4887
  misc_feature 1..296: note = Description of Artificial Sequence: Synthetic polynucleotide
  source 1..296: mol_type = other DNA

SEQ ID NO: 7812 - DNA, 281 bp, synthetic construct; identical to SEQ ID NO: 4931
  misc_feature 1..281: note = Description of Artificial Sequence: Synthetic polynucleotide
  source 1..281: mol_type = other DNA

SEQ ID NO: 7813 - DNA, 250 bp, synthetic construct; identical to SEQ ID NO: 5042
  misc_feature 1..250: note = Description of Artificial Sequence: Synthetic polynucleotide
  source 1..250: mol_type = other DNA

SEQ ID NO: 7814 - DNA, 630 bp, synthetic construct; identical to SEQ ID NO: 5082
  misc_feature 1..630: note = Description of Artificial Sequence: Synthetic polynucleotide
  source 1..630: mol_type = other DNA

SEQ ID NO: 7815 - DNA, 457 bp, synthetic construct; identical to SEQ ID NO: 5093
  misc_feature 1..457: note = Description of Artificial Sequence: Synthetic polynucleotide
  source 1..457: mol_type = other DNA

SEQ ID NO: 7816 - DNA, 283 bp, synthetic construct; identical to SEQ ID NO: 5104
  misc_feature 1..283: note = Description of Artificial Sequence: Synthetic polynucleotide
  source 1..283: mol_type = other DNA

SEQ ID NO: 7817 - DNA, 261 bp, synthetic construct; identical to SEQ ID NO: 5115
  misc_feature 1..261: note = Description of Artificial Sequence: Synthetic polynucleotide
  source 1..261: mol_type = other DNA

SEQ ID NO: 7818 - DNA, 249 bp, synthetic construct; identical to SEQ ID NO: 5126
  misc_feature 1..249: note = Description of Artificial Sequence: Synthetic polynucleotide
  source 1..249: mol_type = other DNA

SEQ ID NO: 7819 - DNA, 2566 bp, Homo sapiens
  source 1..2566: mol_type = unassigned DNA
cgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacg

SEQ ID NO: 7820 - DNA, 572 bp, Homo sapiens
  source 1..572: mol_type = unassigned DNA
cgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcg

SEQ ID NO: 7821 - DNA, 989 bp, Homo sapiens
  source 1..989: mol_type = unassigned DNA
cgtggtgtgtgtgtgcgcgcgcgagtgtgtgagcgccaggggccgcccgcccgccgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcg

SEQ ID NO: 7822 - DNA, 2400 bp, Homo sapiens
  source 1..2400: mol_type = unassigned DNA
cgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccg

SEQ ID NO: 7823 - DNA, 1859 bp, Homo sapiens
  source 1..1859: mol_type = unassigned DNA
cgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccccatcccgggtccacagcttcagtgcagcccctggcgacgcgcgctgacagctgggcagagacttccgtgcg

SEQ ID NO: 7824 - DNA, 902 bp, Homo sapiens
  source 1..902: mol_type = unassigned DNA
cgatcccagaactcgttccccaccccgagcccgtttcccgccgcctcctcgcccctgggagggcggccccattaaccctcgcgacccgggccgctcctggcggtcctgaccccgccaccccgtcccgcggcgggggtttgggggtgaggggcgcgccctggggcagaggattgcgcggcagggtctgccacagggcagaggccagggctctccgggaaaaaggcaggcgcatatatgcccccctttctgggaaaagacggggaggggggcttctcctgggagactccaggcttcgaaattcctcgttccctatcctccggcccccgcacccctcctcctccccgccacgcaccctctcccctccccagccatctgttccactccgcagcgccgcgacaaacacggctccagctcgcttccgcccctgcccagccccctccccaagccccggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgaggatcccggacacagagtgcagagaccccggcaagcctactgaaagccagccgaacccg

SEQ ID NO: 7825 - DNA, 2044 bp, Homo sapiens
  source 1..2044: mol_type = unassigned DNA
cgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccg

SEQ ID NO: 7826 - DNA, 1152 bp, Homo sapiens
  source 1..1152: mol_type = unassigned DNA
cgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccg

SEQ ID NO: 7827 - DNA, 872 bp, Homo sapiens
  source 1..872: mol_type = unassigned DNA
cggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccg

SEQ ID NO: 7828 - DNA, 1070 bp, Homo sapiens
  source 1..1070: mol_type = unassigned DNA
cgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccg

SEQ ID NO: 7829 - DNA, 395 bp, Homo sapiens
  source 1..395: mol_type = unassigned DNA
cgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccg

SEQ ID NO: 7830 - DNA, 265 bp, Homo sapiens
  source 1..265: mol_type = unassigned DNA
cggggacacctaggcgcggggcaggtgcaggggagggggcgcggggcaggggcgcaggggccgccgggttcgggctggaggtgtccgggccgcgggagggagggagggaaggagggagggaggacggcgagggagggaggcaggggcgggcggcgggggatggggccagcggggaggtggaagcgatacccaccgcccgtattggtcctcttggtgctgccggcttcagggggggcttccagcggccttttccgcgagtccggcg

SEQ ID NO: 7831 - DNA, 1169 bp, Homo sapiens
  source 1..1169: mol_type = unassigned DNA
cgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatccttgcgtggcttgggaggcaaatcgggcgtttctccaagtcgtcttaacatgatttaggctctcaaatacgtgaaagcggtagacacaacagggatgcgaaggaaataaaaaacaattggggaagtggtgccaagtcactcaggctttgaactgaggacgagtagtgcggtcgcgcctggggcgcgtccggaaatcatcctcagcctgtggcggccactgccccacttaaactcttctgcggggagagttgagcggatccctggggggttggtcctgggctagttttaaactctccggttgcatctcgcgtggccccaccgacggcgcgtctcggcgtagctcttggcgcgggctcg

SEQ ID NO: 7832 - DNA, 1743 bp, Homo sapiens
  source 1..1743: mol_type = unassigned DNA
cggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacg

SEQ ID NO: 7833 - DNA, 2405 bp, Homo sapiens
  source 1..2405: mol_type = unassigned DNA
cgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctccccctccccagacacacacacacgcacacgcacacgcacacactcaaaccctgccctccctcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgcccgcgcagccctgtgaaggaaagacaccatctttccgcacggaaactgcgtatacccctcccccg

SEQ ID NO: 7834 - DNA, 1920 bp, Homo sapiens
  source 1..1920: mol_type = unassigned DNA
cgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccg

SEQ ID NO: 7835 - DNA, 1403 bp, Homo sapiens
  source 1..1403: mol_type = unassigned DNA
cgcggggtccccgggaaccgccgcctttcttcctcgctcccgcgctcgcgcttcccctcccggggccccggcccacccacccctggtgcggccccgccggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggaggggcagggcgggcatcccggtccgaagacccaggaactgctctggcctggcctggggtctacacctgacgcctggcgagggttggcttcgggtctggtcccaccgggcctgggagggacgggcg

SEQ ID NO: 7836 - DNA, 1088 bp, Homo sapiens
  source 1..1088: mol_type = unassigned DNA
cgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcg

SEQ ID NO: 7837 - DNA, 1812 bp, Homo sapiens
  source 1..1812: mol_type = unassigned DNA
cgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctgggggctgggggcgggaccgggagggggtgttgggggaagcgacgcagcggctgggagattttgcaagggggtctgaagaggagtgggggatgggtatggaagggtgggggaccactgaggtgggatgcgagagtggaagggggacccagagggggcgcgatggccggaggagggggagatggacgatggggcggggcggcaccggtcgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggggcttgcaggtaaagcggggctggggccgtcctggccgtcagtggtcaggaagacgcagcgaccccg

SEQ ID NO: 7838 - DNA, 5819 bp, Homo sapiens
  source 1..5819: mol_type = unassigned DNA
cgagtagaaggcggacgcctccgagccgtaggtcacgtagttgccatagccctgcgatccgccatagggacccccatagacgcccagcgccgcggccgagttgagctcgtggcgcgcggtggccagcagccggctctcgtagaccgggcagtagaccggcgcctgggccgaggcggcgggcccggagtccgccagcgtgcggcctccggactcgcagcacgtgctcagggagttggtggccatcaagaactgcagagagaggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggccccactactcattccaggacacagggtcaatccagcctgtggattggcgaccaccgggacatctcactgaaaccctgtagcctggcctaggcccgcctgcccaaaccggggattctcactgggccacccttctcccatagataatactggaatattttccaagtgccttcaccaaaaggccaagcctggagcggaggcacccagtgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccg

SEQ ID NO: 7839 - DNA, 2001 bp, Homo sapiens
  source 1..2001: mol_type = unassigned DNA
cggaggctgtgccggggctcgtcaaaggctacaaacaaaccggacgggtgggaagcacgtttcagcggcgactggatttttaaaaatctgctggtagagtgaaaacaaaaattgtcctccaagttggcaaaatcggcgtcccagacggtgcgcaggagggccctgcgaggcctgtccccggagccccgcgccagtcctgtaggcccggctgggtccgcagcccggtgttccactcgtgggtcgggcccggctgcggggtctttccgcagccgggacacccaggacagcagcggctggggagccggggccaggggcttccttgcaattccaatgatttttattattatcactcgcaaaggacaaacgcggccaaggccgggcctcacagtggctgtgctggtcatcgcgtggaggagtgtgcgctaacccaggggcgaggggggcgcgcccggtgtcccggggagagcttagaaggaagacgccccaccgtggtccctacagtcagggacagtctgggtgctagaaattcccagagagaactcgaggggctgatgtcctgggtcaccagtccctggtgcctgtggggcttcctgcgcgcccacccccatccccctcccccctctcaggttcgacggattctcccggaggcttaggacagtgatttacagtaagtggtgacagtggaataacgtgacagtccgctgcatttgccagctggctcctgggcaggcctacccgccgggcccgaccccagagtcgagtcctcggagccgccgggtaaagccccctcccccgccccggtgcagccccgcgttccccgcgcccggcgctgccggggaaaagtggcacaacaggaaagcctcgccagagggcccttcccagtcggcttcctcgccataaaaagccagactccagccgaggtcctgaccccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaaacccggagcggggaagcccaggggctgagagcctcggcccgggtcgcaggagctggggagcggggacgcgggcaggctaggtcttcccacctgccgtcggggctcctccccgcagcagcaaaggggtcccagtgcccgtggcagtgcatgccccagcggacacgctggctcccaaattcagagatcagaggggcggctgagaacggggcgtccgctgtgtgtgacccctgaccgtggaggaagggcgggagccgggagtaggcggtggggcccggggtcaggccgcggtcgtcggctcccggcaaaggcgctctggccggggaagggggcgagggtgggcggccggcctctgccgtcgtagtcatacctgggacgttgaaatgggctttggggatagagctcactcccagcgcgccccacaggagaagcccgcagctcaggcctgggccgtgcagaccgctgggcgggctcggggcccgaggagagcaacacggcgcgaggtccagtcgcgagtaataaccccgacagcacggcccctcgaagacgtgttccgggcaccggggttgtgagcgggggagcctcgggccttgggcccgcttggcacggggcgggggcg

SEQ ID NO: 7840 - DNA, 1265 bp, Homo sapiens
  source 1..1265: mol_type = unassigned DNA
cggcgaggagggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccg

SEQ ID NO: 7841 - DNA, 1360 bp, Homo sapiens
  source 1..1360: mol_type = unassigned DNA
cgcccccgacccccgccgctgggatttcccgccgcagctcctgctccagtctgtgctgcgggtggggtcgggttgagcagcccggcgccccccaccgcgccccccaccgcaccgccctcgatctaaccccgcccccgggcgctcattggcctgcagcaccccctccccagcctgtgaagtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcg

SEQ ID NO: 7842 - DNA, 362 bp, Homo sapiens
  source 1..362: mol_type = unassigned DNA
cgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcg

SEQ ID NO: 7843 - DNA, 2566 bp, Homo sapiens
  source 1..2566: mol_type = unassigned DNA
cgtccccaacgcgggagcgcagtgcatcccagtggacaaactcgagaaccgcacgctgctctccgcctccacctctgtcctccccgctcgcggttccaacccgggacccaaatgcacgagctcggtgaatgccccggcaggagggcgagggctcagaggcagcctgcccagcaaaaacgacagctgtgctctggtgggccctgggccaccccaggcagaagccagagaagcccgagaaccccggcgggctggcaaagtttgccgagaagggtctttctggacacccccaccacgggctctaggctcgaaccccctcttccatctggccctggagtcccagacacagacaagccccgggcgcgccggcgggcgtatgtgcgtgtgtgtttacagcggggtggccgccggagctccccaagaaccccagctctcccgccccagctgcccgccagctgtgagcgcccgtcgggcccggaggtcacccgcaaacagctgggtcggcagctgggagcctgggaggcccctgctcagccccggggccccgagaaaggagaagggggagcggagtggctgtttggctgtggtttcctccaactccgcctgcgaagctctcgctgggagcccggagctttagctttccccggcagccccggcccccgcgcccgccgcgcccagcggccggcgcctcgccccgggccccggggaggaggcgcgccggggcagccggccaggacactgcgctgctggctcctagagctgcgggcgcgcctggccggccccacttcccgggttgctggggcgggcgccgctgccccgaccccggacgcgcggaaccctggagacccggccgctccccgccagggccgcggtgctgctccaggctccgggcgggcgcccctttccggctaccggtgcaccccgttgcccgcttgcgggaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttgcgaaaggctcgagagaggccgcaggctaggattggaccgccgggcgccgccggatggtgttgccagggtaaccggatggcacgcgaagccgttcgaggttccgacccggttacgggggcgcccagtggacccggagagctactttggggagggggcggccccgaagaaggactgggtgggggcgcatggagcgggggctgcgcgaaaagtttcctggggcggagctgagccacgcgggccgcgcaggagcgtctgtccgagggtcgcctacgagggactcctctgctcggctgcgcgggcttctgcgttgatgaagtcaccgcgttccgggtcggagcttcggcgcttctgccccgaacccagcgaagcccggtcctatgcccccaattacccaacggtccctcatcgcccagcg

SEQ ID NO: 7844 - DNA, 572 bp, Homo sapiens
  source 1..572: mol_type = unassigned DNA
cgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcg

SEQ ID NO: 7845 - DNA, 989 bp, Homo sapiens
  source 1..989: mol_type = unassigned DNA
cgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgccaacgccgccgccgccactgagcccccggcgcatcccagccccgggcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcggcgggcgggcggcccctggcgctcacacactcgcgcgcgcacacacacaccacg

SEQ ID NO: 7846 - DNA, 2400 bp, Homo sapiens
  source 1..2400: mol_type = unassigned DNA
cggcctgaccggggcgccccgccgtcctcccagtgtaccccaccgctctcggctgggggcgcagcaccttggagagaggcgcctggccccgcgcctgggctgggggcgctctaccttgcgccctgggggtcaggggcgcttgccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcg

SEQ ID NO: 7847 - DNA, 1859 bp, Homo sapiens
  source 1..1859: mol_type = unassigned DNA
cgcacggaagtctctgcccagctgtcagcgcgcgtcgccaggggctgcactgaagctgtggacccgggatggggaggaggctggcggcctccgaagcagggtctacagcgggggagggctagcgccgtctggcggtggctgcgcgtggccagtgcggacccaggctcggctcggccggcgctgcctgcgtgtggtccgggcggagcgagggtccttggagcccggttcgtcctgggtcccaggaagctcggcgtgcagcgtcagaggccgcgtgtgctgggggagggaggagtacagactgtgcctgggggcatccaggacgaattcacagaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttgtgcaacagaaatccgcccgcgcctagcagcgtccggggccgcctgcgccggatccgcagcccagtaccctccgcgccctggactccgaggaggccaggtagagagcggctcgcgcggtccccgtctgcgccctcagccccgcgctgggcagcgggacatgcctggctccggcgccgccacctcggcttccgcttgcccttgagtgcggagcccggagcctccctcgcggtgcgctgggtcccagagggccagaggccaccagggggccggcatcggcgggagcccagccgggcgcgccctcggccctctcccacccacgtcctccgcggccgcccgggtccaggggcgcagcggggaggagaccccggccagggccggggagcgcgagggcggggcggggtccggcggggaggggcgcgggcgggcggggaccggggcgggggccgggtccgggggcggcggcggcgcgggcgggaggaggaggagcttcccgcgcggggcaggggcggagcgagcggccgcgccgcggagccaagtgagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcaggtaacgtgtccccgtcccgcctcggcccgggtcgccgtctcccctgctcctgggcgcgccctgcccggcccggctctggcctccggctcgcgcgccctcctccccggcggtcctcgccgccccaaaccctcaggacggagcccggcagccgtgcctcggcgagaaagttcgtgcttggacgcccggtcgtccacctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcg

SEQ ID NO: 7848 - DNA, 902 bp, Homo sapiens
  source 1..902: mol_type = unassigned DNA
cgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccaaacccccgccgcgggacggggtggcggggtcaggaccgccaggagcggcccgggtcgcgagggttaatggggccgccctcccaggggcgaggaggcggcgggaaacgggctcggggtggggaacgagttctgggatcg

SEQ ID NO: 7849 - DNA, 2044 bp, Homo sapiens
  source 1..2044: mol_type = unassigned DNA
cggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagaggtcaggcgatgctgtgggcttccaaatttgtacagctgcgacactctgcgacgtgccaccctatccccagtggggtggggtgggggattccctccgcagtccgctgaaagcgaggcaggaatcactgcaactcctctgctcaggctgaggtcgccaccgctccgcggatgcacgcgctgcaggggcgccttccgccgcgggcacggcgcgggaagggatggggtctggtgggagtgggcaggtggcgggagaggcgcgtgtccgtgcactagaggcccccgtgcgtgacacaggccgatgagctcctgcgggctgcacccacgcggagtcacagaccgaaaaggtcagccggtggccggtgtgctaacatatatagagagacgcccgccaggcgcgccgcaggctgggacgaggctaggagggcccaggctggaggagggctgaggagggctgcgggggcgggccccggcgcagggcgcccggagcggagggggcgggcccgaggcggggcgggccgcggcgctgacgggctgtcgccgctgcactcgcctccagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaaggtaggcagcggggctgcggcgctggtgggctcggccccctcacctgcccgccgaggcgcggctgctccatagcagttttcggggggcagatatggggagtactgccccccacaccagggtcctggatgattccgggtctcccaggtgggggtcacagtttgaggggcgactgtggatgataacgctcgacactacggggacatgtaggttcggctgggcctagaaccgagcagggtgggggcgggtgggctgtggttgggggtcctgagggctgaggtgggggaccttctccctgcactggtccctggcccctgggactctggccgggctggatagggatccgggtgtcggtgtgggcgtgggggcagcgcgtgttccctgtcaaagctgggagagggatgcaggtgacaacttgtagcgttccattccgataaacacggccgctgtgctgcgggaggattccgatccgggtcaggtttcgctggaacggttccctgagcaagtgcacgtgggccgcgggctgccggcctctgccgtttcg

SEQ ID NO: 7850 - DNA, 1152 bp, Homo sapiens
  source 1..1152: mol_type = unassigned DNA
cggcgcacacaagttgaggactgccgaggcgtctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcggcacagcggccccctcgctccgcggcccccgctcgccgagacgtggctccaagaagtggtgccgcagccggggcagaggcggaggaagccgagtcgggcaagccgggaaggctgcggagacgctttgccggggcaggtgttgcagcctcagctagcggtctctacggagggggcg

SEQ ID NO: 7851 - DNA, 872 bp, Homo sapiens
  source 1..872: mol_type = unassigned DNA
cggccgggcttagcgatgcggctgagctgcccacccgcgtctgttgaatcggccaatcagcggcgcccccggacctagcgggagcgtttccatgccgaccgcggcaggcgtgcgctctccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccgcccggctcccggtgcatgtggcctgcgaggcggcagaggagatgtggggatttagggtcgcacgtcgtgctcgaggtccccacgagaggtcttcccccgcgggctcctgcgcaactgcgtgaagccggcccgggaaagccaagattgtggcccaggaagaggaaggaacgcgggcgacagagctggggcttgggacgttgagggggtcggtggcagctctccg

SEQ ID NO: 7852 - DNA, 1070 bp, Homo sapiens
  source 1..1070: mol_type = unassigned DNA
cggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacgtccggcttcccgggatcgtccggctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcg

SEQ ID NO: 7853 - DNA, 395 bp, Homo sapiens
  source 1..395: mol_type = unassigned DNA
cggcggtctttcgccctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcgatgtgggccgtttttcccttcccagcg

SEQ ID NO: 7854 - DNA, 265 bp, Homo sapiens
  source 1..265: mol_type = unassigned DNA
cgccggactcgcggaaaaggccgctggaagccccccctgaagccggcagcaccaagaggaccaatacgggcggtgggtatcgcttccacctccccgctggccccatcccccgccgcccgcccctgcctccctccctcgccgtcctccctccctccttccctccctccctcccgcggcccggacacctccagcccgaacccggcggcccctgcgcccctgccccgcgccccctcccctgcacctgccccgcgcctaggtgtccccg

SEQ ID NO: 7855 - DNA, 1169 bp, Homo sapiens
  source 1..1169: mol_type = unassigned DNA
cgagcccgcgccaagagctacgccgagacgcgccgtcggtggggccacgcgagatgcaaccggagagtttaaaactagcccaggaccaaccccccagggatccgctcaactctccccgcagaagagtttaagtggggcagtggccgccacaggctgaggatgatttccggacgcgccccaggcgcgaccgcactactcgtcctcagttcaaagcctgagtgacttggcaccacttccccaattgttttttatttccttcgcatccctgttgtgtctaccgctttcacgtatttgagagcctaaatcatgttaagacgacttggagaaacgcccgatttgcctcccaagccacgcaaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcctcttcccctatggcttcattcccgttgtcagtaccccgacctcagcttgcaaccttgatcttgggcttgattataaatgacgaaagaccgcggcagccttcaaagtgcgggagcgagccccgtactggtcagcgcggcggagggatctttccaggaggccccaagcccccaagcctgtggagagacttggtaacagctggcaaggcctgctccagccaccctcgctggctccttgcccctgcattcagcgcctgagggcgttattcgccctctccctgcgtcccacgcaagcggctcaaggaactcactcgatccggattccgcctcgtatgctctccaagccttcgccacctccgcaggcgctctagaaaggcgtgatggccccagctcagtgcccgccagcccg

SEQ ID NO: 7856 - DNA, 1743 bp, Homo sapiens
  source 1..1743: mol_type = unassigned DNA
cgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccagtgtgccctgccagctgcacccaggcgtagcgcttcttgaaagggcttatgaccggcagattgaccatggtccggatcttctgccagtggtttttctgaaagcgacagggtcaaggtctgataatcggcgtctcggcaatgcataagccctccctccactgaaacagggtctcgccacgcccccgacccaccg

SEQ ID NO: 7857 - DNA, 2405 bp, Homo sapiens
  source 1..2405: mol_type = unassigned DNA
cgggggaggggtatacgcagtttccgtgcggaaagatggtgtctttccttcacagggctgcgcgggcacccatccccgctgcaaagcgcccgggccaggcgcggcttgctccgggtcggggcgagctcgctgccctctgcggcagacagcgatgcgcgctccccgccccagctcccggctcgcccggcggcccgcgcgccctcccggtgcagcatgcgggcgctgtgacgttctcggataaatgccgtgtaactgtgtaggcgaatgagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaattcaatgtgacccggctgactatgcaaagactaggactggacgcttttgcagctctatttcgccacccaccttcctccttccacctcgtattagaaataaagtggggggggggggcgagcctttggaggagaaaatgacaactggcacttaaccccaggtctacagtgcgccgcggtggggcgcaaagacgcaaactcccgggatggcgagccttcggggtttcattgggttaaacgaaaattgatctgatttgctttttaacatccgagggagagaaggggagatgaggggagggagggcagggtttgagtgtgtgcgtgtgcgtgtgcgtgtgtgtgtgtctggggagggggaggaggcaccaagttgcagcctgcgcgcggctctgcgcctcggcggggctgcgtgcgtgtgtccctgtccgcgctgctgaaacgggctcttcgagggatcggcgtcacatgactccgcctgcccctcgccagcgcgcagatcgccagtccctcagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacaggtgaggcgagcgtcgcgtcctgacctccctgcgtcccggccgcggccctgggggctcagggccttcggctggctgatggcgcttgaactttggcccctctactcttggcgccctaggcgctctctgcaccctcagcgagaggggaggcttgctcccagccaggcgagtgactgcggcgggcagagggggcagggattgagggcggggagtagatgtgggctgcggctgcccttcgccggacgagccccgtgggaggcgggtacagaggggccgacacctggagatgcagaggaagatggggtcctaaggaccagagacgatgagtctggacacacgtccagccaaaaatggtgctcccaacccccactcccaccgcccagccctaatagccccgatcgtctgttctacaccgggaacgtgtaattccccgcgcttaggcatgggaagggcaagacggaggcgtccgagcgctgccagcccttgcctcgccgcagctgagggcggagagcggtctgcgctagctcctcggagttgggctggggttatggggctacacgggtcggttcggtaccatcgagcggtggtgggctcccagctggcggccgccggagcaacaagcccaaagattcccaaggaccgctctgatgcgccggggctagggccagggctgctgcggaggcagcgggacgaagtgggcgcttctctcctcccccgccccctgcgccgccgccgccgccgcagtcgcggctatagcgctgcg

SEQ ID NO: 7858 - DNA, 1920 bp, Homo sapiens
  source 1..1920: mol_type = unassigned DNA
cgggcgctgccccctgcggccccctccgccgaggcctgtgcgtggcggggttcccaggagcggcagtccgtgcggcctgggggcggccccctccccgcatcgcagcggggcgtgcaaagcgtctgcggctgtagtgtgggcgctcacttcacgtgctcggcggcgtgcgaggagcagtaatacttcttgtgggcgatgaaggtggacaggctgctgaacttgatgttgcaaagacggcagtaccggtggttgccgttgggcagcggcgccggcgtgcccttgctgggagtctggacgcccttgtccgagtaggaggggggcgccggcgggggcggcacggcctcgggcgcggcggccggggacgggggcgggccgggcggcggctcctggggctccgggccgaggccgtcccgggggccacgggacccgggctgcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtcgtcctccgcgtcgtccacggagctacccgggctctggctgccctcgctgccccggccgcccgcgccgtcctcgggcgtggccgcgcccccagccccctcctcgcgcgctccggggcccggggacgagcgcggcgcgtcgggttcggcgggctggccggggggcgcgcgggccgggccggggggcgccttgggcctgcgcgcggcaggcgcgtcctcgggcgcacggcggcctgaacagtagaggcgcttgtgcacgtagtagttgttgacgttgctgaaggtgatctcgcactcgaagcacgtagcgcccttgggggccccggggaagagcccggtctgcgcgccgccggcgcccgcgcccgcgccctgctgcagccggctgtgcaccagctcggacatcttggccaggatctccgaggcggggggcgccgcgtcgggcccgaacacgtactgcggaaggaacagggccccggccaggcccagctcgccgggcaccgggctggagcccggcgtggggctggacagctcggccttgaccctggccggggcggggctgcgcggcgacggcgtccgcgacggggcctggggcccaggctctccggggcccaggatgggggccgcctccggctcctccaccgcctccaccttgatgctcctgggggccgccgggggctcgctgctgcctccattctgggccagaggctccgctctggcctctccgttggtggcctcggccagggcctttctgtccagtcctggcgatggggtgggcgccaggcccaggtccgcg

SEQ ID NO: 7859 - DNA, 1403 bp, Homo sapiens
  source 1..1403: mol_type = unassigned DNA
cgcccgtccctcccaggcccggtgggaccagacccgaagccaaccctcgccaggcgtcaggtgtagaccccaggccaggccagagcagttcctgggtcttcggaccgggatgcccgccctgcccctcctcctggccccgcccggtctgtcacagggggaggcctcggcctcgcattccgggcagcgaacttcgccggccgaggttagccccgtgcgggggcctcccgcgggaccgaccgccaagcggcattgtccgtcccgggcgcccgcccggttccagacgcaggtcctgcggccgccccgtgacaagcacactgacgggccactgtcctttgacgagtgctaaaaagttcgtttgttttgaacgtcaattttcaagtgatcttcacgaggtttcccctcccggttccttcgctgctgcctcgcccgcactcggtccccagtaggtgctcaagaaacgtccagcaaacggcagcgcaggcgagtctgctctgcgcgctggcgcgtttcactgcccacggatggcgggcgacctcacgggatccccggttcgcaggatccccgcccccgaggctgcctctgggccgggaggggttaccccagaggggcgtccactctcgacggcgggggccggggcgccgcgggcaggggagggcgcagcctccaagcagccccagcctggcctagaccccgcgcctagcgagccggccggccaggcccacaccccccacctgccgcccgccccaggggaagggtccccccgacgacgcccgagcccccctcttcctcggagggccggaggccggcgcccattggccggccctgggcgacgccccgcccctccgacgccacgggccaatgagcgcgcgctgtcagctcatcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccggagggcttcttccccgcggatcccgagctcgccccgcgcggccccgcgccccctgcctctttgcaaagtaacttctagggccggcccggggcgccccctccccgcagcccgggcggccggggctcctgagtccggcggggccgcaccaggggtgggtgggccggggccccgggaggggaagcgcgagcgcgggagcgaggaagaaaggcggcggttcccggggaccccgcg

SEQ ID NO: 7860 - DNA, 1088 bp, Homo sapiens
  source 1..1088: mol_type = unassigned DNA
cgctgaggggccgcactcacccgcgcaggtaccagcaggcagccctggcgtccgcgggaggcggccgggggcgggggtccctcggtgcccatcgccgcccctgcggctgggtccgcgctccgggccggccgagctcaacgccaggaccccgtccgagcctcccagggccccgccaggcgccgcgtccgcgcccgcgcccctctgccggctccggctcgggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggctggaggaggggagcgcgcgcttctacccgggctgggtcgccgaggtccgcggcgcatcgtggcggcggtgggcggaggggggcggggggcacctcttctcccttgtggcgcaggtgggcgcgctctggaccggcttgacgacccctccccgccgccccacctccctggccaaaggttctcagcttctaatcagggacatttctagtccacagcctcgaagccatgggttctccccggccctctgaagccgccacacctgtgccagccggccgcgtcctcagacctttccccgcggagtcttcccagcacttggagacgcagcgcagggccccgaggacggcctggcccggagaaaagataccgaagctccaactttccccaaccccgctcccctcctccttccaccctcccttcccgcccccaaagctcgggggtcctatccctcctccggtccgcggagtctcccgaaccctgcggggacccggcgctcggcggtgccctcctggggcgcacggggctggggcgggagcgaggagaccaggtggggaggggaccccagatctcagacgccaggggagacggcgtttcccg

SEQ ID NO: 7861 - DNA, 1812 bp, Homo sapiens
  source 1..1812: mol_type = unassigned DNA
cggggtcgctgcgtcttcctgaccactgacggccaggacggccccagccccgctttacctgcaagccccactccaggctcgagcccccgagggcagggatagcttcccgggtcccgaggcttgaccagagcctgaaagctcctgccgggggttgctccgactcagcgaggcgccaggctgcccggcgcggctgggggcgctcagcgccgggaccccagccctgccccggccgcccgctggcccagtgcgcacgctccggcagctcagctccccctcccacggcggcaggagagctcccggcatctgcccggggcgggggcgggggcggggcggggcgggcgccgcgccctcctgcctgactggcaggaagacagaccaatcggaggggctccccggggggaggggcggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggtgggtacaggtgcgccggggggcgggaggcgagcgctggccagagggaacccgtggacccggcgaccgaggggcggacctggcggcaagggacgcggcgaccggtgccgccccgccccatcgtccatctccccctcctccggccatcgcgccccctctgggtcccccttccactctcgcatcccacctcagtggtcccccacccttccatacccatcccccactcctcttcagacccccttgcaaaatctcccagccgctgcgtcgcttcccccaacaccccctcccggtcccgcccccagcccccagctctccttcacgccacccctatttccactcttctccggattccgccctcaagccaaggagcgggagggggacccacccggtgcctgccggagtggcgcggggggtgtggccggcccgtcccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctgccgggccggcgcgccctgggcgcactggcctccggagatggcgcgcaaggattgactctcgtggtgccagacaccttgccgggcgccctgcgtcggggccagcggcctcgctggcctgcgtcagtgcgctgcggcctcgcctcccagcccctcggtccttcgctccatcccccctgctgtgggctcctgagcatccggcctgggcagcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccg

SEQ ID NO: 7862 - DNA, 5819 bp, Homo sapiens
  source 1..5819: mol_type = unassigned DNA
cggagggaaaccgggccgacgacaagggtggctatttccgggctcttcgcgcccggcccaagcgtccctgggtggggcagcccaaacggggagaggggccccgtgggccgagggcccgaggccgcagcgagcttagcgtttggccaaatctggctcgcgcgccttcccactgtcctgttagggctgtgtgacctcccggagccctacgtccccgcccaaacagctcccagcgcccctgctggcacccggggcgccctcaccccagctcctgcacccggcgcgccgcgcgcagaccggacggaggggaaagttggcaagagcgcggcgcccgcgggagaaagcgttaatgggcggccgggtgggagcagcgcgctcgctcgcccacgtcacgccggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcaggtagggagtgggctccgccgcacaaactttgcgaggattgctcttgcgcttaaggggacaaagtttgctacccgtcgctaggctctccagaggccgctgcgtttgctgcaagttgcgggaagcagggtgcgcgggccggcgcggggcggggggtggggggctcggagtggccaggcctgagtcctggacgcccggacggcgctccgtccagcctcaggccgtacccagggagcaagcggcgggggcgcagcgggagagaggagggagagggccgcgggcccccatggagggcggttgggaatccagagattcaccgcttgtccctgtggctccttctcctaccactggctccgagggggcctcggggctgtgaggaaatgacctgccaacctcgaggttcgccagtgcggcgtcagcgaccgtgaggcctctcaaacccacaccccagccgggtgtcccgagcggtgggcgggcacaggcgcccccaaggtctctggccccaggtctcagaaagaaaggcccttgcctggtgccccgggctcccggcttcgcctttggctggagttaacttctctgggctggaaggagctccctccggacgagctcttggtgcggggaactggtggcccccagggtaactcctgaagcaccagggctaggctggccgaagaagggtcagggcccggcctgtctccccggaggccttccatggttccgacggccaacggtaaccccgtcaaaataggcgacccgcctgcgcttcgcgttaggggctgaccatcccctgcctcccctgcggcctgctccggccctggtcctccgctcttcggagcgctccaggccagcgggagcacctcatctccccgaagctgagccggtgctgtgtactccgggagccggctgacttctggcccacctgctcacgggtgtatttagtaccgggggtccctagagggaggaaggctcagcactccgagtctatgcagacgcgttcagctgatacctgagatgctgagcgtcctatcgttggtgaaagggacactgggtgcctccgctccaggcttggccttttggtgaaggcacttggaaaatattccagtattatctatgggagaagggtggcccagtgagaatccccggtttgggcaggcgggcctaggccaggctacagggtttcagtgagatgtcccggtggtcgccaatccacaggctggattgaccctgtgtcctggaatgagtagtggggcctgggtgaggccgggcgggtcaggaggcctcctgggcagttgcgagcttcccgaggcagggtgactgtgactgggcccggaccccaggcgctggggcctgctggcgggcaggaagtggagcgtgtgtgtgcggcggcctgggaaagccgattcagaggccaggtttctgggtcacggagaaagggtcgcccgctggtggggactggagcgtcgatttatgcacacaggctggaaaggcaaaagagaacaggagaaggtggcggtggtggtcaaaggaagcccccgaaagggcccccacgtactggctgccctgggaagtggaggctgcttctcccagactctgctcagaagatgaatggccgcctgttctggggcttcggctccagttaagccccgccgggtctggaaggaaggaaatgcaccagcctcaggtctgggtgggctgagctgttgcactagagcccagaggtgcagggcataggtggctgggcccctgggccctggctctccccctcagccggcggagtgctcacagtcgccgaggccaggtccccgagtataggtgaggaaaggacaagccacagctgaatgcctcccctctgggggtctctactccccatcccagcccttggcccggctgggctcacacccctccttcagccgggcctcattacctggagagagcgagtagtttgtaaacaataaataatgggaagtagaaggatgctcgggaaaaaccagaaaactgcaaggagtggggaggagggagggtgggagaggggaggaaggagggtgggggaggggaggagcaggaggagagggaaaggggttgagagattcatttctagcgagaaaccccggtggctagtttcttattatttacaggaaggtgatattagcgattcaggtgagaaagaaagaaacgcggcctgccgcgaaatcaatacagaattcagaaacaattattaatgtcatttgactcgtgttctttatatatttctcgcggctaccgacgctaaactgtctgaataatttgcatggagcggctattcattatttccgatggtttccctctgcaagcagctcggacgtggcccgctccggtccaacgcgatcggagaactcgtattttcatctgtaaattaaagcaattacgcagcagatattatatgatgtgtactgtggtctccagatagtcatcaatcaccttcaaccgagctgtcaaaagagcaggcagatttcgtttctgggaggcaggcttgcagctggggagagggcgaggacgtcatcattaattagagggtgaccctggggcgattcacaggtctgaacccaggaatctttctgagcaagtctgcacaacgctgccttgcacggcttccttcccaacttaccacgggaggccggcccagggggcgagggcaaccggggcgagtcccggtcccggagggcgatggcgcagaaggcggggaacgggttcgggatggcccgggcgcccccttgccgcccccttgccgcctgctcactggcctccgctttgaacttgggcaaggtcccagggagggtactggccgagggagtcctggggtgggcgctcggtcccctcttccgattgctccgtgcgccccagacagaaagctgggcaaaatggacaggggagggcgcctccgccaggcacccaacgccccctccctcgcagccagccctgcggggcgccgggagggacgagcttagcgggaggggccggggcctgggttgaggaacctgctcttccgagcgcgcagggccgcccggcagtccccggcttagccgcgaggggcagggggaagccggcggagcacggccggcggaaaggggatcggggaggaaagtcggggaggcgaggtgggggcggtgggctgagcgggaacttaaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccaggtaagcggagccccgccccgcccaggccaccgcaggtgccggtagggcggatggggcggggacggggggtggggagtgtccgacctacgactgcctgcggcttccgagctagcaaggcctgggtcgcgcgcccctcacgcccaacccctgctccccaaacccccggggaaaggccgaggcgctaagaaaatccgacgggccgggcccgggttccctgatgtttgaaccacaaggctcaggctgtgccccaggggagtcctaggaccccaaggaacccctggggaaggaggcttggcgcgcaaatggcgtcagaggccttggaaaccctccggggaagggtgtaggtgctcggctgggccccacgtggcggaggaggccagacgcgcacaagctagtggaaaggggcgagcatcctggtgtggacggcgggaggcccgggggtactcggggcacgccctcgtgggcggcgcgcgggattggcaaggcccagggccccagcctccagcccggcttcccgccagtcctcgcggcctctctctgcagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcg

SEQ ID NO: 7863 - DNA, 2001 bp, Homo sapiens
  source 1..2001: mol_type = unassigned DNA
cgcccccgccccgtgccaagcgggcccaaggcccgaggctcccccgctcacaaccccggtgcccggaacacgtcttcgaggggccgtgctgtcggggttattactcgcgactggacctcgcgccgtgttgctctcctcgggccccgagcccgcccagcggtctgcacggcccaggcctgagctgcgggcttctcctgtggggcgcgctgggagtgagctctatccccaaagcccatttcaacgtcccaggtatgactacgacggcagaggccggccgcccaccctcgcccccttccccggccagagcgcctttgccgggagccgacgaccgcggcctgaccccgggccccaccgcctactcccggctcccgcccttcctccacggtcaggggtcacacacagcggacgccccgttctcagccgcccctctgatctctgaatttgggagccagcgtgtccgctggggcatgcactgccacgggcactgggacccctttgctgctgcggggaggagccccgacggcaggtgggaagacctagcctgcccgcgtccccgctccccagctcctgcgacccgggccgaggctctcagcccctgggcttccccgctccgggtttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggggtcaggacctcggctggagtctggctttttatggcgaggaagccgactgggaagggccctctggcgaggctttcctgttgtgccacttttccccggcagcgccgggcgcggggaacgcggggctgcaccggggcgggggagggggctttacccggcggctccgaggactcgactctggggtcgggcccggcgggtaggcctgcccaggagccagctggcaaatgcagcggactgtcacgttattccactgtcaccacttactgtaaatcactgtcctaagcctccgggagaatccgtcgaacctgagaggggggagggggatgggggtgggcgcgcaggaagccccacaggcaccagggactggtgacccaggacatcagcccctcgagttctctctgggaatttctagcacccagactgtccctgactgtagggaccacggtggggcgtcttccttctaagctctccccgggacaccgggcgcgcccccctcgcccctgggttagcgcacactcctccacgcgatgaccagcacagccactgtgaggcccggccttggccgcgtttgtcctttgcgagtgataataataaaaatcattggaattgcaaggaagcccctggccccggctccccagccgctgctgtcctgggtgtcccggctgcggaaagaccccgcagccgggcccgacccacgagtggaacaccgggctgcggacccagccgggcctacaggactggcgcggggctccggggacaggcctcgcagggccctcctgcgcaccgtctgggacgccgattttgccaacttggaggacaatttttgttttcactctaccagcagatttttaaaaatccagtcgccgctgaaacgtgcttcccacccgtccggtttgtttgtagcctttgacgagccccggcacagcctccg

SEQ ID NO: 7864 - DNA, 1265 bp, Homo sapiens
  source 1..1265: mol_type = unassigned DNA
cggctcgggcgccaggtagaactccagctcgatgctgccgccgtcgggggagagggaatccgttgggagggacagtcgggggctggggaaggaagagcgggtgctgggagggttcaacactggcggagccccaggtggcgacgcgggcggcgagagctgctccgaggcgggggcctcgggcaggtcgctctccacgcagtacacggagcagaagacttgtctcttggcgagggacgggcgccgctgacccagcacgtccaggaccagtccgtcggcggcccccacgcgggtcctgggctccagctcttcgccggggggcgcctcctgctgttcatcccctccctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgctgcccatccagccgccgggacccccacccggcgcccgcgggcagcgggggcagtggctcggctcgactcgcggctccgcttctgcttccgggtccttcctcctgggctgggacgccccaagtcccctccggggagcccgtgctccgaggctgcggcgcgtggggagcctggcccggcccgccgctcctcctcgtactctggcgcggcggggcaccgcctcgggggcgccgagggccgctcgctctgggctcgggcgcgcccgccccacatgcagctcggggcggcgccgcagccccagcgagccccaggcgggacagaggggtctgggaggagacggccgtcagtcccgcgccatcaccggtcccggctgccggacgcgcggcccgagggcggtggtcaaagggtcgaggggcctgtggcgccgccgcggcgcgcaccaggaggtgcagccggagcgctggccagccgcagggcccctgggggagaggccggagcgggcgacctccctctccccgcgcttcacctacagccctcctcgccg

SEQ ID NO: 7865 - DNA, 1360 bp, Homo sapiens
  source 1..1360: mol_type = unassigned DNA
cgccgaggatgtggcctccgccccccgcagccgccgcaggagcttctgcctctaaagcggcaggcaggggtctcagcgggcccacttcaacctgggaaggccggtgcgtttccccacagaccccgcagggcgtttcttctggggaccactgaagccctggcatccccaaccccagcccctccgcgccacgggaaacgaagacgacactcttttgaacaatcccggatgtgtcaccacagaggggcattctacactggcccctaccccaacccccacctagcacattgcttgcccacccctcaaaccccgtgcggattgcggtacctagccccgggggaccctccagccctgccttcccgatccgcgtaggtgcgtccgtccacctaagggtagggaggcatgtccctccgggtccctccggccgcatggcttgcctgcccccctggtctcccttctccgcatcaggaggggcgtgagatagctaggtcgacccccaccccggcagtctgcggcgatcggccgccccgagcgcagcgccagacacttgggttggggggtgtcagcctgacgcgcaggaagggcgcagcggcgggagggggcttcatttcagatctgggaggcttgcctggcgccggccctcgcccgctctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgagccgggtctccgcgcctgtgtggccggctggcggccggggtccgtgtgtccctgcgcggcggcgtgtgcgtgtgcgcacgcggggaccacgctcgcccggagccgccgccgccgccgtcactccctgcccggggccgagcgcagcgccccctttgcccgccccgcgcggcgcggcagtccagcttggctccgtcctgcgggagaggcgccgcctccgccgcgaagccaggctgggcgctggagggaggcgaccgaccaccgcctccccctgctcacttcacaggctggggagggggtgctgcaggccaatgagcgcccgggggcggggttagatcgagggcggtgcggtggggggcgcggtggggggcgccgggctgctcaacccgaccccacccgcagcacagactggagcaggagctgcggcgggaaatcccagcggcgggggtcgggggcg

SEQ ID NO: 7866 - DNA, 362 bp, Homo sapiens
  source 1..362: mol_type = unassigned DNA
cgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtcttctggagctcgctgagcacgcacacgcgcaggcgaagctgcttctccaggtccttggcgctctcggcgcggctgtctccgcggctgtcctcgctcatggtcggcggcggtgcgcagcgcggcgctgcccgccgtgctgagcg

SEQ ID NO: 7867 - DNA, 2566 bp, synthetic construct
  misc_feature 1..2566: note = Description of Artificial Sequence: Synthetic polynucleotide
  source 1..2566: mol_type = other DNA
ygttgggygatgagggatygttgggtaattgggggtataggatygggtttygttgggttyggggtagaagygtygaagtttygattyggaaygyggtgattttattaaygtagaagttygygtagtygagtagaggagtttttygtaggygattttyggatagaygtttttgygyggttygygtggtttagtttygttttaggaaatttttygygtagttttygttttatgygtttttatttagttttttttyggggtygttttttttttaaagtagtttttygggtttattgggygttttygtaatygggtyggaatttygaayggtttygygtgttattyggttattttggtaatattattyggyggygttyggyggtttaattttagtttgyggtttttttygagtttttygtaaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttttygtaagygggtaayggggtgtatyggtagtyggaaaggggygttygttyggagtttggagtagtatygyggttttggyggggagyggtygggtttttagggtttygygygttyggggtyggggtagyggygttygttttagtaattygggaagtggggtyggttaggygygttygtagttttaggagttagtagygtagtgttttggtyggttgtttyggygygtttttttttyggggttyggggygaggygtyggtygttgggygyggygggygygggggtyggggttgtyggggaaagttaaagtttygggtttttagygagagtttygtaggyggagttggaggaaattatagttaaatagttatttygttttttttttttttttttyggggtttyggggttgagtaggggttttttaggtttttagttgtygatttagttgtttgygggtgattttygggttygaygggygtttatagttggygggtagttggggygggagagttggggtttttggggagtttyggyggttatttygttgtaaatatataygtatataygttygtyggygygttyggggtttgtttgtgtttgggattttagggttagatggaagagggggttygagtttagagttygtggtgggggtgtttagaaagatttttttyggtaaattttgttagttygtyggggttttygggtttttttggtttttgtttggggtggtttagggtttattagagtatagttgtygtttttgttgggtaggttgtttttgagttttygtttttttgtyggggtatttatygagttygtgtatttgggtttygggttggaatygygagyggggaggatagaggtggaggyggagagtagygtgyggttttygagtttgtttattgggatgtattgygttttygygttggggayg

SEQ ID NO: 7868 - DNA, 572 bp, synthetic construct
  misc_feature 1..572: note = Description of Artificial Sequence: Synthetic polynucleotide
  source 1..572: mol_type = other DNA
ygtttaagaagtyggggttttttttggttaygygttttygggggygttygygttttttaggttttggttgtttgggygtygattttygggaygygtyggtygatagtaggggaggyggtagtagggatygtagtagttttygttttygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagyg

SEQ ID NO: 7869 - DNA, 989 bp, synthetic construct
  misc_feature 1..989: note = Description of Artificial Sequence: Synthetic polynucleotide
  source 1..989: mol_type = other DNA
ygtggtgtgtgtgtgygygygygagtgtgtgagygttaggggtygttygttygtygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygttyggggttgggatgygtygggggtttagtggyggyggyggygttggyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgyg

SEQ ID NO: 7870 - DNA, 2400 bp, synthetic construct
  misc_feature 1..2400: note = Description of Artificial Sequence: Synthetic polynucleotide
  source 1..2400: mol_type = other DNA
ygaaggtgtygttagttttagtgtyggtgggygtttgtattaggaatagttaaagtygaygatatttagttatttygagygttagggaagaygtttygygtaaaatygyggttttaggyggattttygttttagtttygygttgttggtggtattttyggggatttaaagtgggtggtttgggggtaaaggaatagaggtygaagaatttggggtatgttttattagagtatttaagggayggagtgggaggttatattagatatgygatttygatatattttaaaagtggtagtttygtgggttatttttaatagtgggatggatttttttaatttttttygtttttygaagtttttttgttatttygggttatgtttttttttygggatttttttgtgtaaaattatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattygagtttgtgagttttygatttyggttttagtygtagtygttaataattttataataaataagaggataggattgagygttygygtttyggagygtattggttgggggtaattttttattttyggygygtygttygttgtttygattygagagtatygggagagtygagggaagggaaggyggygaggggaaggtaggyggggatggagggaggtayggygyggygyggagygaggaggtgggttgtaggggaygtygagaagyggtggggttggygtagagggygggygttyggggygygygttattttygttttgttttygtagtggtagtatayggtttataggtatttgagygttygttagagtaagatgatgaagaggttttygaagaaagttattatggaggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagggggygtygygggtygttygygttyggggtttgygtygttttygggttygtttyggtttygygygyggtttygggtgttttyggygtygygtygttygtygtgygttaygggtgtgygttgygttyggtyggtgattttttttttygagygtttttygygyggttaaygagtygtttttygtttattaggtggtaattygttaataatggataatyggtttttttygttygggygtttttgygttagtttttttttttyggttgygttyggtttyggttygtygygttagtgygygttyggtygyggtaggtttatygygttyggtygtyggttygtggtygtttgttagtttatgttttygggattttttagttttgtygttaygtygttgagtttttyggttttygttygttttttttttttgtygttttygattttttttygttttygttttygtygtttaagttttttyggygygygtttygygtttttygtagtygttagtagtagtagttgtagtaattggagygggygyggatttaggaygatttaggygggaggggaggaggttygtygygttggttygtttgggtttygggttgggtaggggtgggtagggtttttyggtagyggttyggtaagygtttttgatttttagggygtaaggtagagygtttttagtttaggygyggggttaggygtttttttttaaggtgttgygtttttagtygagagyggtggggtatattgggaggayggyggggygtttyggttaggtyg

SEQ ID NO: 7871 - DNA, 1859 bp, synthetic construct
  misc_feature 1..1859: note = Description of Artificial Sequence: Synthetic polynucleotide
  source 1..1859: mol_type = other DNA
ygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggaggtggaygatygggygtttaagtaygaattttttygtygaggtayggttgtygggtttygttttgagggtttggggyggygaggatygtyggggaggagggygygygagtyggaggttagagtygggtygggtagggygygtttaggagtaggggagayggygattygggtygaggygggayggggataygttatttgttygtggagygyggggaaggggtgygyggyggyggyggyggyggagtttggygtagagggtagyggtagtagygggagtatyggttygttyggggtyggttagtyggggagatyggggagtagyggggtygygggyggyggggtygaggygagtagtatygggggaattaygattttygygttgagtyggagtagttyggtygagttyggtattatttagatttagggyggyggyggyggyggttttgygtttatyggttagaggagaggttgtygtygtyggggttgttgttgttgtagttgtygtygtygtygttggaatttggygttygtttgtattttatattttygygttgayggyggyggygggggyggygggygttygagatgttgggtyggyggyggygyggtttyggagygaatttatttggtttygyggygyggtygttygtttygtttttgtttygygygggaagtttttttttttttygttygygtygtygtygttttyggattyggttttygtttyggttttygttygttygygttttttttygtyggatttygtttygttttygygtttttyggttttggtyggggtttttttttygttgygtttttggattygggyggtygyggaggaygtgggtgggagagggtygagggygygttyggttgggttttygtygatgtyggttttttggtggtttttggttttttgggatttagygtatygygagggaggtttygggtttygtatttaagggtaagyggaagtygaggtggyggygtyggagttaggtatgtttygttgtttagygyggggttgagggygtagayggggatygygygagtygttttttatttggttttttyggagtttagggygyggagggtattgggttgyggattyggygtaggyggtttyggaygttgttaggygygggyggatttttgttgtataaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttttgtgaattygttttggatgtttttaggtatagtttgtattttttttttttttagtataygyggtttttgaygttgtaygtygagttttttgggatttaggaygaatygggttttaaggattttygtttygttyggattataygtaggtagygtyggtygagtygagtttgggttygtattggttaygygtagttatygttagayggygttagttttttttygttgtagattttgtttyggaggtygttagttttttttttatttygggtttatagttttagtgtagtttttggygaygygygttgatagttgggtagagattttygtgyg

SEQ ID NO: 7872 - DNA, 902 bp, synthetic construct
  misc_feature 1..902: note = Description of Artificial Sequence: Synthetic polynucleotide
  source 1..902: mol_type = other DNA
ygattttagaattygttttttatttygagttygtttttygtygttttttygtttttgggagggyggttttattaattttygygattygggtygtttttggyggttttgatttygttatttygtttygyggygggggtttgggggtgaggggygygttttggggtagaggattgygyggtagggtttgttatagggtagaggttagggtttttygggaaaaaggtaggygtatatatgtttttttttttgggaaaagayggggaggggggttttttttgggagattttaggtttygaaatttttygttttttatttttyggttttygtattttttttttttttygttaygtatttttttttttttttagttatttgttttatttygtagygtygygataaatayggttttagttygttttygtttttgtttagttttttttttaagtttyggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgaggatttyggatatagagtgtagagatttyggtaagtttattgaaagttagtygaattyg

SEQ ID NO: 7873 - DNA, 2044 bp, synthetic construct
  misc_feature 1..2044: note = Description of Artificial Sequence: Synthetic polynucleotide
  source 1..2044: mol_type = other DNA
ygaaayggtagaggtyggtagttygyggtttaygtgtatttgtttagggaatygttttagygaaatttgattyggatyggaattttttygtagtatagyggtygtgtttatyggaatggaaygttataagttgttatttgtattttttttttagttttgatagggaataygygttgtttttaygtttatatygatattyggatttttatttagttyggttagagttttaggggttagggattagtgtagggagaaggttttttattttagtttttaggatttttaattatagtttattygtttttattttgttyggttttaggtttagtygaatttatatgttttygtagtgtygagygttattatttatagtygttttttaaattgtgatttttatttgggagattyggaattatttaggattttggtgtggggggtagtattttttatatttgtttttygaaaattgttatggagtagtygygtttyggygggtaggtgagggggtygagtttattagygtygtagtttygttgtttattttttttagygtyggttgtygttttygggtagatatygtyggttttgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagygtttyggttgtttttttagagttttttgttggggggatatygtttttatgaagaaaatttttaaataaattttagtttaggaggaggttataygattatgttygygggttgtyggtyggaggggygaggaygygygggyggaggygyggttgtygtgtttaggtagggagtygagtttygggtgttygtygygygtttttygtyggggttatgtattttygtttgygttygatatygygggttggaggygagtgtagyggygatagttygttagygtygyggttygtttygtttygggttygtttttttygtttygggygttttgygtyggggttygttttygtagttttttttagtttttttttagtttgggtttttttagtttygttttagtttgtggygygtttggygggygtttttttatatatgttagtatatyggttatyggttgattttttyggtttgtgatttygygtgggtgtagttygtaggagtttatyggtttgtgttaygtaygggggtttttagtgtayggataygygtttttttygttatttgtttatttttattagattttattttttttygygtygtgttygyggyggaaggygtttttgtagygygtgtattygyggagyggtggygattttagtttgagtagaggagttgtagtgatttttgtttygtttttagyggattgyggagggaattttttattttattttattggggatagggtggtaygtygtagagtgtygtagttgtataaatttggaagtttatagtatygtttgattttttgtgtaatttygaaygttagtttgttygggtaattttgagtgggtttttgtagtyggttatgttagyggtttttgtatatttgtattygyggttttygttgtttgtaggttgtagagaygggggtattttaaaygtgaaagagtaatgaaggaaaatgtagatagagygaggaygtyg

SEQ ID NO: 7874 - DNA, 1152 bp, synthetic construct
  misc_feature 1..1152: note = Description of Artificial Sequence: Synthetic polynucleotide
  source 1..1152: mol_type = other DNA
ygtttttttygtagagatygttagttgaggttgtaatatttgtttyggtaaagygttttygtagttttttyggtttgttygattyggtttttttygtttttgtttyggttgyggtattattttttggagttaygtttyggygagygggggtygyggagygagggggtygttgtgtygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggagaygtttyggtagtttttaatttgtgtgygtyg

SEQ ID NO: 7875 - DNA, 872 bp, synthetic construct
  misc_feature 1..872: note = Description of Artificial Sequence: Synthetic polynucleotide
  source 1..872: mol_type = other DNA
yggagagttgttatygatttttttaaygttttaagttttagttttgtygttygygtttttttttttttttgggttataattttggttttttygggtyggttttaygtagttgygtaggagttygygggggaagatttttygtggggatttygagtaygaygtgygattttaaatttttatattttttttgtygtttygtaggttatatgtatygggagtygggyggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttyggagagygtaygtttgtygyggtyggtatggaaaygttttygttaggttygggggygtygttgattggtygatttaatagaygygggtgggtagtttagtygtatygttaagttyggtyg

SEQ ID NO: 7876 - DNA, 1070 bp, synthetic construct
  misc_feature 1..1070: note = Description of Artificial Sequence: Synthetic polynucleotide
  source 1..1070: mol_type = other DNA
ygagyggtggttygatttygggtgtggtaggaaggggtgtttygygttttagagttagtgttagtttttattttttygggaagtygagatttagggggaataggttttttagagtttagtttgtagggaygyggagggtaggagtygtyggygaggagtagttaatttgttatttttggyggttgtatttttyggyggttataggttgttygatagyggattttagggttttygygayggtatttagagtgtttagaagggaggtyggggtyggggtgggtygggaaaatygagggagggaaggagtttggagaagtttygtttaggyggggagggggygattyggggygtatttttygattatgatttttatagattttggygtygtaatttgygttttttgaggtygaagatgygtattttggagaagatatttattaggttgtygttgtagagttygyggtttttgttggggttgtttygttttttgttggtagayggtyggttttagtgttgttttygygtttgtygtttttggyggattaagtygttagygatggtygyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagtyggaygatttygggaagtyggaygtygtggtygtygtygtttggttaygttygagtggagagygggatygyggttgygggygttgttggttatygttygtygtaggaatttyggygggggtygttatygttattygygttgttttttygttttgttyggttttygggygggaggtagagtyggtyggyggtttttygggygtyggttggagggygggtttyggtagggtttttgygygttygtyggttygggtygygttgggtaggatttagygtyg

SEQ ID NO: 7877 - DNA, 395 bp, synthetic construct
  misc_feature 1..395: note = Description of Artificial Sequence: Synthetic polynucleotide
  source 1..395: mol_type = other DNA
ygttgggaagggaaaaayggtttatatygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagggygaaagatygtyg

SEQ ID NO: 7878 - DNA, 265 bp, synthetic construct
  misc_feature 1..265: note = Description of Artificial Sequence: Synthetic polynucleotide
  source 1..265: mol_type = other DNA
yggggatatttaggygyggggtaggtgtaggggagggggygyggggtaggggygtaggggtygtygggttygggttggaggtgttygggtygtgggagggagggagggaaggagggagggaggayggygagggagggaggtaggggygggyggygggggatggggttagyggggaggtggaagygatatttatygttygtattggtttttttggtgttgtyggttttagggggggtttttagyggtttttttygygagttyggyg

SEQ ID NO: 7879 - DNA, 1169 bp, synthetic construct
  misc_feature 1..1169: note = Description of Artificial Sequence: Synthetic polynucleotide
  source 1..1169: mol_type = other DNA
ygggttggygggtattgagttggggttattaygtttttttagagygtttgyggaggtggygaaggtttggagagtataygaggyggaattyggatygagtgagttttttgagtygtttgygtgggaygtagggagagggygaataaygtttttaggygttgaatgtaggggtaaggagttagygagggtggttggagtaggttttgttagttgttattaagtttttttataggtttgggggtttggggttttttggaaagattttttygtygygttgattagtayggggttygttttygtattttgaaggttgtygyggtttttygttatttataattaagtttaagattaaggttgtaagttgaggtyggggtattgataaygggaatgaagttataggggaagaggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggatttttgygtggtttgggaggtaaatygggygtttttttaagtygttttaatatgatttaggtttttaaataygtgaaagyggtagatataatagggatgygaaggaaataaaaaataattggggaagtggtgttaagttatttaggttttgaattgaggaygagtagtgyggtygygtttggggygygttyggaaattatttttagtttgtggyggttattgttttatttaaatttttttgyggggagagttgagyggatttttggggggttggttttgggttagttttaaatttttyggttgtatttygygtggttttatygayggygygtttyggygtagtttttggygygggttyg

SEQ ID NO: 7880 - DNA, 1743 bp, synthetic construct
  misc_feature 1..1743: note = Description of Artificial Sequence: Synthetic polynucleotide
  source 1..1743: mol_type = other DNA
yggtgggtygggggygtggygagattttgttttagtggagggagggtttatgtattgtygagaygtygattattagattttgattttgtygtttttagaaaaattattggtagaagattyggattatggttaatttgtyggttataagtttttttaagaagygttaygtttgggtgtagttggtagggtatattggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttataggatttatttagaggaggagttgattaaggttygtgagyggtttaagttgyggaaggatatgtataagaaaatgttggyggtggattttgaagtttttayggaggaggagtaygygtagygygtygttattaagtygygttatatgtagtggygggaaggtattagttttagtattattttyggttttygtatygagggtattaaggtgaggtaggygygtttygttggtatygtygtagttttattgygygttgtttttttygatttttygttttygtttygtttgttttttygtttttttttatygtttygtygttttttgtaattgggaggtatygttgttttaygttgtttttttttttattggygggttyggggtttttgatatttttgttttatatttagaaagyggayggtttttgtagtatygattttaagattaygygaagtygagagtaggtgtttygygtttttgaagagtttgtgtaaggagatgaggaagtgttggtgagagygggattttaaattttgaggtgttggggagtttgaagtygaggattgtttttgttatttggtttagtgttttyggttgtgtttttattatggtttttatygygttggttygtaattgttttaygtttttttttttttgggttaygttgggyggggttttgggttttttttttggyggtatttgttaagtatagygtgggtttyggttttttatygttagtaggggtttatttggygtttagttaatttgttttttttttttattttattttttgtagaggyggtatttgaatygtttgtagtagattygggatattttggaggtattygagttttttaggaggtaygaggtaagyggyggttgttygggtgttygggtygygagggttagggygggaattyggtaagggygtttttgggtagggtygyggtttgayggtgyggggttygtaggtgatyggtagttygtttttttttgtgtaygattattgttatygygtyggygtgtggtttatygatttyggtaagattaygttttttttygatggttagattttggattatyggyggttttgggaggagggtaatygygaggayg

SEQ ID NO: 7881 - DNA, 2405 bp, synthetic construct
  misc_feature 1..2405: note = Description of Artificial Sequence: Synthetic polynucleotide
  source 1..2405: mol_type = other DNA
ygtagygttatagtygygattgyggyggyggyggyggygtagggggygggggaggagagaagygtttatttygtttygttgttttygtagtagttttggttttagtttyggygtattagagyggtttttgggaatttttgggtttgttgtttyggyggtygttagttgggagtttattatygttygatggtatygaatygattygtgtagttttataattttagtttaatttygaggagttagygtagatygtttttygtttttagttgyggygaggtaagggttggtagygttyggaygttttygttttgttttttttatgtttaagygyggggaattataygttttyggtgtagaatagaygatyggggttattagggttgggyggtgggagtgggggttgggagtattatttttggttggaygtgtgtttagatttatygtttttggtttttaggattttatttttttttgtatttttaggtgtyggtttttttgtattygttttttayggggttygttyggygaagggtagtygtagtttatatttatttttygtttttaatttttgttttttttgttygtygtagttattygtttggttgggagtaagttttttttttygttgagggtgtagagagygtttagggygttaagagtagaggggttaaagtttaagygttattagttagtygaaggttttgagtttttagggtygyggtygggaygtagggaggttaggaygygaygttygttttatttgtttttttagyggttttttggtygatagygtyggtttgggggagggygygyggtygtagaygtagttttttagtaggtaaagtttygagggtygygagttygagtygttttygaagtagaagagtaggttttgtagtagygygaattatttggtttgttattttgtgttgttygaatttygtttgtttaggtagtttttgygygtgtygtttttgygygttagtagttttagggaygygaygtggttattatttagtyggatttttttttgtatggtgtttagaggttagygagattttaygygtttatatttttttygygtagtagtttttygttygtgygygttgygygttgtttttttttggygttygttygttygttttttttagtttttttttttttttaaatatttatattttaggatttggygtygagtygyggttttttgaatttagatatattatttttygttggaatttttttttygtttygtagagttttagtattyggaagatgtygttygattttttttyggtgtygggtaaattgagggattggygatttgygygttggygaggggtaggyggagttatgtgaygtygatttttygaagagttygttttagtagygyggatagggatataygtaygtagtttygtygaggygtagagtygygygtaggttgtaatttggtgttttttttttttttttagatatatatataygtataygtataygtatatatttaaattttgttttttttttttttatttttttttttttttttyggatgttaaaaagtaaattagattaattttygtttaatttaatgaaatttygaaggttygttatttygggagtttgygtttttgygttttatygyggygtattgtagatttggggttaagtgttagttgttatttttttttttaaaggttygttttttttttttattttatttttaataygaggtggaaggaggaaggtgggtggygaaatagagttgtaaaagygtttagttttagtttttgtatagttagtygggttatattgaattttagtattyggttgtattttyggyggtttttttagttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagtttttattygtttatatagttatayggtatttattygagaaygttatagygttygtatgttgtatygggagggygygygggtygtygggygagtygggagttggggyggggagygygtatygttgtttgtygtagagggtagygagttygtttygattyggagtaagtygygtttggttygggygttttgtagyggggatgggtgttygygtagttttgtgaaggaaagatattattttttygtayggaaattgygtatatttttttttyg

SEQ ID NO: 7882 - DNA, 1920 bp, synthetic construct
  misc_feature 1..1920: note = Description of Artificial Sequence: Synthetic polynucleotide
  source 1..1920: mol_type = other DNA
ygyggatttgggtttggygtttattttatygttaggattggatagaaaggttttggtygaggttattaayggagaggttagagyggagtttttggtttagaatggaggtagtagygagttttyggyggtttttaggagtattaaggtggaggyggtggaggagtyggaggyggtttttattttgggtttyggagagtttgggttttaggtttygtygyggaygtygtygtygygtagtttygtttyggttagggttaaggtygagttgtttagttttaygtygggttttagttyggtgttyggygagttgggtttggtyggggttttgtttttttygtagtaygtgttygggttygaygyggygtttttygtttyggagattttggttaagatgttygagttggtgtatagtyggttgtagtagggygygggygygggygtyggyggygygtagatygggttttttttyggggtttttaagggygttaygtgtttygagtgygagattatttttagtaaygttaataattattaygtgtataagygtttttattgtttaggtygtygtgygttygaggaygygtttgtygygygtaggtttaaggygtttttyggttyggttygygygtttttyggttagttygtygaattygaygygtygygttygttttygggtttyggagygygygaggagggggttgggggygyggttaygttygaggayggygygggyggtyggggtagygagggtagttagagttygggtagtttygtggaygaygyggaggaygattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygtagttygggtttygtggttttygggayggtttyggttyggagttttaggagtygtygttyggttygttttygttttyggtygtygygttygaggtygtgtygttttygtyggygttttttttttattyggataagggygtttagatttttagtaagggtaygtyggygtygttgtttaayggtaattatyggtattgtygtttttgtaatattaagtttagtagtttgtttatttttatygtttataagaagtattattgtttttygtaygtygtygagtaygtgaagtgagygtttatattatagtygtagaygttttgtaygtttygttgygatgyggggagggggtygtttttaggtygtayggattgtygtttttgggaatttygttaygtataggtttyggyggagggggtygtagggggtagygttyg

SEQ ID NO: 7883 - DNA, 1403 bp, synthetic construct
  misc_feature 1..1403: note = Description of Artificial Sequence: Synthetic polynucleotide
  source 1..1403: mol_type = other DNA
ygyggggttttygggaatygtygtttttttttttygttttygygttygygttttttttttyggggtttyggtttatttatttttggtgyggtttygtyggatttaggagtttyggtygttygggttgyggggagggggygtttygggtyggttttagaagttattttgtaaagaggtagggggygyggggtygygyggggygagttygggattygyggggaagaagtttttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatgagttgatagygygygtttattggttygtggygtyggaggggyggggygtygtttagggtyggttaatgggygtyggttttyggtttttygaggaagaggggggttygggygtygtyggggggattttttttttggggygggyggtaggtggggggtgtgggtttggtyggtyggttygttaggygyggggtttaggttaggttggggttgtttggaggttgygtttttttttgttygyggygtttyggttttygtygtygagagtggaygtttttttggggtaatttttttyggtttagaggtagtttygggggyggggattttgygaatyggggatttygtgaggtygttygttattygtgggtagtgaaaygygttagygygtagagtagattygtttgygttgtygtttgttggaygttttttgagtatttattggggatygagtgygggygaggtagtagygaaggaatygggaggggaaatttygtgaagattatttgaaaattgaygtttaaaataaaygaattttttagtattygttaaaggatagtggttygttagtgtgtttgttayggggyggtygtaggatttgygtttggaatygggygggygttygggayggataatgtygtttggyggtyggtttygygggaggttttygtayggggttaatttyggtyggygaagttygttgttyggaatgygaggtygaggtttttttttgtgatagatygggyggggttaggaggaggggtagggygggtatttyggttygaagatttaggaattgttttggtttggtttggggtttatatttgaygtttggygagggttggtttygggtttggttttatygggtttgggagggaygggyg

SEQ ID NO: 7884 - DNA, 1088 bp, synthetic construct
  misc_feature 1..1088: note = Description of Artificial Sequence: Synthetic polynucleotide
  source 1..1088: mol_type = other DNA
ygggaaaygtygttttttttggygtttgagatttggggttttttttttatttggttttttygttttygttttagtttygtgygttttaggagggtatygtygagygtygggttttygtagggttygggagatttygyggatyggaggagggataggattttygagttttgggggygggaagggagggtggaaggaggaggggagyggggttggggaaagttggagtttyggtatttttttttygggttaggtygttttyggggttttgygttgygtttttaagtgttgggaagatttygyggggaaaggtttgaggaygyggtyggttggtataggtgtggyggttttagagggtyggggagaatttatggtttygaggttgtggattagaaatgtttttgattagaagttgagaatttttggttagggaggtggggyggyggggaggggtygttaagtyggtttagagygygtttatttgygttataagggagaagaggtgtttttygttttttttygtttatygtygttaygatgygtygyggatttyggygatttagttygggtagaagygygygttttttttttttagtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttygagtyggagtyggtagaggggygygggygyggaygyggygtttggyggggttttgggaggttyggayggggttttggygttgagttyggtyggttyggagygyggatttagtygtaggggyggygatgggtatygagggattttygttttyggtygtttttygyggaygttagggttgtttgttggtatttgygygggtgagtgyggttttttagyg

SEQ ID NO: 7885 - DNA, 1812 bp, synthetic construct
  misc_feature 1..1812: note = Description of Artificial Sequence: Synthetic polynucleotide
  source 1..1812: mol_type = other DNA
ygggyggyggaggagggttggyggttagatatagtatygttggagtttagagagtygggtagaggttggyggagagtygaggttggtttagtttttaggagatyggygagttggggtgtgtgggagygggatgtttttaaggygaaaagaagygttagtttygtaagyggtttttatttgggttgtttaggtyggatgtttaggagtttatagtaggggggatggagygaaggatygaggggttgggaggygaggtygtagygtattgaygtaggttagygaggtygttggtttygaygtagggygttyggtaaggtgtttggtattaygagagttaatttttgygygttattttyggaggttagtgygtttagggygygtyggttyggtaggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggggaygggtyggttatatttttygygttatttyggtaggtatygggtgggtttttttttygttttttggtttgagggyggaattyggagaagagtggaaataggggtggygtgaaggagagttgggggttgggggygggatygggagggggtgttgggggaagygaygtagyggttgggagattttgtaagggggtttgaagaggagtgggggatgggtatggaagggtgggggattattgaggtgggatgygagagtggaagggggatttagagggggygygatggtyggaggagggggagatggaygatggggyggggyggtatyggtygtygygttttttgtygttaggttygtttttyggtygtygggtttaygggttttttttggttagygttygtttttygtttttyggygtatttgtatttatttgttyggygtttaggttygagtygggtagtagtagyggaygtagygagygtagtttygygtygtatttttyggtygtttttttttygttgygagtttaygtygttgtygtygtygttatygttttaaaaaggataaaayggaatagaaaatgaatgtatgtataaaaaaaatygtaaaaagtaattgaggaggatggtagtygygygygyggttyggyggggygggagtygagaggtygyggtattggtggtygygattygggtaggyggtyggygygtgtygtaygygggtggttgtagttttttyggtygttygygttyggtttaggtayggtatygttttttttttyggggagttttttygattggtttgtttttttgttagttaggtaggagggygyggygttygtttygtttygttttygttttygttttgggtagatgtygggagtttttttgtygtygtgggagggggagttgagttgtyggagygtgygtattgggttagygggyggtyggggtagggttggggtttyggygttgagygtttttagtygygtygggtagtttggygtttygttgagtyggagtaattttyggtaggagtttttaggttttggttaagtttygggattygggaagttatttttgttttygggggttygagtttggagtggggtttgtaggtaaagyggggttggggtygttttggtygttagtggttaggaagaygtagygatttyg

SEQ ID NO: 7886 - DNA, 5819 bp, synthetic construct
  misc_feature 1..5819: note = Description of Artificial Sequence: Synthetic polynucleotide
  source 1..5819: mol_type = other DNA
ygagtagaaggyggaygttttygagtygtaggttaygtagttgttatagttttgygattygttatagggatttttatagaygtttagygtygyggtygagttgagttygtggygygyggtggttagtagtyggttttygtagatygggtagtagatyggygtttgggtygaggyggygggttyggagttygttagygtgyggttttyggattygtagtaygtgtttagggagttggtggttattaagaattgtagagagaggtygygaggattggygggaagtygggttggaggttggggttttgggttttgttaatttygygygtygtttaygagggygtgtttygagtattttygggtttttygtygtttatattaggatgttygtttttttttattagtttgtgygygtttggtttttttygttaygtggggtttagtygagtatttatattttttttyggagggtttttaaggtttttgaygttatttgygygttaagtttttttttttaggggttttttggggttttaggatttttttggggtatagtttgagttttgtggtttaaatattagggaattygggttyggttygtyggatttttttagygtttyggttttttttygggggtttggggagtaggggttgggygtgaggggygygygatttaggttttgttagttyggaagtygtaggtagtygtaggtyggatattttttatttttygttttygttttattygttttatyggtatttgyggtggtttgggyggggyggggtttygtttatttggggagtygaggagtaggggtatttaaattgygggtaggatatggygggygyggttyggggyggaygggyggggtttgtagggttttgygygttggggtyggygtggygyggttattgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggttttttaagttttygtttagtttatygtttttatttygttttttygattttttttttygatttttttttygtyggtygtgtttygtyggtttttttttgtttttygyggttaagtyggggattgtygggyggttttgygygttyggaagagtaggttttttaatttaggtttyggtttttttygttaagttygtttttttyggygtttygtagggttggttgygagggagggggygttgggtgtttggyggaggygtttttttttgtttattttgtttagttttttgtttggggygtayggagtaatyggaagaggggatygagygtttattttaggattttttyggttagtattttttttgggattttgtttaagtttaaagyggaggttagtgagtaggyggtaagggggyggtaagggggygttygggttatttygaattygtttttygttttttgygttatygtttttygggatygggattygtttyggttgttttygttttttgggtyggtttttygtggtaagttgggaaggaagtygtgtaaggtagygttgtgtagatttgtttagaaagatttttgggtttagatttgtgaatygttttagggttattttttaattaatgatgaygttttygttttttttttagttgtaagtttgttttttagaaaygaaatttgtttgtttttttgatagttyggttgaaggtgattgatgattatttggagattatagtatatattatataatatttgttgygtaattgttttaatttatagatgaaaataygagtttttygatygygttggatyggagygggttaygttygagttgtttgtagagggaaattatyggaaataatgaatagtygttttatgtaaattatttagatagtttagygtyggtagtygygagaaatatataaagaataygagttaaatgatattaataattgtttttgaattttgtattgatttygyggtaggtygygttttttttttttttatttgaatygttaatattatttttttgtaaataataagaaattagttatyggggtttttygttagaaatgaattttttaatttttttttttttttttttgtttttttttttttttatttttttttttttttttttttatttttttttttttttattttttgtagttttttggtttttttygagtatttttttattttttattatttattgtttataaattattygttttttttaggtaatgaggttyggttgaaggaggggtgtgagtttagtygggttaagggttgggatggggagtagagatttttagaggggaggtatttagttgtggtttgttttttttttatttatattyggggatttggtttyggygattgtgagtatttygtyggttgagggggagagttagggtttaggggtttagttatttatgttttgtatttttgggttttagtgtaatagtttagtttatttagatttgaggttggtgtatttttttttttttagattyggyggggtttaattggagtygaagttttagaataggyggttatttattttttgagtagagtttgggagaagtagtttttattttttagggtagttagtaygtgggggttttttygggggttttttttgattattatygttatttttttttgtttttttttgtttttttagtttgtgtgtataaatygaygttttagtttttattagygggygatttttttttygtgatttagaaatttggtttttgaatyggtttttttaggtygtygtatatataygttttattttttgttygttagtaggttttagygtttggggttygggtttagttatagttattttgtttygggaagttygtaattgtttaggaggttttttgattygttyggttttatttaggttttattatttattttaggatatagggttaatttagtttgtggattggygattatygggatattttattgaaattttgtagtttggtttaggttygtttgtttaaatyggggatttttattgggttattttttttttatagataatattggaatattttttaagtgtttttattaaaaggttaagtttggagyggaggtatttagtgttttttttattaaygataggaygtttagtattttaggtattagttgaaygygtttgtatagattyggagtgttgagtttttttttttttagggattttyggtattaaatatattygtgagtaggtgggttagaagttagtyggttttyggagtatatagtatyggtttagtttyggggagatgaggtgttttygttggtttggagygtttygaagagyggaggattagggtyggagtaggtygtaggggaggtaggggatggttagtttttaaygygaagygtaggygggtygtttattttgayggggttatygttggtygtyggaattatggaaggttttyggggagataggtygggttttgattttttttyggttagtttagttttggtgttttaggagttattttgggggttattagtttttygtattaagagttygttyggagggagttttttttagtttagagaagttaattttagttaaaggygaagtygggagttyggggtattaggtaagggtttttttttttgagatttggggttagagattttgggggygtttgtgttygtttatygttygggatattyggttggggtgtgggtttgagaggttttayggtygttgaygtygtattggygaatttygaggttggtaggttatttttttatagtttygaggttttttyggagttagtggtaggagaaggagttatagggataagyggtgaatttttggatttttaatygttttttatgggggttygyggtttttttttttttttttttygttgygttttygtygtttgttttttgggtayggtttgaggttggayggagygtygttygggygtttaggatttaggtttggttatttygagttttttatttttygtttygygtyggttygygtattttgtttttygtaatttgtagtaaaygtagyggtttttggagagtttagygaygggtagtaaattttgtttttttaagygtaagagtaattttygtaaagtttgtgyggyggagtttattttttatttgagttggggaagttttygttygygtygtgtggttgtyggggtygyggggagtagttygtagttygggaygtatyggggagtygtygtagtygtygtygttygtttttttyggyggtygygyggagttttygttttttyggaaggggggaggggtttyggaatttyggggygggggygggagygggggattttatttatttgyggtggygttgggtygttttyggtagttygygagggtttygygyggaagttyggygygygygttttagyggggagtyggygataattaatggagatatttttaggyggagtatttggygagyggagygygtyggygtttttaggygtygyggtygttagtygagttygtatyggygtgaygtgggygagygagygygttgtttttattyggtygtttattaaygttttttttygygggygtygygtttttgttaattttttttttygttyggtttgygygyggygygtygggtgtaggagttggggtgagggygtttygggtgttagtaggggygttgggagttgtttgggyggggaygtagggtttygggaggttatatagttttaataggatagtgggaaggygygygagttagatttggttaaaygttaagttygttgyggtttygggttttyggtttayggggttttttttttygtttgggttgttttatttagggaygtttgggtygggygygaagagttyggaaatagttatttttgtygtyggttyggttttttttyg

SEQ ID NO: 7887 - DNA, 2001 bp, synthetic construct
  misc_feature 1..2001: note = Description of Artificial Sequence: Synthetic polynucleotide
  source 1..2001: mol_type = other DNA
yggaggttgtgtyggggttygttaaaggttataaataaatyggaygggtgggaagtaygttttagyggygattggatttttaaaaatttgttggtagagtgaaaataaaaattgttttttaagttggtaaaatyggygttttagayggtgygtaggagggttttgygaggtttgttttyggagtttygygttagttttgtaggttyggttgggttygtagttyggtgttttattygtgggtygggttyggttgyggggttttttygtagtygggatatttaggatagtagyggttggggagtyggggttaggggtttttttgtaattttaatgatttttattattattattygtaaaggataaaygyggttaaggtygggttttatagtggttgtgttggttatygygtggaggagtgtgygttaatttaggggygaggggggygygttyggtgtttyggggagagtttagaaggaagaygttttatygtggtttttatagttagggatagtttgggtgttagaaatttttagagagaattygaggggttgatgttttgggttattagtttttggtgtttgtggggttttttgygygtttatttttatttttttttttttttttaggttygayggattttttyggaggtttaggatagtgatttatagtaagtggtgatagtggaataaygtgatagttygttgtatttgttagttggtttttgggtaggtttattygtygggttygattttagagtygagttttyggagtygtygggtaaagttttttttttygtttyggtgtagtttygygtttttygygttyggygttgtyggggaaaagtggtataataggaaagtttygttagagggttttttttagtyggttttttygttataaaaagttagattttagtygaggttttgattttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaaattyggagyggggaagtttaggggttgagagtttyggttygggtygtaggagttggggagyggggaygygggtaggttaggtttttttatttgtygtyggggttttttttygtagtagtaaaggggttttagtgttygtggtagtgtatgttttagyggataygttggtttttaaatttagagattagaggggyggttgagaayggggygttygttgtgtgtgatttttgatygtggaggaagggygggagtygggagtaggyggtggggttyggggttaggtygyggtygtyggttttyggtaaaggygttttggtyggggaagggggygagggtgggyggtyggtttttgtygtygtagttatatttgggaygttgaaatgggttttggggatagagtttatttttagygygttttataggagaagttygtagtttaggtttgggtygtgtagatygttgggygggttyggggttygaggagagtaatayggygygaggtttagtygygagtaataatttygatagtayggtttttygaagaygtgtttygggtatyggggttgtgagygggggagtttygggttttgggttygtttggtayggggygggggyg

SEQ ID NO: 7888 - DNA, 1265 bp, synthetic construct
  misc_feature 1..1265: note = Description of Artificial Sequence: Synthetic polynucleotide
  source 1..1265: mol_type = other DNA
yggygaggagggttgtaggtgaagygyggggagagggaggtygttygtttyggttttttttttaggggttttgyggttggttagygtttyggttgtattttttggtgygygtygyggyggygttataggtttttygattttttgattatygttttygggtygygygttyggtagtygggatyggtgatggygygggattgayggtygtttttttttagatttttttgtttygtttggggttygttggggttgyggygtygtttygagttgtatgtggggygggygygttygagtttagagygagyggttttyggygttttygaggyggtgtttygtygygttagagtaygaggaggagyggygggtygggttaggttttttaygygtygtagtttyggagtaygggtttttyggaggggatttggggygttttagtttaggaggaaggattyggaagtagaagyggagtygygagtygagtygagttattgttttygttgttygygggygtygggtgggggtttyggyggttggatgggtagyggyggygygggtygygggyggygatgggygaggagtagagtayggtgagyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagagggaggggatgaatagtaggaggygtttttyggygaagagttggagtttaggattygygtgggggtygtygayggattggttttggaygtgttgggttagyggygttygtttttygttaagagataagttttttgtttygtgtattgygtggagagygatttgttygaggttttygtttyggagtagttttygtygttygygtygttatttggggtttygttagtgttgaatttttttagtattygtttttttttttttagttttygattgttttttttaayggattttttttttttygayggyggtagtatygagttggagttttatttggygttygagtyg

SEQ ID NO: 7889 - DNA, 1360 bp, synthetic construct
  misc_feature 1..1360: note = Description of Artificial Sequence: Synthetic polynucleotide
  source 1..1360: mol_type = other DNA
ygttttygattttygtygttgggatttttygtygtagtttttgttttagtttgtgttgygggtggggtygggttgagtagttyggygttttttatygygttttttatygtatygttttygatttaatttygttttygggygtttattggtttgtagtattttttttttagtttgtgaagtgagtagggggaggyggtggtyggtygtttttttttagygtttagtttggtttygyggyggaggyggygtttttttygtaggayggagttaagttggattgtygygtygygyggggygggtaaagggggygttgygttyggtttygggtagggagtgayggyggyggyggyggtttygggygagygtggttttygygtgygtataygtataygtygtygygtagggatatayggatttyggtygttagtyggttatataggygyggagattyggttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggagagygggygagggtyggygttaggtaagttttttagatttgaaatgaagttttttttygtygttgygttttttttgygygttaggttgatattttttaatttaagtgtttggygttgygttyggggyggtygatygtygtagattgtyggggtgggggtygatttagttattttaygttttttttgatgyggagaagggagattaggggggtaggtaagttatgyggtyggagggattyggagggatatgtttttttatttttaggtggayggaygtatttaygyggatygggaaggtagggttggagggtttttyggggttaggtatygtaattygtayggggtttgaggggtgggtaagtaatgtgttaggtgggggttggggtaggggttagtgtagaatgtttttttgtggtgatatattygggattgtttaaaagagtgtygttttygtttttygtggygyggaggggttggggttggggatgttagggttttagtggtttttagaagaaaygttttgyggggtttgtggggaaaygtatyggtttttttaggttgaagtgggttygttgagatttttgtttgtygttttagaggtagaagtttttgyggyggttgyggggggyggaggttatattttyggyg

SEQ ID NO: 7890 - DNA, 362 bp, synthetic construct
  misc_feature 1..362: note = Description of Artificial Sequence: Synthetic polynucleotide
  source 1..362: mol_type = other DNA
ygtttagtayggygggtagygtygygttgygtatygtygtygattatgagygaggatagtygyggagatagtygygtygagagygttaaggatttggagaagtagtttygtttgygygtgtgygtgtttagygagttttagaagatygagygggattatgtgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyg

SEQ ID NO: 7891 - DNA, 2566 bp, synthetic construct
  misc_feature 1..2566: note = Description of Artificial Sequence: Synthetic polynucleotide
  source 1..2566: mol_type = other DNA
cgttgggcgatgagggatcgttgggtaattgggggtataggatcgggtttcgttgggttcggggtagaagcgtcgaagtttcgattcggaacgcggtgattttattaacgtagaagttcgcgtagtcgagtagaggagtttttcgtaggcgattttcggatagacgtttttgcgcggttcgcgtggtttagtttcgttttaggaaatttttcgcgtagttttcgttttatgcgtttttatttagttttttttcggggtcgttttttttttaaagtagtttttcgggtttattgggcgttttcgtaatcgggtcggaatttcgaacggtttcgcgtgttattcggttattttggtaatattattcggcggcgttcggcggtttaattttagtttgcggtttttttcgagtttttcgtaaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttttcgtaagcgggtaacggggtgtatcggtagtcggaaaggggcgttcgttcggagtttggagtagtatcgcggttttggcggggagcggtcgggtttttagggtttcgcgcgttcggggtcggggtagcggcgttcgttttagtaattcgggaagtggggtcggttaggcgcgttcgtagttttaggagttagtagcgtagtgttttggtcggttgtttcggcgcgtttttttttcggggttcggggcgaggcgtcggtcgttgggcgcggcgggcgcgggggtcggggttgtcggggaaagttaaagtttcgggtttttagcgagagtttcgtaggcggagttggaggaaattatagttaaatagttatttcgttttttttttttttttttcggggtttcggggttgagtaggggttttttaggtttttagttgtcgatttagttgtttgcgggtgattttcgggttcgacgggcgtttatagttggcgggtagttggggcgggagagttggggtttttggggagtttcggcggttatttcgttgtaaatatatacgtatatacgttcgtcggcgcgttcggggtttgtttgtgtttgggattttagggttagatggaagagggggttcgagtttagagttcgtggtgggggtgtttagaaagatttttttcggtaaattttgttagttcgtcggggttttcgggtttttttggtttttgtttggggtggtttagggtttattagagtatagttgtcgtttttgttgggtaggttgtttttgagttttcgtttttttgtcggggtatttatcgagttcgtgtatttgggtttcgggttggaatcgcgagcggggaggatagaggtggaggcggagagtagcgtgcggttttcgagtttgtttattgggatgtattgcgttttcgcgttggggacg

SEQ ID NO: 7892 - DNA, 572 bp, synthetic construct
  misc_feature 1..572: note = Description of Artificial Sequence: Synthetic polynucleotide
  source 1..572: mol_type = other DNA
cgtttaagaagtcggggttttttttggttacgcgttttcgggggcgttcgcgttttttaggttttggttgtttgggcgtcgattttcgggacgcgtcggtcgatagtaggggaggcggtagtagggatcgtagtagttttcgttttcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcg

SEQ ID NO: 7893 - DNA, 989 bp, synthetic construct
  misc_feature 1..989: note = Description of Artificial Sequence: Synthetic polynucleotide
  source 1..989: mol_type = other DNA
cgtggtgtgtgtgtgcgcgcgcgagtgtgtgagcgttaggggtcgttcgttcgtcgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgttcggggttgggatgcgtcgggggtttagtggcggcggcggcgttggcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcg

SEQ ID NO: 7894 - DNA, 2400 bp, synthetic construct
  misc_feature 1..2400: note = Description of Artificial Sequence: Synthetic polynucleotide
  source 1..2400: mol_type = other DNA
cgaaggtgtcgttagttttagtgtcggtgggcgtttgtattaggaatagttaaagtcgacgatatttagttatttcgagcgttagggaagacgtttcgcgtaaaatcgcggttttaggcggattttcgttttagtttcgcgttgttggtggtattttcggggatttaaagtgggtggtttgggggtaaaggaatagaggtcgaagaatttggggtatgttttattagagtatttaagggacggagtgggaggttatattagatatgcgatttcgatatattttaaaagtggtagtttcgtgggttatttttaatagtgggatggatttttttaatttttttcgtttttcgaagtttttttgttatttcgggttatgtttttttttcgggatttttttgtgtaaaattatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcgagtttgtgagttttcgatttcggttttagtcgtagtcgttaataattttataataaataagaggataggattgagcgttcgcgtttcggagcgtattggttgggggtaattttttattttcggcgcgtcgttcgttgtttcgattcgagagtatcgggagagtcgagggaagggaaggcggcgaggggaaggtaggcggggatggagggaggtacggcgcggcgcggagcgaggaggtgggttgtaggggacgtcgagaagcggtggggttggcgtagagggcgggcgttcggggcgcgcgttattttcgttttgttttcgtagtggtagtatacggtttataggtatttgagcgttcgttagagtaagatgatgaagaggttttcgaagaaagttattatggaggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagggggcgtcgcgggtcgttcgcgttcggggtttgcgtcgttttcgggttcgtttcggtttcgcgcgcggtttcgggtgttttcggcgtcgcgtcgttcgtcgtgcgttacgggtgtgcgttgcgttcggtcggtgattttttttttcgagcgtttttcgcgcggttaacgagtcgtttttcgtttattaggtggtaattcgttaataatggataatcggtttttttcgttcgggcgtttttgcgttagtttttttttttcggttgcgttcggtttcggttcgtcgcgttagtgcgcgttcggtcgcggtaggtttatcgcgttcggtcgtcggttcgtggtcgtttgttagtttatgttttcgggattttttagttttgtcgttacgtcgttgagtttttcggttttcgttcgttttttttttttgtcgttttcgattttttttcgttttcgttttcgtcgtttaagttttttcggcgcgcgtttcgcgtttttcgtagtcgttagtagtagtagttgtagtaattggagcgggcgcggatttaggacgatttaggcgggaggggaggaggttcgtcgcgttggttcgtttgggtttcgggttgggtaggggtgggtagggtttttcggtagcggttcggtaagcgtttttgatttttagggcgtaaggtagagcgtttttagtttaggcgcggggttaggcgtttttttttaaggtgttgcgtttttagtcgagagcggtggggtatattgggaggacggcggggcgtttcggttaggtcg

SEQ ID NO: 7895 - DNA, 1859 bp, synthetic construct
  misc_feature 1..1859: note = Description of Artificial Sequence: Synthetic polynucleotide
  source 1..1859: mol_type = other DNA
cgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggaggtggacgatcgggcgtttaagtacgaattttttcgtcgaggtacggttgtcgggtttcgttttgagggtttggggcggcgaggatcgtcggggaggagggcgcgcgagtcggaggttagagtcgggtcgggtagggcgcgtttaggagtaggggagacggcgattcgggtcgaggcgggacggggatacgttatttgttcgtggagcgcggggaaggggtgcgcggcggcggcggcggcggagtttggcgtagagggtagcggtagtagcgggagtatcggttcgttcggggtcggttagtcggggagatcggggagtagcggggtcgcgggcggcggggtcgaggcgagtagtatcgggggaattacgattttcgcgttgagtcggagtagttcggtcgagttcggtattatttagatttagggcggcggcggcggcggttttgcgtttatcggttagaggagaggttgtcgtcgtcggggttgttgttgttgtagttgtcgtcgtcgtcgttggaatttggcgttcgtttgtattttatattttcgcgttgacggcggcggcgggggcggcgggcgttcgagatgttgggtcggcggcggcgcggtttcggagcgaatttatttggtttcgcggcgcggtcgttcgtttcgtttttgtttcgcgcgggaagtttttttttttttcgttcgcgtcgtcgtcgttttcggattcggttttcgtttcggttttcgttcgttcgcgttttttttcgtcggatttcgtttcgttttcgcgtttttcggttttggtcggggtttttttttcgttgcgtttttggattcgggcggtcgcggaggacgtgggtgggagagggtcgagggcgcgttcggttgggttttcgtcgatgtcggttttttggtggtttttggttttttgggatttagcgtatcgcgagggaggtttcgggtttcgtatttaagggtaagcggaagtcgaggtggcggcgtcggagttaggtatgtttcgttgtttagcgcggggttgagggcgtagacggggatcgcgcgagtcgttttttatttggttttttcggagtttagggcgcggagggtattgggttgcggattcggcgtaggcggtttcggacgttgttaggcgcgggcggatttttgttgtataaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttttgtgaattcgttttggatgtttttaggtatagtttgtattttttttttttttagtatacgcggtttttgacgttgtacgtcgagttttttgggatttaggacgaatcgggttttaaggattttcgtttcgttcggattatacgtaggtagcgtcggtcgagtcgagtttgggttcgtattggttacgcgtagttatcgttagacggcgttagttttttttcgttgtagattttgtttcggaggtcgttagttttttttttatttcgggtttatagttttagtgtagtttttggcgacgcgcgttgatagttgggtagagattttcgtgcg

SEQ ID NO: 7896 - DNA, 902 bp, synthetic construct
  misc_feature 1..902: note = Description of Artificial Sequence: Synthetic polynucleotide
  source 1..902: mol_type = other DNA
cgattttagaattcgttttttatttcgagttcgtttttcgtcgttttttcgtttttgggagggcggttttattaattttcgcgattcgggtcgtttttggcggttttgatttcgttatttcgtttcgcggcgggggtttgggggtgaggggcgcgttttggggtagaggattgcgcggtagggtttgttatagggtagaggttagggtttttcgggaaaaaggtaggcgtatatatgtttttttttttgggaaaagacggggaggggggttttttttgggagattttaggtttcgaaatttttcgttttttatttttcggttttcgtattttttttttttttcgttacgtatttttttttttttttagttatttgttttatttcgtagcgtcgcgataaatacggttttagttcgttttcgtttttgtttagttttttttttaagtttcggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgaggatttcggatatagagtgtagagatttcggtaagtttattgaaagttagtcgaattcg

SEQ ID NO: 7897 - DNA, 2044 bp, synthetic construct
  misc_feature 1..2044: note = Description of Artificial Sequence: Synthetic polynucleotide
  source 1..2044: mol_type = other DNA
cgaaacggtagaggtcggtagttcgcggtttacgtgtatttgtttagggaatcgttttagcgaaatttgattcggatcggaattttttcgtagtatagcggtcgtgtttatcggaatggaacgttataagttgttatttgtattttttttttagttttgatagggaatacgcgttgtttttacgtttatatcgatattcggatttttatttagttcggttagagttttaggggttagggattagtgtagggagaaggttttttattttagtttttaggatttttaattatagtttattcgtttttattttgttcggttttaggtttagtcgaatttatatgttttcgtagtgtcgagcgttattatttatagtcgttttttaaattgtgatttttatttgggagattcggaattatttaggattttggtgtggggggtagtattttttatatttgtttttcgaaaattgttatggagtagtcgcgtttcggcgggtaggtgagggggtcgagtttattagcgtcgtagtttcgttgtttattttttttagcgtcggttgtcgttttcgggtagatatcgtcggttttgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagcgtttcggttgtttttttagagttttttgttggggggatatcgtttttatgaagaaaatttttaaataaattttagtttaggaggaggttatacgattatgttcgcgggttgtcggtcggaggggcgaggacgcgcgggcggaggcgcggttgtcgtgtttaggtagggagtcgagtttcgggtgttcgtcgcgcgtttttcgtcggggttatgtattttcgtttgcgttcgatatcgcgggttggaggcgagtgtagcggcgatagttcgttagcgtcgcggttcgtttcgtttcgggttcgtttttttcgtttcgggcgttttgcgtcggggttcgttttcgtagttttttttagtttttttttagtttgggtttttttagtttcgttttagtttgtggcgcgtttggcgggcgtttttttatatatgttagtatatcggttatcggttgattttttcggtttgtgatttcgcgtgggtgtagttcgtaggagtttatcggtttgtgttacgtacgggggtttttagtgtacggatacgcgtttttttcgttatttgtttatttttattagattttattttttttcgcgtcgtgttcgcggcggaaggcgtttttgtagcgcgtgtattcgcggagcggtggcgattttagtttgagtagaggagttgtagtgatttttgtttcgtttttagcggattgcggagggaattttttattttattttattggggatagggtggtacgtcgtagagtgtcgtagttgtataaatttggaagtttatagtatcgtttgattttttgtgtaatttcgaacgttagtttgttcgggtaattttgagtgggtttttgtagtcggttatgttagcggtttttgtatatttgtattcgcggttttcgttgtttgtaggttgtagagacgggggtattttaaacgtgaaagagtaatgaaggaaaatgtagatagagcgaggacgtcg

SEQ ID NO: 7898 - DNA, 1152 bp, synthetic construct
  misc_feature 1..1152: note = Description of Artificial Sequence: Synthetic polynucleotide
  source 1..1152: mol_type = other DNA
cgtttttttcgtagagatcgttagttgaggttgtaatatttgtttcggtaaagcgttttcgtagttttttcggtttgttcgattcggtttttttcgtttttgtttcggttgcggtattattttttggagttacgtttcggcgagcgggggtcgcggagcgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggagacgtttcggtagtttttaatttgtgtgcgtcg

SEQ ID NO: 7899 - DNA, 872 bp, synthetic construct
  misc_feature 1..872: note = Description of Artificial Sequence: Synthetic polynucleotide
  source 1..872: mol_type = other DNA
cggagagttgttatcgatttttttaacgttttaagttttagttttgtcgttcgcgtttttttttttttttgggttataattttggttttttcgggtcggttttacgtagttgcgtaggagttcgcgggggaagatttttcgtggggatttcgagtacgacgtgcgattttaaatttttatattttttttgtcgtttcgtaggttatatgtatcgggagtcgggcggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcggagagcgtacgtttgtcgcggtcggtatggaaacgttttcgttaggttcgggggcgtcgttgattggtcgatttaatagacgcgggtgggtagtttagtcgtatcgttaagttcggtcg

SEQ ID NO: 7900 - DNA, 1070 bp, synthetic construct
  misc_feature 1..1070: note = Description of Artificial Sequence: Synthetic polynucleotide
  source 1..1070: mol_type = other DNA
cgagcggtggttcgatttcgggtgtggtaggaaggggtgtttcgcgttttagagttagtgttagtttttattttttcgggaagtcgagatttagggggaataggttttttagagtttagtttgtagggacgcggagggtaggagtcgtcggcgaggagtagttaatttgttatttttggcggttgtatttttcggcggttataggttgttcgatagcggattttagggttttcgcgacggtatttagagtgtttagaagggaggtcggggtcggggtgggtcgggaaaatcgagggagggaaggagtttggagaagtttcgtttaggcggggagggggcgattcggggcgtatttttcgattatgatttttatagattttggcgtcgtaatttgcgttttttgaggtcgaagatgcgtattttggagaagatatttattaggttgtcgttgtagagttcgcggtttttgttggggttgtttcgttttttgttggtagacggtcggttttagtgttgttttcgcgtttgtcgtttttggcggattaagtcgttagcgatggtcgcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagtcggacgatttcgggaagtcggacgtcgtggtcgtcgtcgtttggttacgttcgagtggagagcgggatcgcggttgcgggcgttgttggttatcgttcgtcgtaggaatttcggcgggggtcgttatcgttattcgcgttgttttttcgttttgttcggttttcgggcgggaggtagagtcggtcggcggtttttcgggcgtcggttggagggcgggtttcggtagggtttttgcgcgttcgtcggttcgggtcgcgttgggtaggatttagcgtcg

SEQ ID NO: 7901 - DNA, 395 bp, synthetic construct
  misc_feature 1..395: note = Description of Artificial Sequence: Synthetic polynucleotide
  source 1..395: mol_type = other DNA
cgttgggaagggaaaaacggtttatatcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagggcgaaagatcgtcg

SEQ ID NO: 7902 - DNA, 265 bp, synthetic construct
  misc_feature 1..265: note = Description of Artificial Sequence: Synthetic polynucleotide
  source 1..265: mol_type = other DNA
cggggatatttaggcgcggggtaggtgtaggggagggggcgcggggtaggggcgtaggggtcgtcgggttcgggttggaggtgttcgggtcgtgggagggagggagggaaggagggagggaggacggcgagggagggaggtaggggcgggcggcgggggatggggttagcggggaggtggaagcgatatttatcgttcgtattggtttttttggtgttgtcggttttagggggggtttttagcggtttttttcgcgagttcggcg

SEQ ID NO: 7903 - DNA, 1169 bp, synthetic construct
  misc_feature 1..1169: note = Description of Artificial Sequence: Synthetic polynucleotide
  source 1..1169: mol_type = other DNA
cgggttggcgggtattgagttggggttattacgtttttttagagcgtttgcggaggtggcgaaggtttggagagtatacgaggcggaattcggatcgagtgagttttttgagtcgtttgcgtgggacgtagggagagggcgaataacgtttttaggcgttgaatgtaggggtaaggagttagcgagggtggttggagtaggttttgttagttgttattaagtttttttataggtttgggggtttggggttttttggaaagattttttcgtcgcgttgattagtacggggttcgttttcgtattttgaaggttgtcgcggtttttcgttatttataattaagtttaagattaaggttgtaagttgaggtcggggtattgataacgggaatgaagttataggggaagaggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggatttttgcgtggtttgggaggtaaatcgggcgtttttttaagtcgttttaatatgatttaggtttttaaatacgtgaaagcggtagatataatagggatgcgaaggaaataaaaaataattggggaagtggtgttaagttatttaggttttgaattgaggacgagtagtgcggtcgcgtttggggcgcgttcggaaattatttttagtttgtggcggttattgttttatttaaatttttttgcggggagagttgagcggatttttggggggttggttttgggttagttttaaatttttcggttgtatttcgcgtggttttatcgacggcgcgtttcggcgtagtttttggcgcgggttcg

SEQ ID NO: 7904 - DNA, 1743 bp, synthetic construct
  misc_feature 1..1743: note = Description of Artificial Sequence: Synthetic polynucleotide
  source 1..1743: mol_type = other DNA
cggtgggtcgggggcgtggcgagattttgttttagtggagggagggtttatgtattgtcgagacgtcgattattagattttgattttgtcgtttttagaaaaattattggtagaagattcggattatggttaatttgtcggttataagtttttttaagaagcgttacgtttgggtgtagttggtagggtatattggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttataggatttatttagaggaggagttgattaaggttcgtgagcggtttaagttgcggaaggatatgtataagaaaatgttggcggtggattttgaagtttttacggaggaggagtacgcgtagcgcgtcgttattaagtcgcgttatatgtagtggcgggaaggtattagttttagtattattttcggttttcgtatcgagggtattaaggtgaggtaggcgcgtttcgttggtatcgtcgtagttttattgcgcgttgtttttttcgatttttcgttttcgtttcgtttgttttttcgtttttttttatcgtttcgtcgttttttgtaattgggaggtatcgttgttttacgttgtttttttttttattggcgggttcggggtttttgatatttttgttttatatttagaaagcggacggtttttgtagtatcgattttaagattacgcgaagtcgagagtaggtgtttcgcgtttttgaagagtttgtgtaaggagatgaggaagtgttggtgagagcgggattttaaattttgaggtgttggggagtttgaagtcgaggattgtttttgttatttggtttagtgttttcggttgtgtttttattatggtttttatcgcgttggttcgtaattgttttacgtttttttttttttgggttacgttgggcggggttttgggttttttttttggcggtatttgttaagtatagcgtgggtttcggttttttatcgttagtaggggtttatttggcgtttagttaatttgttttttttttttattttattttttgtagaggcggtatttgaatcgtttgtagtagattcgggatattttggaggtattcgagttttttaggaggtacgaggtaagcggcggttgttcgggtgttcgggtcgcgagggttagggcgggaattcggtaagggcgtttttgggtagggtcgcggtttgacggtgcggggttcgtaggtgatcggtagttcgtttttttttgtgtacgattattgttatcgcgtcggcgtgtggtttatcgatttcggtaagattacgttttttttcgatggttagattttggattatcggcggttttgggaggagggtaatcgcgaggacg

SEQ ID NO: 7905 - DNA, 2405 bp, synthetic construct
  misc_feature 1..2405: note = Description of Artificial Sequence: Synthetic polynucleotide
  source 1..2405: mol_type = other DNA
cgtagcgttatagtcgcgattgcggcggcggcggcggcgtagggggcgggggaggagagaagcgtttatttcgtttcgttgttttcgtagtagttttggttttagtttcggcgtattagagcggtttttgggaatttttgggtttgttgtttcggcggtcgttagttgggagtttattatcgttcgatggtatcgaatcgattcgtgtagttttataattttagtttaatttcgaggagttagcgtagatcgtttttcgtttttagttgcggcgaggtaagggttggtagcgttcggacgttttcgttttgttttttttatgtttaagcgcggggaattatacgttttcggtgtagaatagacgatcggggttattagggttgggcggtgggagtgggggttgggagtattatttttggttggacgtgtgtttagatttatcgtttttggtttttaggattttatttttttttgtatttttaggtgtcggtttttttgtattcgttttttacggggttcgttcggcgaagggtagtcgtagtttatatttatttttcgtttttaatttttgttttttttgttcgtcgtagttattcgtttggttgggagtaagttttttttttcgttgagggtgtagagagcgtttagggcgttaagagtagaggggttaaagtttaagcgttattagttagtcgaaggttttgagtttttagggtcgcggtcgggacgtagggaggttaggacgcgacgttcgttttatttgtttttttagcggttttttggtcgatagcgtcggtttgggggagggcgcgcggtcgtagacgtagttttttagtaggtaaagtttcgagggtcgcgagttcgagtcgttttcgaagtagaagagtaggttttgtagtagcgcgaattatttggtttgttattttgtgttgttcgaatttcgtttgtttaggtagtttttgcgcgtgtcgtttttgcgcgttagtagttttagggacgcgacgtggttattatttagtcggatttttttttgtatggtgtttagaggttagcgagattttacgcgtttatatttttttcgcgtagtagtttttcgttcgtgcgcgttgcgcgttgtttttttttggcgttcgttcgttcgttttttttagtttttttttttttttaaatatttatattttaggatttggcgtcgagtcgcggttttttgaatttagatatattatttttcgttggaatttttttttcgtttcgtagagttttagtattcggaagatgtcgttcgattttttttcggtgtcgggtaaattgagggattggcgatttgcgcgttggcgaggggtaggcggagttatgtgacgtcgatttttcgaagagttcgttttagtagcgcggatagggatatacgtacgtagtttcgtcgaggcgtagagtcgcgcgtaggttgtaatttggtgttttttttttttttttagatatatatatacgtatacgtatacgtatatatttaaattttgttttttttttttttatttttttttttttttttcggatgttaaaaagtaaattagattaattttcgtttaatttaatgaaatttcgaaggttcgttatttcgggagtttgcgtttttgcgttttatcgcggcgtattgtagatttggggttaagtgttagttgttatttttttttttaaaggttcgttttttttttttattttatttttaatacgaggtggaaggaggaaggtgggtggcgaaatagagttgtaaaagcgtttagttttagtttttgtatagttagtcgggttatattgaattttagtattcggttgtattttcggcggtttttttagttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagtttttattcgtttatatagttatacggtatttattcgagaacgttatagcgttcgtatgttgtatcgggagggcgcgcgggtcgtcgggcgagtcgggagttggggcggggagcgcgtatcgttgtttgtcgtagagggtagcgagttcgtttcgattcggagtaagtcgcgtttggttcgggcgttttgtagcggggatgggtgttcgcgtagttttgtgaaggaaagatattattttttcgtacggaaattgcgtatatttttttttcg

SEQ ID NO: 7906 - DNA, 1920 bp, synthetic construct
  misc_feature 1..1920: note = Description of Artificial Sequence: Synthetic polynucleotide
  source 1..1920: mol_type = other DNA
cgcggatttgggtttggcgtttattttatcgttaggattggatagaaaggttttggtcgaggttattaacggagaggttagagcggagtttttggtttagaatggaggtagtagcgagttttcggcggtttttaggagtattaaggtggaggcggtggaggagtcggaggcggtttttattttgggtttcggagagtttgggttttaggtttcgtcgcggacgtcgtcgtcgcgtagtttcgtttcggttagggttaaggtcgagttgtttagttttacgtcgggttttagttcggtgttcggcgagttgggtttggtcggggttttgtttttttcgtagtacgtgttcgggttcgacgcggcgtttttcgtttcggagattttggttaagatgttcgagttggtgtatagtcggttgtagtagggcgcgggcgcgggcgtcggcggcgcgtagatcgggttttttttcggggtttttaagggcgttacgtgtttcgagtgcgagattatttttagtaacgttaataattattacgtgtataagcgtttttattgtttaggtcgtcgtgcgttcgaggacgcgtttgtcgcgcgtaggtttaaggcgtttttcggttcggttcgcgcgtttttcggttagttcgtcgaattcgacgcgtcgcgttcgttttcgggtttcggagcgcgcgaggagggggttgggggcgcggttacgttcgaggacggcgcgggcggtcggggtagcgagggtagttagagttcgggtagtttcgtggacgacgcggaggacgattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgtagttcgggtttcgtggttttcgggacggtttcggttcggagttttaggagtcgtcgttcggttcgttttcgttttcggtcgtcgcgttcgaggtcgtgtcgttttcgtcggcgttttttttttattcggataagggcgtttagatttttagtaagggtacgtcggcgtcgttgtttaacggtaattatcggtattgtcgtttttgtaatattaagtttagtagtttgtttatttttatcgtttataagaagtattattgtttttcgtacgtcgtcgagtacgtgaagtgagcgtttatattatagtcgtagacgttttgtacgtttcgttgcgatgcggggagggggtcgtttttaggtcgtacggattgtcgtttttgggaatttcgttacgtataggtttcggcggagggggtcgtagggggtagcgttcg

SEQ ID NO: 7907 - DNA, 1403 bp, synthetic construct
  misc_feature 1..1403: note = Description of Artificial Sequence: Synthetic polynucleotide
  source 1..1403: mol_type = other DNA
cgcggggttttcgggaatcgtcgtttttttttttcgttttcgcgttcgcgttttttttttcggggtttcggtttatttatttttggtgcggtttcgtcggatttaggagtttcggtcgttcgggttgcggggagggggcgtttcgggtcggttttagaagttattttgtaaagaggtagggggcgcggggtcgcgcggggcgagttcgggattcgcggggaagaagtttttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatgagttgatagcgcgcgtttattggttcgtggcgtcggaggggcggggcgtcgtttagggtcggttaatgggcgtcggttttcggtttttcgaggaagaggggggttcgggcgtcgtcggggggattttttttttggggcgggcggtaggtggggggtgtgggtttggtcggtcggttcgttaggcgcggggtttaggttaggttggggttgtttggaggttgcgtttttttttgttcgcggcgtttcggttttcgtcgtcgagagtggacgtttttttggggtaatttttttcggtttagaggtagtttcgggggcggggattttgcgaatcggggatttcgtgaggtcgttcgttattcgtgggtagtgaaacgcgttagcgcgtagagtagattcgtttgcgttgtcgtttgttggacgttttttgagtatttattggggatcgagtgcgggcgaggtagtagcgaaggaatcgggaggggaaatttcgtgaagattatttgaaaattgacgtttaaaataaacgaattttttagtattcgttaaaggatagtggttcgttagtgtgtttgttacggggcggtcgtaggatttgcgtttggaatcgggcgggcgttcgggacggataatgtcgtttggcggtcggtttcgcgggaggttttcgtacggggttaatttcggtcggcgaagttcgttgttcggaatgcgaggtcgaggtttttttttgtgatagatcgggcggggttaggaggaggggtagggcgggtatttcggttcgaagatttaggaattgttttggtttggtttggggtttatatttgacgtttggcgagggttggtttcgggtttggttttatcgggtttgggagggacgggcg

SEQ ID NO: 7908 - DNA, 1088 bp, synthetic construct
  misc_feature 1..1088: note = Description of Artificial Sequence: Synthetic polynucleotide
  source 1..1088: mol_type = other DNA
cgggaaacgtcgttttttttggcgtttgagatttggggttttttttttatttggttttttcgttttcgttttagtttcgtgcgttttaggagggtatcgtcgagcgtcgggttttcgtagggttcgggagatttcgcggatcggaggagggataggattttcgagttttgggggcgggaagggagggtggaaggaggaggggagcggggttggggaaagttggagtttcggtatttttttttcgggttaggtcgttttcggggttttgcgttgcgtttttaagtgttgggaagatttcgcggggaaaggtttgaggacgcggtcggttggtataggtgtggcggttttagagggtcggggagaatttatggtttcgaggttgtggattagaaatgtttttgattagaagttgagaatttttggttagggaggtggggcggcggggaggggtcgttaagtcggtttagagcgcgtttatttgcgttataagggagaagaggtgtttttcgttttttttcgtttatcgtcgttacgatgcgtcgcggatttcggcgatttagttcgggtagaagcgcgcgttttttttttttagtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttcgagtcggagtcggtagaggggcgcgggcgcggacgcggcgtttggcggggttttgggaggttcggacggggttttggcgttgagttcggtcggttcggagcgcggatttagtcgtaggggcggcgatgggtatcgagggattttcgttttcggtcgtttttcgcggacgttagggttgtttgttggtatttgcgcgggtgagtgcggttttttagcg

SEQ ID NO: 7909 - DNA, 1812 bp, synthetic construct
  misc_feature 1..1812: note = Description of Artificial Sequence: Synthetic polynucleotide
  source 1..1812: mol_type = other DNA
cgggcggcggaggagggttggcggttagatatagtatcgttggagtttagagagtcgggtagaggttggcggagagtcgaggttggtttagtttttaggagatcggcgagttggggtgtgtgggagcgggatgtttttaaggcgaaaagaagcgttagtttcgtaagcggtttttatttgggttgtttaggtcggatgtttaggagtttatagtaggggggatggagcgaaggatcgaggggttgggaggcgaggtcgtagcgtattgacgtaggttagcgaggtcgttggtttcgacgtagggcgttcggtaaggtgtttggtattacgagagttaatttttgcgcgttattttcggaggttagtgcgtttagggcgcgtcggttcggtaggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggggacgggtcggttatatttttcgcgttatttcggtaggtatcgggtgggtttttttttcgttttttggtttgagggcggaattcggagaagagtggaaataggggtggcgtgaaggagagttgggggttgggggcgggatcgggagggggtgttgggggaagcgacgtagcggttgggagattttgtaagggggtttgaagaggagtgggggatgggtatggaagggtgggggattattgaggtgggatgcgagagtggaagggggatttagagggggcgcgatggtcggaggagggggagatggacgatggggcggggcggtatcggtcgtcgcgttttttgtcgttaggttcgtttttcggtcgtcgggtttacgggttttttttggttagcgttcgtttttcgtttttcggcgtatttgtatttatttgttcggcgtttaggttcgagtcgggtagtagtagcggacgtagcgagcgtagtttcgcgtcgtatttttcggtcgtttttttttcgttgcgagtttacgtcgttgtcgtcgtcgttatcgttttaaaaaggataaaacggaatagaaaatgaatgtatgtataaaaaaaatcgtaaaaagtaattgaggaggatggtagtcgcgcgcgcggttcggcggggcgggagtcgagaggtcgcggtattggtggtcgcgattcgggtaggcggtcggcgcgtgtcgtacgcgggtggttgtagttttttcggtcgttcgcgttcggtttaggtacggtatcgttttttttttcggggagttttttcgattggtttgtttttttgttagttaggtaggagggcgcggcgttcgtttcgtttcgttttcgttttcgttttgggtagatgtcgggagtttttttgtcgtcgtgggagggggagttgagttgtcggagcgtgcgtattgggttagcgggcggtcggggtagggttggggtttcggcgttgagcgtttttagtcgcgtcgggtagtttggcgtttcgttgagtcggagtaattttcggtaggagtttttaggttttggttaagtttcgggattcgggaagttatttttgttttcgggggttcgagtttggagtggggtttgtaggtaaagcggggttggggtcgttttggtcgttagtggttaggaagacgtagcgatttcg

SEQ ID NO: 7910 - DNA, 5819 bp, synthetic construct
  misc_feature 1..5819: note = Description of Artificial Sequence: Synthetic polynucleotide
  source 1..5819: mol_type = other DNA
cgagtagaaggcggacgttttcgagtcgtaggttacgtagttgttatagttttgcgattcgttatagggatttttatagacgtttagcgtcgcggtcgagttgagttcgtggcgcgcggtggttagtagtcggttttcgtagatcgggtagtagatcggcgtttgggtcgaggcggcgggttcggagttcgttagcgtgcggttttcggattcgtagtacgtgtttagggagttggtggttattaagaattgtagagagaggtcgcgaggattggcgggaagtcgggttggaggttggggttttgggttttgttaatttcgcgcgtcgtttacgagggcgtgtttcgagtattttcgggtttttcgtcgtttatattaggatgttcgtttttttttattagtttgtgcgcgtttggtttttttcgttacgtggggtttagtcgagtatttatattttttttcggagggtttttaaggtttttgacgttatttgcgcgttaagtttttttttttaggggttttttggggttttaggatttttttggggtatagtttgagttttgtggtttaaatattagggaattcgggttcggttcgtcggatttttttagcgtttcggttttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggttttttaagttttcgtttagtttatcgtttttatttcgttttttcgattttttttttcgatttttttttcgtcggtcgtgtttcgtcggtttttttttgtttttcgcggttaagtcggggattgtcgggcggttttgcgcgttcggaagagtaggttttttaatttaggtttcggtttttttcgttaagttcgtttttttcggcgtttcgtagggttggttgcgagggagggggcgttgggtgtttggcggaggcgtttttttttgtttattttgtttagttttttgtttggggcgtacggagtaatcggaagaggggatcgagcgtttattttaggattttttcggttagtattttttttgggattttgtttaagtttaaagcggaggttagtgagtaggcggtaagggggcggtaagggggcgttcgggttatttcgaattcgtttttcgttttttgcgttatcgtttttcgggatcgggattcgtttcggttgttttcgttttttgggtcggtttttcgtggtaagttgggaaggaagtcgtgtaaggtagcgttgtgtagatttgtttagaaagatttttgggtttagatttgtgaatcgttttagggttattttttaattaatgatgacgttttcgttttttttttagttgtaagtttgttttttagaaacgaaatttgtttgtttttttgatagttcggttgaaggtgattgatgattatttggagattatagtatatattatataatatttgttgcgtaattgttttaatttatagatgaaaatacgagtttttcgatcgcgttggatcggagcgggttacgttcgagttgtttgtagagggaaattatcggaaataatgaatagtcgttttatgtaaattatttagatagtttagcgtcggtagtcgcgagaaatatataaagaatacgagttaaatgatattaataattgtttttgaattttgtattgatttcgcggtaggtcgcgttttttttttttttatttgaatcgttaatattatttttttgtaaataataagaaattagttatcggggtttttcgttagaaatgaattttttaatttttttttttttttttttgtttttttttttttttatttttttttttttttttttttatttttttttttttttattttttgtagttttttggtttttttcgagtatttttttattttttattatttattgtttataaattattcgttttttttaggtaatgaggttcggttgaaggaggggtgtgagtttagtcgggttaagggttgggatggggagtagagatttttagaggggaggtatttagttgtggtttgttttttttttatttatattcggggatttggtttcggcgattgtgagtatttcgtcggttgagggggagagttagggtttaggggtttagttatttatgttttgtatttttgggttttagtgtaatagtttagtttatttagatttgaggttggtgtatttttttttttttagattcggcggggtttaattggagtcgaagttttagaataggcggttatttattttttgagtagagtttgggagaagtagtttttattttttagggtagttagtacgtgggggttttttcgggggttttttttgattattatcgttatttttttttgtttttttttgtttttttagtttgtgtgtataaatcgacgttttagtttttattagcgggcgatttttttttcgtgatttagaaatttggtttttgaatcggtttttttaggtcgtcgtatatatacgttttattttttgttcgttagtaggttttagcgtttggggttcgggtttagttatagttattttgtttcgggaagttcgtaattgtttaggaggttttttgattcgttcggttttatttaggttttattatttattttaggatatagggttaatttagtttgtggattggcgattatcgggatattttattgaaattttgtagtttggtttaggttcgtttgtttaaatcggggatttttattgggttattttttttttatagataatattggaatattttttaagtgtttttattaaaaggttaagtttggagcggaggtatttagtgttttttttattaacgataggacgtttagtattttaggtattagttgaacgcgtttgtatagattcggagtgttgagtttttttttttttagggattttcggtattaaatatattcgtgagtaggtgggttagaagttagtcggttttcggagtatatagtatcggtttagtttcggggagatgaggtgttttcgttggtttggagcgtttcgaagagcggaggattagggtcggagtaggtcgtaggggaggtaggggatggttagtttttaacgcgaagcgtaggcgggtcgtttattttgacggggttatcgttggtcgtcggaattatggaaggttttcggggagataggtcgggttttgattttttttcggttagtttagttttggtgttttaggagttattttgggggttattagtttttcgtattaagagttcgttcggagggagttttttttagtttagagaagttaattttagttaaaggcgaagtcgggagttcggggtattaggtaagggtttttttttttgagatttggggttagagattttgggggcgtttgtgttcgtttatcgttcgggatattcggttggggtgtgggtttgagaggttttacggtcgttgacgtcgtattggcgaatttcgaggttggtaggttatttttttatagtttcgaggttttttcggagttagtggtaggagaaggagttatagggataagcggtgaatttttggatttttaatcgttttttatgggggttcgcggtttttttttttttttttttcgttgcgttttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgttttcggtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgggtgtaggagttggggtgagggcgtttcgggtgttagtaggggcgttgggagttgtttgggcggggacgtagggtttcgggaggttatatagttttaataggatagtgggaaggcgcgcgagttagatttggttaaacgttaagttcgttgcggtttcgggttttcggtttacggggttttttttttcgtttgggttgttttatttagggacgtttgggtcgggcgcgaagagttcggaaatagttatttttgtcgtcggttcggttttttttcg

SEQ ID NO: 7911 - DNA, 2001 bp, synthetic construct
  misc_feature 1..2001: note = Description of Artificial Sequence: Synthetic polynucleotide
  source 1..2001: mol_type = other DNA
cggaggttgtgtcggggttcgttaaaggttataaataaatcggacgggtgggaagtacgttttagcggcgattggatttttaaaaatttgttggtagagtgaaaataaaaattgttttttaagttggtaaaatcggcgttttagacggtgcgtaggagggttttgcgaggtttgttttcggagtttcgcgttagttttgtaggttcggttgggttcgtagttcggtgttttattcgtgggtcgggttcggttgcggggttttttcgtagtcgggatatttaggatagtagcggttggggagtcggggttaggggtttttttgtaattttaatgatttttattattattattcgtaaaggataaacgcggttaaggtcgggttttatagtggttgtgttggttatcgcgtggaggagtgtgcgttaatttaggggcgaggggggcgcgttcggtgtttcggggagagtttagaaggaagacgttttatcgtggtttttatagttagggatagtttgggtgttagaaatttttagagagaattcgaggggttgatgttttgggttattagtttttggtgtttgtggggttttttgcgcgtttatttttatttttttttttttttttaggttcgacggattttttcggaggtttaggatagtgatttatagtaagtggtgatagtggaataacgtgatagttcgttgtatttgttagttggtttttgggtaggtttattcgtcgggttcgattttagagtcgagttttcggagtcgtcgggtaaagttttttttttcgtttcggtgtagtttcgcgtttttcgcgttcggcgttgtcggggaaaagtggtataataggaaagtttcgttagagggttttttttagtcggttttttcgttataaaaagttagattttagtcgaggttttgattttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaaattcggagcggggaagtttaggggttgagagtttcggttcgggtcgtaggagttggggagcggggacgcgggtaggttaggtttttttatttgtcgtcggggttttttttcgtagtagtaaaggggttttagtgttcgtggtagtgtatgttttagcggatacgttggtttttaaatttagagattagaggggcggttgagaacggggcgttcgttgtgtgtgatttttgatcgtggaggaagggcgggagtcgggagtaggcggtggggttcggggttaggtcgcggtcgtcggttttcggtaaaggcgttttggtcggggaagggggcgagggtgggcggtcggtttttgtcgtcgtagttatatttgggacgttgaaatgggttttggggatagagtttatttttagcgcgttttataggagaagttcgtagtttaggtttgggtcgtgtagatcgttgggcgggttcggggttcgaggagagtaatacggcgcgaggtttagtcgcgagtaataatttcgatagtacggtttttcgaagacgtgtttcgggtatcggggttgtgagcgggggagtttcgggttttgggttcgtttggtacggggcgggggcg

SEQ ID NO: 7912 - DNA, 1265 bp, synthetic construct
  misc_feature 1..1265: note = Description of Artificial Sequence: Synthetic polynucleotide
  source 1..1265: mol_type = other DNA
cggcgaggagggttgtaggtgaagcgcggggagagggaggtcgttcgtttcggttttttttttaggggttttgcggttggttagcgtttcggttgtattttttggtgcgcgtcgcggcggcgttataggtttttcgattttttgattatcgttttcgggtcgcgcgttcggtagtcgggatcggtgatggcgcgggattgacggtcgtttttttttagatttttttgtttcgtttggggttcgttggggttgcggcgtcgtttcgagttgtatgtggggcgggcgcgttcgagtttagagcgagcggttttcggcgttttcgaggcggtgtttcgtcgcgttagagtacgaggaggagcggcgggtcgggttaggttttttacgcgtcgtagtttcggagtacgggtttttcggaggggatttggggcgttttagtttaggaggaaggattcggaagtagaagcggagtcgcgagtcgagtcgagttattgttttcgttgttcgcgggcgtcgggtgggggtttcggcggttggatgggtagcggcggcgcgggtcgcgggcggcgatgggcgaggagtagagtacggtgagcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagagggaggggatgaatagtaggaggcgtttttcggcgaagagttggagtttaggattcgcgtgggggtcgtcgacggattggttttggacgtgttgggttagcggcgttcgtttttcgttaagagataagttttttgtttcgtgtattgcgtggagagcgatttgttcgaggttttcgtttcggagtagttttcgtcgttcgcgtcgttatttggggtttcgttagtgttgaatttttttagtattcgtttttttttttttagttttcgattgttttttttaacggattttttttttttcgacggcggtagtatcgagttggagttttatttggcgttcgagtcg

SEQ ID NO: 7913 - DNA, 1360 bp, synthetic construct
  misc_feature 1..1360: note = Description of Artificial Sequence: Synthetic polynucleotide
  source 1..1360: mol_type = other DNA
cgttttcgattttcgtcgttgggatttttcgtcgtagtttttgttttagtttgtgttgcgggtggggtcgggttgagtagttcggcgttttttatcgcgttttttatcgtatcgttttcgatttaatttcgttttcgggcgtttattggtttgtagtattttttttttagtttgtgaagtgagtagggggaggcggtggtcggtcgtttttttttagcgtttagtttggtttcgcggcggaggcggcgtttttttcgtaggacggagttaagttggattgtcgcgtcgcgcggggcgggtaaagggggcgttgcgttcggtttcgggtagggagtgacggcggcggcggcggtttcgggcgagcgtggttttcgcgtgcgtatacgtatacgtcgtcgcgtagggatatacggatttcggtcgttagtcggttatataggcgcggagattcggttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggagagcgggcgagggtcggcgttaggtaagttttttagatttgaaatgaagttttttttcgtcgttgcgttttttttgcgcgttaggttgatattttttaatttaagtgtttggcgttgcgttcggggcggtcgatcgtcgtagattgtcggggtgggggtcgatttagttattttacgttttttttgatgcggagaagggagattaggggggtaggtaagttatgcggtcggagggattcggagggatatgtttttttatttttaggtggacggacgtatttacgcggatcgggaaggtagggttggagggtttttcggggttaggtatcgtaattcgtacggggtttgaggggtgggtaagtaatgtgttaggtgggggttggggtaggggttagtgtagaatgtttttttgtggtgatatattcgggattgtttaaaagagtgtcgttttcgtttttcgtggcgcggaggggttggggttggggatgttagggttttagtggtttttagaagaaacgttttgcggggtttgtggggaaacgtatcggtttttttaggttgaagtgggttcgttgagatttttgtttgtcgttttagaggtagaagtttttgcggcggttgcggggggcggaggttatattttcggcg

SEQ ID NO: 7914 - DNA, 362 bp, synthetic construct
  misc_feature 1..362: note = Description of Artificial Sequence: Synthetic polynucleotide
  source 1..362: mol_type = other DNA
cgtttagtacggcgggtagcgtcgcgttgcgtatcgtcgtcgattatgagcgaggatagtcgcggagatagtcgcgtcgagagcgttaaggatttggagaagtagtttcgtttgcgcgtgtgcgtgtttagcgagttttagaagatcgagcgggattatgtgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcg

SEQ ID NO: 7915 - DNA, 2566 bp, synthetic construct
  misc_feature 1..2566: note = Description of Artificial Sequence: Synthetic polynucleotide
  source 1..2566: mol_type = other DNA
ygtttttaaygygggagygtagtgtattttagtggataaattygagaatygtaygttgtttttygtttttatttttgtttttttygttygyggttttaattygggatttaaatgtaygagttyggtgaatgtttyggtaggagggygagggtttagaggtagtttgtttagtaaaaaygatagttgtgttttggtgggttttgggttattttaggtagaagttagagaagttygagaatttyggygggttggtaaagtttgtygagaagggtttttttggatatttttattaygggttttaggttygaatttttttttttatttggttttggagttttagatatagataagtttygggygygtyggygggygtatgtgygtgtgtgtttatagyggggtggtygtyggagttttttaagaattttagttttttygttttagttgttygttagttgtgagygttygtygggttyggaggttattygtaaatagttgggtyggtagttgggagtttgggaggtttttgtttagtttyggggtttygagaaaggagaagggggagyggagtggttgtttggttgtggttttttttaatttygtttgygaagttttygttgggagttyggagttttagtttttttyggtagtttyggttttygygttygtygygtttagyggtyggygtttygtttygggtttyggggaggaggygygtyggggtagtyggttaggatattgygttgttggtttttagagttgygggygygtttggtyggttttatttttygggttgttggggygggygtygttgtttygatttyggaygygyggaattttggagattyggtygtttttygttagggtygyggtgttgttttaggtttygggygggygttttttttyggttatyggtgtatttygttgttygtttgygggaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttgygaaaggttygagagaggtygtaggttaggattggatygtygggygtygtyggatggtgttgttagggtaatyggatggtaygygaagtygttygaggtttygattyggttaygggggygtttagtggattyggagagttattttggggagggggyggtttygaagaaggattgggtgggggygtatggagygggggttgygygaaaagttttttggggyggagttgagttaygygggtygygtaggagygtttgttygagggtygtttaygagggatttttttgttyggttgygygggtttttgygttgatgaagttatygygtttygggtyggagtttyggygtttttgtttygaatttagygaagttyggttttatgtttttaattatttaayggttttttatygtttagyg

SEQ ID NO: 7916 - DNA, 572 bp, synthetic construct
  misc_feature 1..572: note = Description of Artificial Sequence: Synthetic polynucleotide
  source 1..572: mol_type = other DNA
ygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgyggaagygggggttgttgyggtttttgttgtygttttttttgttgtyggtyggygygtttygggaatyggygtttaggtagttagggtttggagagygygagygttttyggaggygygtggttagggaggatttygattttttgggyg

SEQ ID NO: 7917 - DNA, 989 bp, synthetic construct
  misc_feature 1..989: note = Description of Artificial Sequence: Synthetic polynucleotide
  source 1..989: mol_type = other DNA
ygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygttaaygtygtygtygttattgagttttyggygtattttagtttygggygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyggygggygggyggtttttggygtttatatattygygygygtatatatatattayg

SEQ ID NO: 7918 - DNA, 2400 bp, synthetic construct
  misc_feature 1..2400: note = Description of Artificial Sequence: Synthetic polynucleotide
  source 1..2400: mol_type = other DNA
yggtttgatyggggygtttygtygtttttttagtgtattttatygttttyggttgggggygtagtattttggagagaggygtttggtttygygtttgggttgggggygttttattttgygttttgggggttaggggygtttgtygggtygttgtygaggggttttgtttatttttgtttagttyggagtttaggygagttagygyggygagtttttttttttttygtttgggtygttttgagttygygttygttttagttgttgtagttgttgttgttggyggttgyggggagygyggggygygygtygaagaggtttgggyggygaggayggggaygaggaggagtyggaggyggtaaggaggaagagygagyggaggtygaggggtttagyggygtggygataggattagggggtttygagaatatgggttagtaggyggttaygggtyggyggtyggaygyggtgaatttgtygyggtygggygygtattggygyggygagtyggagtygagygtagtygggggaggagggttggygtaggggygttygggyggagggggtygattatttattattaaygagttattatttaataagyggagagyggttygttagtygygygggaggygttyggggaagggggttatyggtygagygtagygtatattygtggygtayggygggyggygyggygtygaggatattygggatygygygyggagtyggggygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggttttttttatggtgatttttttygggggtttttttattattttgttttggyggaygtttaagtatttgtggatygtgtgttgttattgygggggtaagaygaaggtaaygygygtttygggygttygttttttgygttagttttatygtttttyggygttttttgtagtttattttttygtttygygtygygtygtgtttttttttattttygtttgtttttttttygtygtttttttttttttyggttttttyggtgttttyggatyggggtagygggyggygygtygggggtgaggagttgtttttagttagtgygtttygggaygyggaygtttaattttgtttttttgtttattgtagggttgttggyggttgyggttggggtyggggtyggggatttataggttygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataattttgtataagggaatttygggggaggagtatggttygagataatagggggatttygaggggygagagaagttggggagatttattttattattgggggtagtttayggggttgttatttttggaatgtgtygaggtygtatatttgatgtaattttttatttygttttttaggtgttttagtggaatatattttaagtttttyggtttttgtttttttgtttttaggttatttattttgggttttyggaaatgttattagtagygyggagttggagygggagttygtttgaggtygyggttttaygyggagygttttttttggygttygaggtggttagatgtygtyggttttagttatttttggtgtagaygtttatyggtattgaggttggygatattttyg

SEQ ID NO: 7919 - DNA, 1859 bp, synthetic construct
  misc_feature 1..1859: note = Description of Artificial Sequence: Synthetic polynucleotide
  source 1..1859: mol_type = other DNA
ygtayggaagtttttgtttagttgttagygygygtygttaggggttgtattgaagttgtggattygggatggggaggaggttggyggttttygaagtagggtttatagygggggagggttagygtygtttggyggtggttgygygtggttagtgyggatttaggttyggttyggtyggygttgtttgygtgtggttygggyggagygagggtttttggagttyggttygttttgggttttaggaagttyggygtgtagygttagaggtygygtgtgttgggggagggaggagtatagattgtgtttgggggtatttaggaygaatttatagaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttgtgtaatagaaattygttygygtttagtagygttyggggtygtttgygtyggattygtagtttagtatttttygygttttggatttygaggaggttaggtagagagyggttygygyggttttygtttgygtttttagtttygygttgggtagygggatatgtttggtttyggygtygttatttyggttttygtttgtttttgagtgyggagttyggagtttttttygyggtgygttgggttttagagggttagaggttattagggggtyggtatyggygggagtttagtygggygygttttyggtttttttttatttaygtttttygyggtygttygggtttaggggygtagyggggaggagatttyggttagggtyggggagygygagggyggggyggggttyggyggggaggggygygggygggyggggatyggggygggggtygggttygggggyggyggyggygygggygggaggaggaggagtttttygygyggggtaggggyggagygagyggtygygtygyggagttaagtgagttygtttyggagtygygtygtygtyggtttagtatttygggygttygtygttttygtygtygtygttagygyggggatgtaggatgtaggygggygttaggttttagyggyggyggyggtagttgtagtagtagtagtttyggyggyggtagttttttttttggtygatggaygtagagtygtygtygtygtygttttgggtttggatggtgtygggttyggtygggttgtttyggtttagygygggggtygtggttttttyggtgttgttygtttyggtttygtygttygyggtttygttgtttttyggttttttyggttggtyggtttygagygagtyggtgttttygttgttgtygttgttttttgygttagatttygtygtygtygtygtygygtatttttttttygygttttaygggtaggtaaygtgttttygtttygtttyggttygggtygtygttttttttgtttttgggygygttttgttyggttyggttttggttttyggttygygygttttttttttyggyggttttygtygttttaaatttttaggayggagttyggtagtygtgtttyggygagaaagttygtgtttggaygttyggtygtttattttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyg

SEQ ID NO: 7920 - DNA, 902 bp, synthetic construct
  misc_feature 1..902: note = Description of Artificial Sequence: Synthetic polynucleotide
  source 1..902: mol_type = other DNA
ygggttyggttggtttttagtaggtttgtyggggtttttgtattttgtgttygggatttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttyggggtttggggagggggttgggtaggggyggaagygagttggagtygtgtttgtygyggygttgyggagtggaatagatggttggggaggggagagggtgygtggyggggaggaggaggggtgygggggtyggaggatagggaaygaggaatttygaagtttggagttttttaggagaagttttttttttygtttttttttagaaaggggggtatatatgygtttgtttttttttyggagagttttggtttttgttttgtggtagattttgtygygtaattttttgttttagggygygttttttatttttaaattttygtygygggayggggtggyggggttaggatygttaggagyggttygggtygygagggttaatggggtygtttttttaggggygaggaggyggygggaaaygggttyggggtggggaaygagttttgggatyg

SEQ ID NO: 7921 - DNA, 2044 bp, synthetic construct
  misc_feature 1..2044: note = Description of Artificial Sequence: Synthetic polynucleotide
  source 1..2044: mol_type = other DNA
yggygttttygttttgtttgtatttttttttattgtttttttaygtttggaatgttttygtttttgtagtttgtagatagyggaaatygygggtgtaaatgtgtaggggtygttgatatgatyggttgtagaagtttatttagggttattygaataggttagygttygggattgtataagaggttaggygatgttgtgggtttttaaatttgtatagttgygatattttgygaygtgttattttatttttagtggggtggggtgggggatttttttygtagttygttgaaagygaggtaggaattattgtaatttttttgtttaggttgaggtygttatygtttygyggatgtaygygttgtaggggygtttttygtygygggtayggygygggaagggatggggtttggtgggagtgggtaggtggygggagaggygygtgttygtgtattagaggttttygtgygtgatataggtygatgagtttttgygggttgtatttaygyggagttatagatygaaaaggttagtyggtggtyggtgtgttaatatatatagagagaygttygttaggygygttgtaggttgggaygaggttaggagggtttaggttggaggagggttgaggagggttgygggggygggtttyggygtagggygttyggagyggagggggygggttygaggyggggygggtygyggygttgaygggttgtygtygttgtattygtttttagttygyggtgtygagygtaggyggaggtatatggtttygaygggaggygygyggygagtattyggagttyggttttttgtttgagtayggtagtygygttttygttygygygttttygttttttyggtyggtagttygyggatatgatygtgtagtttttttttgggttgggatttgtttgaagattttttttatggaagygatgtttttttagtaggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagttagggtyggygatgtttgttygggagyggtagtyggygttgaagaaggtaggtagyggggttgyggygttggtgggttyggtttttttatttgttygtygaggygyggttgttttatagtagttttyggggggtagatatggggagtattgttttttatattagggttttggatgatttygggttttttaggtgggggttatagtttgaggggygattgtggatgataaygttygatattayggggatatgtaggttyggttgggtttagaatygagtagggtgggggygggtgggttgtggttgggggttttgagggttgaggtgggggattttttttttgtattggtttttggtttttgggattttggtygggttggatagggattygggtgtyggtgtgggygtgggggtagygygtgttttttgttaaagttgggagagggatgtaggtgataatttgtagygttttatttygataaatayggtygttgtgttgygggaggatttygattygggttaggtttygttggaayggttttttgagtaagtgtaygtgggtygygggttgtyggtttttgtygtttyg

SEQ ID NO: 7922 - DNA, 1152 bp, synthetic construct
  misc_feature 1..1152: note = Description of Artificial Sequence: Synthetic polynucleotide
  source 1..1152: mol_type = other DNA
yggygtatataagttgaggattgtygaggygttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyggtatagyggttttttygtttygyggttttygttygtygagaygtggttttaagaagtggtgtygtagtyggggtagaggyggaggaagtygagtygggtaagtygggaaggttgyggagaygttttgtyggggtaggtgttgtagttttagttagyggtttttayggagggggyg

SEQ ID NO: 7923 - DNA, 872 bp, synthetic construct
  misc_feature 1..872: note = Description of Artificial Sequence: Synthetic polynucleotide
  source 1..872: mol_type = other DNA
yggtygggtttagygatgyggttgagttgtttattygygtttgttgaatyggttaattagyggygttttyggatttagygggagygtttttatgtygatygyggtaggygtgygtttttyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttygttyggttttyggtgtatgtggtttgygaggyggtagaggagatgtggggatttagggtygtaygtygtgttygaggtttttaygagaggttttttttygygggtttttgygtaattgygtgaagtyggttygggaaagttaagattgtggtttaggaagaggaaggaaygygggygatagagttggggtttgggaygttgagggggtyggtggtagtttttyg

SEQ ID NO: 7924 - DNA, 1070 bp, synthetic construct
  misc_feature 1..1070: note = Description of Artificial Sequence: Synthetic polynucleotide
  source 1..1070: mol_type = other DNA
yggygttgagttttgtttagygygattyggatygayggaygygtagagattttgtygggattygttttttagtyggygttyggggagtygtyggtyggttttatttttygttygggagtygggtagggygagaaggtagygygagtggyggtggygattttygtyggggtttttgygaygagyggtgattagtagygttygtagtygyggtttygttttttattyggaygtggttaagyggyggyggttaygaygttyggtttttygggatygttyggttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygyggttatygttagyggtttgattygttagaagyggtaggygygggagtagtattgggatyggtygtttgttagtaggaggyggagtagttttagtaagaatygygggttttgtaayggtaatttggtggatattttttttaaagtgygtattttyggttttaagaagygtaggttgyggygttaaggtttgtgggggttatggtygggagatgygtttygggtygtttttttttygtttaaayggagtttttttaggttttttttttttttyggttttttyggtttatttyggtttyggttttttttttgagtattttgggtgtygtygyggggattttggagttygttgtygggtaatttgtagtygtygagaagtgtagtygttagagatggtaagttggttgtttttygtyggyggtttttgtttttygygtttttgtaggttgggttttgggaaatttgttttttttgagtttyggtttttygggaggatagggattggtattggttttggaaygyggggtatttttttttgttatattyggggtygagttatygttyg

SEQ ID NO: 7925 - DNA, 395 bp, synthetic construct
  misc_feature 1..395: note = Description of Artificial Sequence: Synthetic polynucleotide
  source 1..395: mol_type = other DNA
yggyggtttttygttttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttygatgtgggtygtttttttttttttagyg

SEQ ID NO: 7926 - DNA, 265 bp, synthetic construct
  misc_feature 1..265: note = Description of Artificial Sequence: Synthetic polynucleotide
  source 1..265: mol_type = other DNA
ygtyggattygyggaaaaggtygttggaagttttttttgaagtyggtagtattaagaggattaataygggyggtgggtatygtttttattttttygttggttttatttttygtygttygtttttgtttttttttttygtygtttttttttttttttttttttttttttttttgyggttyggatatttttagttygaattyggyggtttttgygtttttgtttygygtttttttttttgtatttgtttygygtttaggtgttttyg

SEQ ID NO: 7927 - DNA, 1169 bp, synthetic construct
  misc_feature 1..1169: note = Description of Artificial Sequence: Synthetic polynucleotide
  source 1..1169: mol_type = other DNA
ygagttygygttaagagttaygtygagaygygtygtyggtggggttaygygagatgtaatyggagagtttaaaattagtttaggattaattttttagggattygtttaatttttttygtagaagagtttaagtggggtagtggtygttataggttgaggatgattttyggaygygttttaggygygatygtattattygtttttagtttaaagtttgagtgatttggtattatttttttaattgttttttatttttttygtatttttgttgtgtttatygtttttaygtatttgagagtttaaattatgttaagaygatttggagaaaygttygatttgttttttaagttaygtaaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttattttttttttttatggttttattttygttgttagtatttygattttagtttgtaattttgattttgggtttgattataaatgaygaaagatygyggtagtttttaaagtgygggagygagtttygtattggttagygyggyggagggatttttttaggaggttttaagtttttaagtttgtggagagatttggtaatagttggtaaggtttgttttagttattttygttggttttttgtttttgtatttagygtttgagggygttattygttttttttttgygttttaygtaagyggtttaaggaatttattygattyggatttygtttygtatgttttttaagttttygttattttygtaggygttttagaaaggygtgatggttttagtttagtgttygttagttyg

SEQ ID NO: 7928 - DNA, 1743 bp, synthetic construct
  misc_feature 1..1743: note = Description of Artificial Sequence: Synthetic polynucleotide
  source 1..1743: mol_type = other DNA
ygttttygyggttgttttttttttagggtygtyggtggtttaggatttggttatyggggaggggygtggttttgtygaagtygatgagttataygtyggygygatggtagtgatygtgtataaagaggagygagttgtygattatttgygagtttygtatygttaggtygyggttttgtttagagaygtttttgtygggttttygttttagttttygyggttygggtattygggtagtygtygtttatttygtgttttttgaagaattyggatatttttagggtgtttyggatttgttgtaggyggtttagatatygtttttgtagagggtggggtgggagaggagggtaaattaattaaaygttaaatgagtttttgttaaygatgaggagtygggatttaygttgtgtttggtaaatgtygttaggaggaggatttagggtttygtttagygtggtttagaagggaaggagygtagagtagttgygagttagygyggtgagggttatggtggggatatagtygagggtattgggttagatgataggggtagttttyggttttaggttttttaatattttagggtttgggatttygtttttattagtatttttttatttttttgtataaattttttaaagaygygaagtatttgttttyggtttygygtagttttgaagtyggtgttgtaggagtygttygttttttggatgtgggataggagtgttaggggtttygggttygttagtggggaagaggatagygtagagtagyggtattttttagttgtaggggayggygaggyggtgggagagggyggaggggtaggyggggygggagygggggatygggaaagatagygygtagtggggttgyggyggtgttagygaagygygtttgttttattttgatgttttygatgyggaagtygagggtggtgttggagttgatgttttttygttattgtatgtagygyggtttggtgayggygygttgygygtgtttttttttygtgggagttttaggatttatygttagtatttttttgtatatgttttttygtagtttgggtygtttaygggttttggttagttttttttttaggtaagttttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattagtgtgttttgttagttgtatttaggygtagygttttttgaaagggtttatgatyggtagattgattatggttyggattttttgttagtggtttttttgaaagygatagggttaaggtttgataatyggygtttyggtaatgtataagttttttttttattgaaatagggtttygttaygttttygatttatyg

SEQ ID NO: 7929 - DNA, 2405 bp, synthetic construct
  misc_feature 1..2405: note = Description of Artificial Sequence: Synthetic polynucleotide
  source 1..2405: mol_type = other DNA
ygggggaggggtataygtagttttygtgyggaaagatggtgttttttttttatagggttgygygggtatttattttygttgtaaagygttygggttaggygyggtttgtttygggtyggggygagttygttgttttttgyggtagatagygatgygygtttttygttttagttttyggttygttyggyggttygygygttttttyggtgtagtatgygggygttgtgaygttttyggataaatgtygtgtaattgtgtaggygaatgagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatttaatgtgattyggttgattatgtaaagattaggattggaygtttttgtagttttatttygttatttatttttttttttttatttygtattagaaataaagtggggggggggggygagtttttggaggagaaaatgataattggtatttaattttaggtttatagtgygtygyggtggggygtaaagaygtaaattttygggatggygagttttyggggttttattgggttaaaygaaaattgatttgatttgttttttaatattygagggagagaaggggagatgaggggagggagggtagggtttgagtgtgtgygtgtgygtgtgygtgtgtgtgtgtttggggagggggaggaggtattaagttgtagtttgygygyggttttgygtttyggyggggttgygtgygtgtgtttttgttygygttgttgaaaygggtttttygagggatyggygttatatgatttygtttgtttttygttagygygtagatygttagttttttagtttgttyggtatyggaggagggtygggyggtatttttygggtattggggttttgyggagyggagaagaggttttagyggggaatggtatatttggatttaagaagtygyggttyggygttagattttggagtgtagatatttggggggaggggagagttagagggagygagygagygagygttagagagaggtagygygtagygygtayggayggggggttgttgygyggagaagatgtaagygygtggggtttygttggtttttgagtattatgtagaaggggattyggttgaatgatggttaygtygygtttttgggattgttggygygtaaggayggtaygygtaaaggttatttgagtaagyggagttyggataatataaaatggtaaattaagtggttygygttgttgtagaatttgtttttttatttygagagygattygagttygyggttttyggggttttatttgttggagggttgygtttgygatygygygtttttttttaagtyggygttgtyggttaaggagtygttggagaaataggtgaggygagygtygygttttgatttttttgygtttyggtygyggttttgggggtttagggttttyggttggttgatggygtttgaattttggtttttttatttttggygttttaggygttttttgtatttttagygagaggggaggtttgtttttagttaggygagtgattgyggygggtagagggggtagggattgagggyggggagtagatgtgggttgyggttgtttttygtyggaygagtttygtgggaggygggtatagaggggtygatatttggagatgtagaggaagatggggttttaaggattagagaygatgagtttggatataygtttagttaaaaatggtgtttttaatttttatttttatygtttagttttaatagtttygatygtttgttttatatygggaaygtgtaatttttygygtttaggtatgggaagggtaagayggaggygttygagygttgttagtttttgtttygtygtagttgagggyggagagyggtttgygttagtttttyggagttgggttggggttatggggttataygggtyggttyggtattatygagyggtggtgggtttttagttggyggtygtyggagtaataagtttaaagatttttaaggatygttttgatgygtyggggttagggttagggttgttgyggaggtagygggaygaagtgggygttttttttttttttygttttttgygtygtygtygtygtygtagtygyggttatagygttgyg

SEQ ID NO: 7930 - DNA, 1920 bp, synthetic construct
  misc_feature 1..1920: note = Description of Artificial Sequence: Synthetic polynucleotide
  source 1..1920: mol_type = other DNA
ygggygttgttttttgyggtttttttygtygaggtttgtgygtggyggggtttttaggagyggtagttygtgyggtttgggggyggtttttttttygtatygtagyggggygtgtaaagygtttgyggttgtagtgtgggygtttattttaygtgttyggyggygtgygaggagtagtaatattttttgtgggygatgaaggtggataggttgttgaatttgatgttgtaaagayggtagtatyggtggttgtygttgggtagyggygtyggygtgtttttgttgggagtttggaygtttttgttygagtaggaggggggygtyggygggggyggtayggtttygggygyggyggtyggggaygggggygggtygggyggyggtttttggggtttygggtygaggtygtttygggggttaygggattygggttgyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtygtttttygygtygtttayggagttattygggttttggttgttttygttgtttyggtygttygygtygttttygggygtggtygygtttttagtttttttttygygygtttyggggttyggggaygagygyggygygtygggttyggygggttggtyggggggygygygggtygggtyggggggygttttgggtttgygygyggtaggygygttttygggygtayggyggtttgaatagtagaggygtttgtgtaygtagtagttgttgaygttgttgaaggtgatttygtattygaagtaygtagygtttttgggggtttyggggaagagttyggtttgygygtygtyggygttygygttygygttttgttgtagtyggttgtgtattagttyggatattttggttaggattttygaggyggggggygtygygtygggttygaataygtattgyggaaggaatagggtttyggttaggtttagttygtygggtatygggttggagttyggygtggggttggatagttyggttttgattttggtyggggyggggttgygyggygayggygttygygayggggtttggggtttaggtttttyggggtttaggatgggggtygttttyggtttttttatygtttttattttgatgtttttgggggtygtygggggttygttgttgtttttattttgggttagaggtttygttttggttttttygttggtggtttyggttagggtttttttgtttagttttggygatggggtgggygttaggtttaggttygyg

SEQ ID NO: 7931 - DNA, 1403 bp, synthetic construct
  misc_feature 1..1403: note = Description of Artificial Sequence: Synthetic polynucleotide
  source 1..1403: mol_type = other DNA
ygttygttttttttaggttyggtgggattagattygaagttaattttygttaggygttaggtgtagattttaggttaggttagagtagtttttgggttttyggatygggatgttygttttgtttttttttttggtttygttyggtttgttatagggggaggtttyggtttygtatttygggtagygaatttygtyggtygaggttagtttygtgygggggtttttygygggatygatygttaagyggtattgttygtttygggygttygttyggttttagaygtaggttttgyggtygtttygtgataagtatattgaygggttattgttttttgaygagtgttaaaaagttygtttgttttgaaygttaatttttaagtgatttttaygaggttttttttttyggttttttygttgttgtttygttygtattyggtttttagtaggtgtttaagaaaygtttagtaaayggtagygtaggygagtttgttttgygygttggygygttttattgtttayggatggygggygattttaygggattttyggttygtaggattttygttttygaggttgtttttgggtygggaggggttattttagaggggygtttattttygayggygggggtyggggygtygygggtaggggagggygtagtttttaagtagttttagtttggtttagatttygygtttagygagtyggtyggttaggtttatattttttatttgtygttygttttaggggaagggttttttygaygaygttygagtttttttttttttyggagggtyggaggtyggygtttattggtyggttttgggygaygtttygttttttygaygttaygggttaatgagygygygttgttagtttattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttyggagggtttttttttygyggatttygagttygtttygygyggtttygygttttttgtttttttgtaaagtaatttttagggtyggttyggggygtttttttttygtagttygggyggtyggggtttttgagttyggyggggtygtattaggggtgggtgggtyggggtttygggaggggaagygygagygygggagygaggaagaaaggyggyggttttyggggatttygyg

SEQ ID NO: 7932 - DNA, 1088 bp, synthetic construct
  misc_feature 1..1088: note = Description of Artificial Sequence: Synthetic polynucleotide
  source 1..1088: mol_type = other DNA
ygttgaggggtygtatttattygygtaggtattagtaggtagttttggygttygygggaggyggtygggggygggggtttttyggtgtttatygtygtttttgyggttgggttygygtttygggtyggtygagtttaaygttaggatttygttygagttttttagggtttygttaggygtygygttygygttygygtttttttgtyggtttyggttygggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggttggaggaggggagygygygtttttattygggttgggtygtygaggttygyggygtatygtggyggyggtgggyggaggggggyggggggtatttttttttttttgtggygtaggtgggygygttttggatyggtttgaygattttttttygtygttttatttttttggttaaaggtttttagtttttaattagggatatttttagtttatagtttygaagttatgggtttttttyggttttttgaagtygttatatttgtgttagtyggtygygtttttagattttttttygyggagtttttttagtatttggagaygtagygtagggtttygaggayggtttggttyggagaaaagatatygaagttttaattttttttaatttygttttttttttttttttatttttttttttygtttttaaagttygggggttttatttttttttyggttygyggagtttttygaattttgyggggattyggygttyggyggtgtttttttggggygtayggggttggggygggagygaggagattaggtggggaggggattttagattttagaygttaggggagayggygtttttyg

SEQ ID NO: 7933 - DNA, 1812 bp, synthetic construct
  misc_feature 1..1812: note = Description of Artificial Sequence: Synthetic polynucleotide
  source 1..1812: mol_type = other DNA
yggggtygttgygtttttttgattattgayggttaggayggttttagtttygttttatttgtaagttttattttaggttygagttttygagggtagggatagtttttygggtttygaggtttgattagagtttgaaagtttttgtygggggttgtttygatttagygaggygttaggttgttyggygyggttgggggygtttagygtygggattttagttttgtttyggtygttygttggtttagtgygtaygtttyggtagtttagtttttttttttayggyggtaggagagttttyggtatttgtttggggygggggygggggyggggyggggygggygtygygtttttttgtttgattggtaggaagatagattaatyggaggggtttttyggggggaggggyggtgtygtgtttgagtygggygygggygatygagggagttgtagttattygygtgyggtaygygtyggtygtttgttyggatygyggttattagtgtygyggtttttygattttygtttygtygagtygygygygygattgttattttttttaattgttttttaygattttttttgtgtatgtatttattttttgtttygttttgttttttttaaggyggtggyggyggygatagyggygtaagttygtagyggggagggggyggtyggaggatgyggygyggggttgygttygttaygttygttgttgttgttyggttygggtttgagygtygagtaggtgggtataggtgygtyggggggygggaggygagygttggttagagggaattygtggattyggygatygaggggyggatttggyggtaagggaygyggygatyggtgtygtttygttttatygtttatttttttttttttyggttatygygttttttttgggttttttttttattttygtattttattttagtggttttttatttttttatatttattttttatttttttttagatttttttgtaaaattttttagtygttgygtygttttttttaatattttttttyggtttygtttttagtttttagtttttttttaygttatttttatttttattttttttyggatttygtttttaagttaaggagygggagggggatttattyggtgtttgtyggagtggygyggggggtgtggtyggttygtttttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttgtygggtyggygygttttgggygtattggttttyggagatggygygtaaggattgattttygtggtgttagatattttgtygggygttttgygtyggggttagyggtttygttggtttgygttagtgygttgyggtttygttttttagtttttyggtttttygttttattttttttgttgtgggtttttgagtattyggtttgggtagtttagatagaggtygtttaygaggttggygttttttttygttttagaagtatttygtttttatatattttagttygtyggttttttgaaggttgggttagtttyggtttttygttagtttttgttyggttttttgagttttagygatattgtatttaatygttagttttttttygtygttyg

SEQ ID NO: 7934 - DNA, 5819 bp, synthetic construct
  misc_feature 1..5819: note = Description of Artificial Sequence: Synthetic polynucleotide
  source 1..5819: mol_type = other DNA
yggagggaaatygggtygaygataagggtggttattttygggtttttygygttyggtttaagygtttttgggtggggtagtttaaayggggagaggggtttygtgggtygagggttygaggtygtagygagtttagygtttggttaaatttggttygygygtttttttattgttttgttagggttgtgtgatttttyggagttttaygttttygtttaaatagtttttagygtttttgttggtattyggggygtttttattttagtttttgtattyggygygtygygygtagatyggayggaggggaaagttggtaagagygyggygttygygggagaaagygttaatgggyggtygggtgggagtagygygttygttygtttaygttaygtyggtgygggttyggttgaygatygyggygtttggggaygtyggygygtttygttygttaggtgtttygtttggaaatgtttttattagttgtygtyggtttttygttggagygygygygtygagttttygygyggagttttygygggttgtygggagyggtttagygttatygtaggtaggtgaggtttttygttttygttttygtttyggggtttygagattttttttttttttygaggaggyggaggtttygygyggtygtygaggggagygggyggyggyggttgyggygatttttyggtgygtttygggttgygagttgtttttygyggtttyggtagttatayggygygggygggagtttttttagtttaggtagggagtgggtttygtygtataaattttgygaggattgtttttgygtttaaggggataaagtttgttattygtygttaggttttttagaggtygttgygtttgttgtaagttgygggaagtagggtgygygggtyggygyggggyggggggtggggggttyggagtggttaggtttgagttttggaygttyggayggygtttygtttagttttaggtygtatttagggagtaagyggygggggygtagygggagagaggagggagagggtygygggtttttatggagggyggttgggaatttagagatttatygtttgtttttgtggtttttttttttattattggtttygagggggtttyggggttgtgaggaaatgatttgttaatttygaggttygttagtgyggygttagygatygtgaggttttttaaatttatattttagtygggtgtttygagyggtgggygggtataggygtttttaaggtttttggttttaggttttagaaagaaaggtttttgtttggtgtttygggttttyggtttygtttttggttggagttaatttttttgggttggaaggagtttttttyggaygagtttttggtgyggggaattggtggtttttagggtaatttttgaagtattagggttaggttggtygaagaagggttagggttyggtttgttttttyggaggttttttatggtttygayggttaayggtaatttygttaaaataggygattygtttgygtttygygttaggggttgattattttttgttttttttgyggtttgtttyggttttggtttttygtttttyggagygttttaggttagygggagtattttattttttygaagttgagtyggtgttgtgtatttygggagtyggttgatttttggtttatttgtttaygggtgtatttagtatygggggtttttagagggaggaaggtttagtatttygagtttatgtagaygygtttagttgatatttgagatgttgagygttttatygttggtgaaagggatattgggtgttttygttttaggtttggttttttggtgaaggtatttggaaaatattttagtattatttatgggagaagggtggtttagtgagaattttyggtttgggtaggygggtttaggttaggttatagggttttagtgagatgtttyggtggtygttaatttataggttggattgattttgtgttttggaatgagtagtggggtttgggtgaggtygggygggttaggaggttttttgggtagttgygagtttttygaggtagggtgattgtgattgggttyggattttaggygttggggtttgttggygggtaggaagtggagygtgtgtgtgyggyggtttgggaaagtygatttagaggttaggtttttgggttayggagaaagggtygttygttggtggggattggagygtygatttatgtatataggttggaaaggtaaaagagaataggagaaggtggyggtggtggttaaaggaagttttygaaagggtttttaygtattggttgttttgggaagtggaggttgttttttttagattttgtttagaagatgaatggtygtttgttttggggtttyggttttagttaagtttygtygggtttggaaggaaggaaatgtattagttttaggtttgggtgggttgagttgttgtattagagtttagaggtgtagggtataggtggttgggtttttgggttttggtttttttttttagtyggyggagtgtttatagtygtygaggttaggttttygagtataggtgaggaaaggataagttatagttgaatgttttttttttgggggtttttattttttattttagtttttggttyggttgggtttatattttttttttagtygggttttattatttggagagagygagtagtttgtaaataataaataatgggaagtagaaggatgttygggaaaaattagaaaattgtaaggagtggggaggagggagggtgggagaggggaggaaggagggtgggggaggggaggagtaggaggagagggaaaggggttgagagatttatttttagygagaaatttyggtggttagttttttattatttataggaaggtgatattagygatttaggtgagaaagaaagaaaygyggtttgtygygaaattaatatagaatttagaaataattattaatgttatttgattygtgttttttatatatttttygyggttatygaygttaaattgtttgaataatttgtatggagyggttatttattattttygatggtttttttttgtaagtagttyggaygtggttygtttyggtttaaygygatyggagaattygtatttttatttgtaaattaaagtaattaygtagtagatattatatgatgtgtattgtggtttttagatagttattaattatttttaatygagttgttaaaagagtaggtagatttygtttttgggaggtaggtttgtagttggggagagggygaggaygttattattaattagagggtgattttggggygatttataggtttgaatttaggaatttttttgagtaagtttgtataaygttgttttgtayggttttttttttaatttattaygggaggtyggtttagggggygagggtaatyggggygagtttyggtttyggagggygatggygtagaaggyggggaaygggttygggatggttygggygtttttttgtygtttttttgtygtttgtttattggttttygttttgaatttgggtaaggttttagggagggtattggtygagggagttttggggtgggygttyggttttttttttygattgtttygtgygttttagatagaaagttgggtaaaatggataggggagggygttttygttaggtatttaaygttttttttttygtagttagttttgyggggygtygggagggaygagtttagygggaggggtyggggtttgggttgaggaatttgttttttygagygygtagggtygttyggtagttttyggtttagtygygaggggtagggggaagtyggyggagtayggtyggyggaaaggggatyggggaggaaagtyggggaggygaggtgggggyggtgggttgagygggaatttaaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtagtggtygygttaygtyggttttagygygtagaattttgtaggtttygttygttygtttygggtygygttygttatgttttattygtagtttggatatttttatttttyggttttttaggtaagyggagtttygtttygtttaggttatygtaggtgtyggtagggyggatggggyggggayggggggtggggagtgttygatttaygattgtttgyggttttygagttagtaaggtttgggtygygygttttttaygtttaatttttgttttttaaattttyggggaaaggtygaggygttaagaaaattygaygggtygggttygggttttttgatgtttgaattataaggtttaggttgtgttttaggggagttttaggattttaaggaatttttggggaaggaggtttggygygtaaatggygttagaggttttggaaatttttyggggaagggtgtaggtgttyggttgggttttaygtggyggaggaggttagaygygtataagttagtggaaaggggygagtattttggtgtggayggygggaggttygggggtattyggggtaygttttygtgggyggygygygggattggtaaggtttagggttttagtttttagttyggtttttygttagttttygyggtttttttttgtagtttttgatggttattaattttttgagtaygtgttgygagttyggaggtygtaygttggyggatttygggttygtygtttyggtttaggygtyggtttattgttyggtttaygagagtyggttgttggttatygygygttaygagtttaattyggtygyggygttgggygtttatgggggtttttatggyggatygtagggttatggtaattaygtgatttayggttyggaggygttygttttttattyg

SEQ ID NO: 7935 - DNA, 2001 bp, synthetic construct
  misc_feature 1..2001: note = Description of Artificial Sequence: Synthetic polynucleotide
  source 1..2001: mol_type = other DNA
ygttttygtttygtgttaagygggtttaaggttygaggttttttygtttataatttyggtgttyggaataygttttygaggggtygtgttgtyggggttattattygygattggatttygygtygtgttgtttttttygggtttygagttygtttagyggtttgtayggtttaggtttgagttgygggttttttttgtggggygygttgggagtgagttttatttttaaagtttattttaaygttttaggtatgattaygayggtagaggtyggtygtttattttygttttttttttyggttagagygtttttgtygggagtygaygatygyggtttgatttygggttttatygtttattttyggttttygttttttttttayggttaggggttatatatagyggaygtttygtttttagtygtttttttgatttttgaatttgggagttagygtgttygttggggtatgtattgttaygggtattgggatttttttgttgttgyggggaggagtttygayggtaggtgggaagatttagtttgttygygttttygttttttagtttttgygattygggtygaggtttttagtttttgggttttttygtttygggtttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggggttaggatttyggttggagtttggttttttatggygaggaagtygattgggaagggttttttggygaggtttttttgttgtgttattttttttyggtagygtygggygyggggaaygyggggttgtatyggggygggggagggggttttattyggyggtttygaggattygattttggggtygggttyggygggtaggtttgtttaggagttagttggtaaatgtagyggattgttaygttattttattgttattatttattgtaaattattgttttaagttttygggagaattygtygaatttgagaggggggagggggatgggggtgggygygtaggaagttttataggtattagggattggtgatttaggatattagtttttygagttttttttgggaatttttagtatttagattgtttttgattgtagggattayggtggggygttttttttttaagtttttttygggatatygggygygtttttttygtttttgggttagygtatatttttttaygygatgattagtatagttattgtgaggttyggttttggtygygtttgttttttgygagtgataataataaaaattattggaattgtaaggaagtttttggtttyggttttttagtygttgttgttttgggtgtttyggttgyggaaagatttygtagtygggttygatttaygagtggaatatygggttgyggatttagtygggtttataggattggygyggggtttyggggataggtttygtagggtttttttgygtatygtttgggaygtygattttgttaatttggaggataatttttgtttttattttattagtagatttttaaaaatttagtygtygttgaaaygtgttttttattygttyggtttgtttgtagtttttgaygagtttyggtatagttttyg

SEQ ID NO: 7936 - DNA, 1265 bp, synthetic construct
  misc_feature 1..1265: note = Description of Artificial Sequence: Synthetic polynucleotide
  source 1..1265: mol_type = other DNA
yggttygggygttaggtagaattttagttygatgttgtygtygtygggggagagggaattygttgggagggatagtygggggttggggaaggaagagygggtgttgggagggtttaatattggyggagttttaggtggygaygygggyggygagagttgtttygaggygggggtttygggtaggtygttttttaygtagtatayggagtagaagatttgttttttggygagggaygggygtygttgatttagtaygtttaggattagttygtyggyggtttttaygygggttttgggttttagtttttygtyggggggygttttttgttgtttatttttttttttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygttgtttatttagtygtygggatttttattyggygttygygggtagygggggtagtggttyggttygattygyggtttygtttttgttttygggtttttttttttgggttgggaygttttaagtttttttyggggagttygtgtttygaggttgyggygygtggggagtttggttyggttygtygttttttttygtattttggygyggyggggtatygtttygggggygtygagggtygttygttttgggttygggygygttygttttatatgtagttyggggyggygtygtagttttagygagttttaggygggatagaggggtttgggaggagayggtygttagtttygygttattatyggtttyggttgtyggaygygyggttygagggyggtggttaaagggtygaggggtttgtggygtygtygyggygygtattaggaggtgtagtyggagygttggttagtygtagggtttttgggggagaggtyggagygggygattttttttttttygygttttatttatagtttttttygtyg

SEQ ID NO: 7937 - DNA, 1360 bp, synthetic construct
  misc_feature 1..1360: note = Description of Artificial Sequence: Synthetic polynucleotide
  source 1..1360: mol_type = other DNA
ygtygaggatgtggttttygtttttygtagtygtygtaggagtttttgtttttaaagyggtaggtaggggttttagygggtttattttaatttgggaaggtyggtgygtttttttatagatttygtagggygttttttttggggattattgaagttttggtatttttaattttagttttttygygttaygggaaaygaagaygatatttttttgaataatttyggatgtgttattatagaggggtattttatattggtttttattttaatttttatttagtatattgtttgtttattttttaaatttygtgyggattgyggtatttagtttygggggattttttagttttgttttttygattygygtaggtgygttygtttatttaagggtagggaggtatgttttttygggttttttyggtygtatggtttgtttgtttttttggtttttttttttygtattaggaggggygtgagatagttaggtygatttttatttyggtagtttgyggygatyggtygtttygagygtagygttagatatttgggttggggggtgttagtttgaygygtaggaagggygtagyggygggagggggttttattttagatttgggaggtttgtttggygtyggttttygttygtttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygagtygggttttygygtttgtgtggtyggttggyggtyggggttygtgtgtttttgygyggyggygtgtgygtgtgygtaygyggggattaygttygttyggagtygtygtygtygtygttattttttgttyggggtygagygtagygttttttttgttygtttygygyggygyggtagtttagtttggtttygttttgygggagaggygtygttttygtygygaagttaggttgggygttggagggaggygatygattatygtttttttttgtttattttataggttggggagggggtgttgtaggttaatgagygttygggggyggggttagatygagggyggtgyggtggggggygyggtggggggygtygggttgtttaattygattttattygtagtatagattggagtaggagttgyggygggaaattttagyggygggggtygggggyg

SEQ ID NO: 7938 - DNA, 362 bp, synthetic construct
  misc_feature 1..362: note = Description of Artificial Sequence: Synthetic polynucleotide
  source 1..362: mol_type = other DNA
ygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttttttggagttygttgagtaygtataygygtaggygaagttgtttttttaggtttttggygttttyggygyggttgttttygyggttgttttygtttatggtyggyggyggtgygtagygyggygttgttygtygtgttgagyg

SEQ ID NO: 7939 - DNA, 2566 bp, synthetic construct
  misc_feature 1..2566: note = Description of Artificial Sequence: Synthetic polynucleotide
  source 1..2566: mol_type = other DNA
cgtttttaacgcgggagcgtagtgtattttagtggataaattcgagaatcgtacgttgtttttcgtttttatttttgtttttttcgttcgcggttttaattcgggatttaaatgtacgagttcggtgaatgtttcggtaggagggcgagggtttagaggtagtttgtttagtaaaaacgatagttgtgttttggtgggttttgggttattttaggtagaagttagagaagttcgagaatttcggcgggttggtaaagtttgtcgagaagggtttttttggatatttttattacgggttttaggttcgaatttttttttttatttggttttggagttttagatatagataagtttcgggcgcgtcggcgggcgtatgtgcgtgtgtgtttatagcggggtggtcgtcggagttttttaagaattttagttttttcgttttagttgttcgttagttgtgagcgttcgtcgggttcggaggttattcgtaaatagttgggtcggtagttgggagtttgggaggtttttgtttagtttcggggtttcgagaaaggagaagggggagcggagtggttgtttggttgtggttttttttaatttcgtttgcgaagttttcgttgggagttcggagttttagtttttttcggtagtttcggttttcgcgttcgtcgcgtttagcggtcggcgtttcgtttcgggtttcggggaggaggcgcgtcggggtagtcggttaggatattgcgttgttggtttttagagttgcgggcgcgtttggtcggttttatttttcgggttgttggggcgggcgtcgttgtttcgatttcggacgcgcggaattttggagattcggtcgtttttcgttagggtcgcggtgttgttttaggtttcgggcgggcgttttttttcggttatcggtgtatttcgttgttcgtttgcgggaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttgcgaaaggttcgagagaggtcgtaggttaggattggatcgtcgggcgtcgtcggatggtgttgttagggtaatcggatggtacgcgaagtcgttcgaggtttcgattcggttacgggggcgtttagtggattcggagagttattttggggagggggcggtttcgaagaaggattgggtgggggcgtatggagcgggggttgcgcgaaaagttttttggggcggagttgagttacgcgggtcgcgtaggagcgtttgttcgagggtcgtttacgagggatttttttgttcggttgcgcgggtttttgcgttgatgaagttatcgcgtttcgggtcggagtttcggcgtttttgtttcgaatttagcgaagttcggttttatgtttttaattatttaacggttttttatcgtttagcg

SEQ ID NO: 7940 - DNA, 572 bp, synthetic construct
  misc_feature 1..572: note = Description of Artificial Sequence: Synthetic polynucleotide
  source 1..572: mol_type = other DNA
cgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcggaagcgggggttgttgcggtttttgttgtcgttttttttgttgtcggtcggcgcgtttcgggaatcggcgtttaggtagttagggtttggagagcgcgagcgttttcggaggcgcgtggttagggaggatttcgattttttgggcg

SEQ ID NO: 7941 - DNA, 989 bp, synthetic construct
  misc_feature 1..989: note = Description of Artificial Sequence: Synthetic polynucleotide
  source 1..989: mol_type = other DNA
cgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgttaacgtcgtcgtcgttattgagttttcggcgtattttagtttcgggcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcggcgggcgggcggtttttggcgtttatatattcgcgcgcgtatatatatattacg

SEQ ID NO: 7942 - DNA, 2400 bp, synthetic construct
  misc_feature 1..2400: note = Description of Artificial Sequence: Synthetic polynucleotide
  source 1..2400: mol_type = other DNA
cggtttgatcggggcgtttcgtcgtttttttagtgtattttatcgttttcggttgggggcgtagtattttggagagaggcgtttggtttcgcgtttgggttgggggcgttttattttgcgttttgggggttaggggcgtttgtcgggtcgttgtcgaggggttttgtttatttttgtttagttcggagtttaggcgagttagcgcggcgagtttttttttttttcgtttgggtcgttttgagttcgcgttcgttttagttgttgtagttgttgttgttggcggttgcggggagcgcggggcgcgcgtcgaagaggtttgggcggcgaggacggggacgaggaggagtcggaggcggtaaggaggaagagcgagcggaggtcgaggggtttagcggcgtggcgataggattagggggtttcgagaatatgggttagtaggcggttacgggtcggcggtcggacgcggtgaatttgtcgcggtcgggcgcgtattggcgcggcgagtcggagtcgagcgtagtcgggggaggagggttggcgtaggggcgttcgggcggagggggtcgattatttattattaacgagttattatttaataagcggagagcggttcgttagtcgcgcgggaggcgttcggggaagggggttatcggtcgagcgtagcgtatattcgtggcgtacggcgggcggcgcggcgtcgaggatattcgggatcgcgcgcggagtcggggcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggttttttttatggtgatttttttcgggggtttttttattattttgttttggcggacgtttaagtatttgtggatcgtgtgttgttattgcgggggtaagacgaaggtaacgcgcgtttcgggcgttcgttttttgcgttagttttatcgtttttcggcgttttttgtagtttattttttcgtttcgcgtcgcgtcgtgtttttttttattttcgtttgtttttttttcgtcgtttttttttttttcggttttttcggtgttttcggatcggggtagcgggcggcgcgtcgggggtgaggagttgtttttagttagtgcgtttcgggacgcggacgtttaattttgtttttttgtttattgtagggttgttggcggttgcggttggggtcggggtcggggatttataggttcgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataattttgtataagggaatttcgggggaggagtatggttcgagataatagggggatttcgaggggcgagagaagttggggagatttattttattattgggggtagtttacggggttgttatttttggaatgtgtcgaggtcgtatatttgatgtaattttttatttcgttttttaggtgttttagtggaatatattttaagtttttcggtttttgtttttttgtttttaggttatttattttgggttttcggaaatgttattagtagcgcggagttggagcgggagttcgtttgaggtcgcggttttacgcggagcgttttttttggcgttcgaggtggttagatgtcgtcggttttagttatttttggtgtagacgtttatcggtattgaggttggcgatattttcg

SEQ ID NO: 7943 - DNA, 1859 bp, synthetic construct
  misc_feature 1..1859: note = Description of Artificial Sequence: Synthetic polynucleotide
  source 1..1859: mol_type = other DNA
cgtacggaagtttttgtttagttgttagcgcgcgtcgttaggggttgtattgaagttgtggattcgggatggggaggaggttggcggttttcgaagtagggtttatagcgggggagggttagcgtcgtttggcggtggttgcgcgtggttagtgcggatttaggttcggttcggtcggcgttgtttgcgtgtggttcgggcggagcgagggtttttggagttcggttcgttttgggttttaggaagttcggcgtgtagcgttagaggtcgcgtgtgttgggggagggaggagtatagattgtgtttgggggtatttaggacgaatttatagaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttgtgtaatagaaattcgttcgcgtttagtagcgttcggggtcgtttgcgtcggattcgtagtttagtatttttcgcgttttggatttcgaggaggttaggtagagagcggttcgcgcggttttcgtttgcgtttttagtttcgcgttgggtagcgggatatgtttggtttcggcgtcgttatttcggttttcgtttgtttttgagtgcggagttcggagtttttttcgcggtgcgttgggttttagagggttagaggttattagggggtcggtatcggcgggagtttagtcgggcgcgttttcggtttttttttatttacgtttttcgcggtcgttcgggtttaggggcgtagcggggaggagatttcggttagggtcggggagcgcgagggcggggcggggttcggcggggaggggcgcgggcgggcggggatcggggcgggggtcgggttcgggggcggcggcggcgcgggcgggaggaggaggagtttttcgcgcggggtaggggcggagcgagcggtcgcgtcgcggagttaagtgagttcgtttcggagtcgcgtcgtcgtcggtttagtatttcgggcgttcgtcgttttcgtcgtcgtcgttagcgcggggatgtaggatgtaggcgggcgttaggttttagcggcggcggcggtagttgtagtagtagtagtttcggcggcggtagttttttttttggtcgatggacgtagagtcgtcgtcgtcgtcgttttgggtttggatggtgtcgggttcggtcgggttgtttcggtttagcgcgggggtcgtggttttttcggtgttgttcgtttcggtttcgtcgttcgcggtttcgttgtttttcggttttttcggttggtcggtttcgagcgagtcggtgttttcgttgttgtcgttgttttttgcgttagatttcgtcgtcgtcgtcgtcgcgtatttttttttcgcgttttacgggtaggtaacgtgttttcgtttcgtttcggttcgggtcgtcgttttttttgtttttgggcgcgttttgttcggttcggttttggttttcggttcgcgcgttttttttttcggcggttttcgtcgttttaaatttttaggacggagttcggtagtcgtgtttcggcgagaaagttcgtgtttggacgttcggtcgtttattttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcg

SEQ ID NO: 7944 - DNA, 902 bp, synthetic construct
  misc_feature 1..902: note = Description of Artificial Sequence: Synthetic polynucleotide
  source 1..902: mol_type = other DNA
cgggttcggttggtttttagtaggtttgtcggggtttttgtattttgtgttcgggatttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttcggggtttggggagggggttgggtaggggcggaagcgagttggagtcgtgtttgtcgcggcgttgcggagtggaatagatggttggggaggggagagggtgcgtggcggggaggaggaggggtgcgggggtcggaggatagggaacgaggaatttcgaagtttggagttttttaggagaagttttttttttcgtttttttttagaaaggggggtatatatgcgtttgtttttttttcggagagttttggtttttgttttgtggtagattttgtcgcgtaattttttgttttagggcgcgttttttatttttaaattttcgtcgcgggacggggtggcggggttaggatcgttaggagcggttcgggtcgcgagggttaatggggtcgtttttttaggggcgaggaggcggcgggaaacgggttcggggtggggaacgagttttgggatcg

SEQ ID NO: 7945 - DNA, 2044 bp, synthetic construct
  misc_feature 1..2044: note = Description of Artificial Sequence: Synthetic polynucleotide
  source 1..2044: mol_type = other DNA
cggcgttttcgttttgtttgtatttttttttattgtttttttacgtttggaatgttttcgtttttgtagtttgtagatagcggaaatcgcgggtgtaaatgtgtaggggtcgttgatatgatcggttgtagaagtttatttagggttattcgaataggttagcgttcgggattgtataagaggttaggcgatgttgtgggtttttaaatttgtatagttgcgatattttgcgacgtgttattttatttttagtggggtggggtgggggatttttttcgtagttcgttgaaagcgaggtaggaattattgtaatttttttgtttaggttgaggtcgttatcgtttcgcggatgtacgcgttgtaggggcgtttttcgtcgcgggtacggcgcgggaagggatggggtttggtgggagtgggtaggtggcgggagaggcgcgtgttcgtgtattagaggttttcgtgcgtgatataggtcgatgagtttttgcgggttgtatttacgcggagttatagatcgaaaaggttagtcggtggtcggtgtgttaatatatatagagagacgttcgttaggcgcgttgtaggttgggacgaggttaggagggtttaggttggaggagggttgaggagggttgcgggggcgggtttcggcgtagggcgttcggagcggagggggcgggttcgaggcggggcgggtcgcggcgttgacgggttgtcgtcgttgtattcgtttttagttcgcggtgtcgagcgtaggcggaggtatatggtttcgacgggaggcgcgcggcgagtattcggagttcggttttttgtttgagtacggtagtcgcgttttcgttcgcgcgttttcgttttttcggtcggtagttcgcggatatgatcgtgtagtttttttttgggttgggatttgtttgaagattttttttatggaagcgatgtttttttagtaggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagttagggtcggcgatgtttgttcgggagcggtagtcggcgttgaagaaggtaggtagcggggttgcggcgttggtgggttcggtttttttatttgttcgtcgaggcgcggttgttttatagtagttttcggggggtagatatggggagtattgttttttatattagggttttggatgatttcgggttttttaggtgggggttatagtttgaggggcgattgtggatgataacgttcgatattacggggatatgtaggttcggttgggtttagaatcgagtagggtgggggcgggtgggttgtggttgggggttttgagggttgaggtgggggattttttttttgtattggtttttggtttttgggattttggtcgggttggatagggattcgggtgtcggtgtgggcgtgggggtagcgcgtgttttttgttaaagttgggagagggatgtaggtgataatttgtagcgttttatttcgataaatacggtcgttgtgttgcgggaggatttcgattcgggttaggtttcgttggaacggttttttgagtaagtgtacgtgggtcgcgggttgtcggtttttgtcgtttcg

SEQ ID NO: 7946 - DNA, 1152 bp, synthetic construct
  misc_feature 1..1152: note = Description of Artificial Sequence: Synthetic polynucleotide
  source 1..1152: mol_type = other DNA
cggcgtatataagttgaggattgtcgaggcgttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtttcgcggttttcgttcgtcgagacgtggttttaagaagtggtgtcgtagtcggggtagaggcggaggaagtcgagtcgggtaagtcgggaaggttgcggagacgttttgtcggggtaggtgttgtagttttagttagcggtttttacggagggggcg

SEQ ID NO: 7947 - DNA, 872 bp, synthetic construct
  misc_feature 1..872: note = Description of Artificial Sequence: Synthetic polynucleotide
  source 1..872: mol_type = other DNA
cggtcgggtttagcgatgcggttgagttgtttattcgcgtttgttgaatcggttaattagcggcgttttcggatttagcgggagcgtttttatgtcgatcgcggtaggcgtgcgtttttcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcgttcggttttcggtgtatgtggtttgcgaggcggtagaggagatgtggggatttagggtcgtacgtcgtgttcgaggtttttacgagaggttttttttcgcgggtttttgcgtaattgcgtgaagtcggttcgggaaagttaagattgtggtttaggaagaggaaggaacgcgggcgatagagttggggtttgggacgttgagggggtcggtggtagtttttcg

SEQ ID NO: 7948 - DNA, 1070 bp, synthetic construct
  misc_feature 1..1070: note = Description of Artificial Sequence: Synthetic polynucleotide
  source 1..1070: mol_type = other DNA
cggcgttgagttttgtttagcgcgattcggatcgacggacgcgtagagattttgtcgggattcgttttttagtcggcgttcggggagtcgtcggtcggttttatttttcgttcgggagtcgggtagggcgagaaggtagcgcgagtggcggtggcgattttcgtcggggtttttgcgacgagcggtgattagtagcgttcgtagtcgcggtttcgttttttattcggacgtggttaagcggcggcggttacgacgttcggtttttcgggatcgttcggttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgcggttatcgttagcggtttgattcgttagaagcggtaggcgcgggagtagtattgggatcggtcgtttgttagtaggaggcggagtagttttagtaagaatcgcgggttttgtaacggtaatttggtggatattttttttaaagtgcgtattttcggttttaagaagcgtaggttgcggcgttaaggtttgtgggggttatggtcgggagatgcgtttcgggtcgtttttttttcgtttaaacggagtttttttaggttttttttttttttcggttttttcggtttatttcggtttcggttttttttttgagtattttgggtgtcgtcgcggggattttggagttcgttgtcgggtaatttgtagtcgtcgagaagtgtagtcgttagagatggtaagttggttgtttttcgtcggcggtttttgtttttcgcgtttttgtaggttgggttttgggaaatttgttttttttgagtttcggtttttcgggaggatagggattggtattggttttggaacgcggggtatttttttttgttatattcggggtcgagttatcgttcg

SEQ ID NO: 7949 - DNA, 395 bp, synthetic construct
  misc_feature 1..395: note = Description of Artificial Sequence: Synthetic polynucleotide
  source 1..395: mol_type = other DNA
cggcggtttttcgttttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcgatgtgggtcgtttttttttttttagcg

SEQ ID NO: 7950 - DNA, 265 bp, synthetic construct
  misc_feature 1..265: note = Description of Artificial Sequence: Synthetic polynucleotide
  source 1..265: mol_type = other DNA
cgtcggattcgcggaaaaggtcgttggaagttttttttgaagtcggtagtattaagaggattaatacgggcggtgggtatcgtttttattttttcgttggttttatttttcgtcgttcgtttttgtttttttttttcgtcgtttttttttttttttttttttttttttttttgcggttcggatatttttagttcgaattcggcggtttttgcgtttttgtttcgcgtttttttttttgtatttgtttcgcgtttaggtgttttcg

SEQ ID NO: 7951 - DNA, 1169 bp, synthetic construct
  misc_feature 1..1169: note = Description of Artificial Sequence: Synthetic polynucleotide
  source 1..1169: mol_type = other DNA
cgagttcgcgttaagagttacgtcgagacgcgtcgtcggtggggttacgcgagatgtaatcggagagtttaaaattagtttaggattaattttttagggattcgtttaatttttttcgtagaagagtttaagtggggtagtggtcgttataggttgaggatgattttcggacgcgttttaggcgcgatcgtattattcgtttttagtttaaagtttgagtgatttggtattatttttttaattgttttttatttttttcgtatttttgttgtgtttatcgtttttacgtatttgagagtttaaattatgttaagacgatttggagaaacgttcgatttgttttttaagttacgtaaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttattttttttttttatggttttattttcgttgttagtatttcgattttagtttgtaattttgattttgggtttgattataaatgacgaaagatcgcggtagtttttaaagtgcgggagcgagtttcgtattggttagcgcggcggagggatttttttaggaggttttaagtttttaagtttgtggagagatttggtaatagttggtaaggtttgttttagttattttcgttggttttttgtttttgtatttagcgtttgagggcgttattcgttttttttttgcgttttacgtaagcggtttaaggaatttattcgattcggatttcgtttcgtatgttttttaagttttcgttattttcgtaggcgttttagaaaggcgtgatggttttagtttagtgttcgttagttcg

SEQ ID NO: 7952 - DNA, 1743 bp, synthetic construct
  misc_feature 1..1743: note = Description of Artificial Sequence: Synthetic polynucleotide
  source 1..1743: mol_type = other DNA
cgttttcgcggttgttttttttttagggtcgtcggtggtttaggatttggttatcggggaggggcgtggttttgtcgaagtcgatgagttatacgtcggcgcgatggtagtgatcgtgtataaagaggagcgagttgtcgattatttgcgagtttcgtatcgttaggtcgcggttttgtttagagacgtttttgtcgggttttcgttttagttttcgcggttcgggtattcgggtagtcgtcgtttatttcgtgttttttgaagaattcggatatttttagggtgtttcggatttgttgtaggcggtttagatatcgtttttgtagagggtggggtgggagaggagggtaaattaattaaacgttaaatgagtttttgttaacgatgaggagtcgggatttacgttgtgtttggtaaatgtcgttaggaggaggatttagggtttcgtttagcgtggtttagaagggaaggagcgtagagtagttgcgagttagcgcggtgagggttatggtggggatatagtcgagggtattgggttagatgataggggtagttttcggttttaggttttttaatattttagggtttgggatttcgtttttattagtatttttttatttttttgtataaattttttaaagacgcgaagtatttgttttcggtttcgcgtagttttgaagtcggtgttgtaggagtcgttcgttttttggatgtgggataggagtgttaggggtttcgggttcgttagtggggaagaggatagcgtagagtagcggtattttttagttgtaggggacggcgaggcggtgggagagggcggaggggtaggcggggcgggagcgggggatcgggaaagatagcgcgtagtggggttgcggcggtgttagcgaagcgcgtttgttttattttgatgttttcgatgcggaagtcgagggtggtgttggagttgatgttttttcgttattgtatgtagcgcggtttggtgacggcgcgttgcgcgtgtttttttttcgtgggagttttaggatttatcgttagtatttttttgtatatgttttttcgtagtttgggtcgtttacgggttttggttagttttttttttaggtaagttttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattagtgtgttttgttagttgtatttaggcgtagcgttttttgaaagggtttatgatcggtagattgattatggttcggattttttgttagtggtttttttgaaagcgatagggttaaggtttgataatcggcgtttcggtaatgtataagttttttttttattgaaatagggtttcgttacgttttcgatttatcg

SEQ ID NO: 7953 - DNA, 2405 bp, synthetic construct
  misc_feature 1..2405: note = Description of Artificial Sequence: Synthetic polynucleotide
  source 1..2405: mol_type = other DNA
cgggggaggggtatacgtagttttcgtgcggaaagatggtgttttttttttatagggttgcgcgggtatttattttcgttgtaaagcgttcgggttaggcgcggtttgtttcgggtcggggcgagttcgttgttttttgcggtagatagcgatgcgcgtttttcgttttagttttcggttcgttcggcggttcgcgcgttttttcggtgtagtatgcgggcgttgtgacgttttcggataaatgtcgtgtaattgtgtaggcgaatgagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatttaatgtgattcggttgattatgtaaagattaggattggacgtttttgtagttttatttcgttatttatttttttttttttatttcgtattagaaataaagtggggggggggggcgagtttttggaggagaaaatgataattggtatttaattttaggtttatagtgcgtcgcggtggggcgtaaagacgtaaattttcgggatggcgagttttcggggttttattgggttaaacgaaaattgatttgatttgttttttaatattcgagggagagaaggggagatgaggggagggagggtagggtttgagtgtgtgcgtgtgcgtgtgcgtgtgtgtgtgtttggggagggggaggaggtattaagttgtagtttgcgcgcggttttgcgtttcggcggggttgcgtgcgtgtgtttttgttcgcgttgttgaaacgggtttttcgagggatcggcgttatatgatttcgtttgtttttcgttagcgcgtagatcgttagttttttagtttgttcggtatcggaggagggtcgggcggtatttttcgggtattggggttttgcggagcggagaagaggttttagcggggaatggtatatttggatttaagaagtcgcggttcggcgttagattttggagtgtagatatttggggggaggggagagttagagggagcgagcgagcgagcgttagagagaggtagcgcgtagcgcgtacggacggggggttgttgcgcggagaagatgtaagcgcgtggggtttcgttggtttttgagtattatgtagaaggggattcggttgaatgatggttacgtcgcgtttttgggattgttggcgcgtaaggacggtacgcgtaaaggttatttgagtaagcggagttcggataatataaaatggtaaattaagtggttcgcgttgttgtagaatttgtttttttatttcgagagcgattcgagttcgcggttttcggggttttatttgttggagggttgcgtttgcgatcgcgcgtttttttttaagtcggcgttgtcggttaaggagtcgttggagaaataggtgaggcgagcgtcgcgttttgatttttttgcgtttcggtcgcggttttgggggtttagggttttcggttggttgatggcgtttgaattttggtttttttatttttggcgttttaggcgttttttgtatttttagcgagaggggaggtttgtttttagttaggcgagtgattgcggcgggtagagggggtagggattgagggcggggagtagatgtgggttgcggttgtttttcgtcggacgagtttcgtgggaggcgggtatagaggggtcgatatttggagatgtagaggaagatggggttttaaggattagagacgatgagtttggatatacgtttagttaaaaatggtgtttttaatttttatttttatcgtttagttttaatagtttcgatcgtttgttttatatcgggaacgtgtaatttttcgcgtttaggtatgggaagggtaagacggaggcgttcgagcgttgttagtttttgtttcgtcgtagttgagggcggagagcggtttgcgttagtttttcggagttgggttggggttatggggttatacgggtcggttcggtattatcgagcggtggtgggtttttagttggcggtcgtcggagtaataagtttaaagatttttaaggatcgttttgatgcgtcggggttagggttagggttgttgcggaggtagcgggacgaagtgggcgttttttttttttttcgttttttgcgtcgtcgtcgtcgtcgtagtcgcggttatagcgttgcg

SEQ ID NO: 7954 - DNA, 1920 bp, synthetic construct
  misc_feature 1..1920: note = Description of Artificial Sequence: Synthetic polynucleotide
  source 1..1920: mol_type = other DNA
cgggcgttgttttttgcggtttttttcgtcgaggtttgtgcgtggcggggtttttaggagcggtagttcgtgcggtttgggggcggtttttttttcgtatcgtagcggggcgtgtaaagcgtttgcggttgtagtgtgggcgtttattttacgtgttcggcggcgtgcgaggagtagtaatattttttgtgggcgatgaaggtggataggttgttgaatttgatgttgtaaagacggtagtatcggtggttgtcgttgggtagcggcgtcggcgtgtttttgttgggagtttggacgtttttgttcgagtaggaggggggcgtcggcgggggcggtacggtttcgggcgcggcggtcggggacgggggcgggtcgggcggcggtttttggggtttcgggtcgaggtcgtttcgggggttacgggattcgggttgcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtcgtttttcgcgtcgtttacggagttattcgggttttggttgttttcgttgtttcggtcgttcgcgtcgttttcgggcgtggtcgcgtttttagtttttttttcgcgcgtttcggggttcggggacgagcgcggcgcgtcgggttcggcgggttggtcggggggcgcgcgggtcgggtcggggggcgttttgggtttgcgcgcggtaggcgcgttttcgggcgtacggcggtttgaatagtagaggcgtttgtgtacgtagtagttgttgacgttgttgaaggtgatttcgtattcgaagtacgtagcgtttttgggggtttcggggaagagttcggtttgcgcgtcgtcggcgttcgcgttcgcgttttgttgtagtcggttgtgtattagttcggatattttggttaggattttcgaggcggggggcgtcgcgtcgggttcgaatacgtattgcggaaggaatagggtttcggttaggtttagttcgtcgggtatcgggttggagttcggcgtggggttggatagttcggttttgattttggtcggggcggggttgcgcggcgacggcgttcgcgacggggtttggggtttaggtttttcggggtttaggatgggggtcgttttcggtttttttatcgtttttattttgatgtttttgggggtcgtcgggggttcgttgttgtttttattttgggttagaggtttcgttttggttttttcgttggtggtttcggttagggtttttttgtttagttttggcgatggggtgggcgttaggtttaggttcgcg

SEQ ID NO: 7955 - DNA, 1403 bp, synthetic construct
  misc_feature 1..1403: note = Description of Artificial Sequence: Synthetic polynucleotide
  source 1..1403: mol_type = other DNA
cgttcgttttttttaggttcggtgggattagattcgaagttaattttcgttaggcgttaggtgtagattttaggttaggttagagtagtttttgggttttcggatcgggatgttcgttttgtttttttttttggtttcgttcggtttgttatagggggaggtttcggtttcgtatttcgggtagcgaatttcgtcggtcgaggttagtttcgtgcgggggtttttcgcgggatcgatcgttaagcggtattgttcgtttcgggcgttcgttcggttttagacgtaggttttgcggtcgtttcgtgataagtatattgacgggttattgttttttgacgagtgttaaaaagttcgtttgttttgaacgttaatttttaagtgatttttacgaggttttttttttcggttttttcgttgttgtttcgttcgtattcggtttttagtaggtgtttaagaaacgtttagtaaacggtagcgtaggcgagtttgttttgcgcgttggcgcgttttattgtttacggatggcgggcgattttacgggattttcggttcgtaggattttcgttttcgaggttgtttttgggtcgggaggggttattttagaggggcgtttattttcgacggcgggggtcggggcgtcgcgggtaggggagggcgtagtttttaagtagttttagtttggtttagatttcgcgtttagcgagtcggtcggttaggtttatattttttatttgtcgttcgttttaggggaagggttttttcgacgacgttcgagtttttttttttttcggagggtcggaggtcggcgtttattggtcggttttgggcgacgtttcgttttttcgacgttacgggttaatgagcgcgcgttgttagtttattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcggagggtttttttttcgcggatttcgagttcgtttcgcgcggtttcgcgttttttgtttttttgtaaagtaatttttagggtcggttcggggcgtttttttttcgtagttcgggcggtcggggtttttgagttcggcggggtcgtattaggggtgggtgggtcggggtttcgggaggggaagcgcgagcgcgggagcgaggaagaaaggcggcggttttcggggatttcgcg

SEQ ID NO: 7956 - DNA, 1088 bp, synthetic construct
  misc_feature 1..1088: note = Description of Artificial Sequence: Synthetic polynucleotide
  source 1..1088: mol_type = other DNA
cgttgaggggtcgtatttattcgcgtaggtattagtaggtagttttggcgttcgcgggaggcggtcgggggcgggggtttttcggtgtttatcgtcgtttttgcggttgggttcgcgtttcgggtcggtcgagtttaacgttaggatttcgttcgagttttttagggtttcgttaggcgtcgcgttcgcgttcgcgtttttttgtcggtttcggttcgggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggttggaggaggggagcgcgcgtttttattcgggttgggtcgtcgaggttcgcggcgtatcgtggcggcggtgggcggaggggggcggggggtatttttttttttttgtggcgtaggtgggcgcgttttggatcggtttgacgattttttttcgtcgttttatttttttggttaaaggtttttagtttttaattagggatatttttagtttatagtttcgaagttatgggtttttttcggttttttgaagtcgttatatttgtgttagtcggtcgcgtttttagattttttttcgcggagtttttttagtatttggagacgtagcgtagggtttcgaggacggtttggttcggagaaaagatatcgaagttttaattttttttaatttcgttttttttttttttttatttttttttttcgtttttaaagttcgggggttttatttttttttcggttcgcggagtttttcgaattttgcggggattcggcgttcggcggtgtttttttggggcgtacggggttggggcgggagcgaggagattaggtggggaggggattttagattttagacgttaggggagacggcgtttttcg

SEQ ID NO: 7957 - DNA, 1812 bp, synthetic construct
  misc_feature 1..1812: note = Description of Artificial Sequence: Synthetic polynucleotide
  source 1..1812: mol_type = other DNA
cggggtcgttgcgtttttttgattattgacggttaggacggttttagtttcgttttatttgtaagttttattttaggttcgagttttcgagggtagggatagtttttcgggtttcgaggtttgattagagtttgaaagtttttgtcgggggttgtttcgatttagcgaggcgttaggttgttcggcgcggttgggggcgtttagcgtcgggattttagttttgtttcggtcgttcgttggtttagtgcgtacgtttcggtagtttagtttttttttttacggcggtaggagagttttcggtatttgtttggggcgggggcgggggcggggcggggcgggcgtcgcgtttttttgtttgattggtaggaagatagattaatcggaggggtttttcggggggaggggcggtgtcgtgtttgagtcgggcgcgggcgatcgagggagttgtagttattcgcgtgcggtacgcgtcggtcgtttgttcggatcgcggttattagtgtcgcggtttttcgattttcgtttcgtcgagtcgcgcgcgcgattgttattttttttaattgttttttacgattttttttgtgtatgtatttattttttgtttcgttttgttttttttaaggcggtggcggcggcgatagcggcgtaagttcgtagcggggagggggcggtcggaggatgcggcgcggggttgcgttcgttacgttcgttgttgttgttcggttcgggtttgagcgtcgagtaggtgggtataggtgcgtcggggggcgggaggcgagcgttggttagagggaattcgtggattcggcgatcgaggggcggatttggcggtaagggacgcggcgatcggtgtcgtttcgttttatcgtttatttttttttttttcggttatcgcgttttttttgggttttttttttattttcgtattttattttagtggttttttatttttttatatttattttttatttttttttagatttttttgtaaaattttttagtcgttgcgtcgttttttttaatattttttttcggtttcgtttttagtttttagtttttttttacgttatttttatttttattttttttcggatttcgtttttaagttaaggagcgggagggggatttattcggtgtttgtcggagtggcgcggggggtgtggtcggttcgtttttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttgtcgggtcggcgcgttttgggcgtattggttttcggagatggcgcgtaaggattgattttcgtggtgttagatattttgtcgggcgttttgcgtcggggttagcggtttcgttggtttgcgttagtgcgttgcggtttcgttttttagtttttcggtttttcgttttattttttttgttgtgggtttttgagtattcggtttgggtagtttagatagaggtcgtttacgaggttggcgttttttttcgttttagaagtatttcgtttttatatattttagttcgtcggttttttgaaggttgggttagtttcggtttttcgttagtttttgttcggttttttgagttttagcgatattgtatttaatcgttagttttttttcgtcgttcg

SEQ ID NO: 7958 - DNA, 5819 bp, synthetic construct
  misc_feature 1..5819: note = Description of Artificial Sequence: Synthetic polynucleotide
  source 1..5819: mol_type = other DNA
cggagggaaatcgggtcgacgataagggtggttattttcgggtttttcgcgttcggtttaagcgtttttgggtggggtagtttaaacggggagaggggtttcgtgggtcgagggttcgaggtcgtagcgagtttagcgtttggttaaatttggttcgcgcgtttttttattgttttgttagggttgtgtgatttttcggagttttacgttttcgtttaaatagtttttagcgtttttgttggtattcggggcgtttttattttagtttttgtattcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgtcgggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggggcgtagcgggagagaggagggagagggtcgcgggtttttatggagggcggttgggaatttagagatttatcgtttgtttttgtggtttttttttttattattggtttcgagggggtttcggggttgtgaggaaatgatttgttaatttcgaggttcgttagtgcggcgttagcgatcgtgaggttttttaaatttatattttagtcgggtgtttcgagcggtgggcgggtataggcgtttttaaggtttttggttttaggttttagaaagaaaggtttttgtttggtgtttcgggttttcggtttcgtttttggttggagttaatttttttgggttggaaggagtttttttcggacgagtttttggtgcggggaattggtggtttttagggtaatttttgaagtattagggttaggttggtcgaagaagggttagggttcggtttgttttttcggaggttttttatggtttcgacggttaacggtaatttcgttaaaataggcgattcgtttgcgtttcgcgttaggggttgattattttttgttttttttgcggtttgtttcggttttggtttttcgtttttcggagcgttttaggttagcgggagtattttattttttcgaagttgagtcggtgttgtgtatttcgggagtcggttgatttttggtttatttgtttacgggtgtatttagtatcgggggtttttagagggaggaaggtttagtatttcgagtttatgtagacgcgtttagttgatatttgagatgttgagcgttttatcgttggtgaaagggatattgggtgttttcgttttaggtttggttttttggtgaaggtatttggaaaatattttagtattatttatgggagaagggtggtttagtgagaattttcggtttgggtaggcgggtttaggttaggttatagggttttagtgagatgtttcggtggtcgttaatttataggttggattgattttgtgttttggaatgagtagtggggtttgggtgaggtcgggcgggttaggaggttttttgggtagttgcgagtttttcgaggtagggtgattgtgattgggttcggattttaggcgttggggtttgttggcgggtaggaagtggagcgtgtgtgtgcggcggtttgggaaagtcgatttagaggttaggtttttgggttacggagaaagggtcgttcgttggtggggattggagcgtcgatttatgtatataggttggaaaggtaaaagagaataggagaaggtggcggtggtggttaaaggaagttttcgaaagggtttttacgtattggttgttttgggaagtggaggttgttttttttagattttgtttagaagatgaatggtcgtttgttttggggtttcggttttagttaagtttcgtcgggtttggaaggaaggaaatgtattagttttaggtttgggtgggttgagttgttgtattagagtttagaggtgtagggtataggtggttgggtttttgggttttggtttttttttttagtcggcggagtgtttatagtcgtcgaggttaggttttcgagtataggtgaggaaaggataagttatagttgaatgttttttttttgggggtttttattttttattttagtttttggttcggttgggtttatattttttttttagtcgggttttattatttggagagagcgagtagtttgtaaataataaataatgggaagtagaaggatgttcgggaaaaattagaaaattgtaaggagtggggaggagggagggtgggagaggggaggaaggagggtgggggaggggaggagtaggaggagagggaaaggggttgagagatttatttttagcgagaaatttcggtggttagttttttattatttataggaaggtgatattagcgatttaggtgagaaagaaagaaacgcggtttgtcgcgaaattaatatagaatttagaaataattattaatgttatttgattcgtgttttttatatatttttcgcggttatcgacgttaaattgtttgaataatttgtatggagcggttatttattattttcgatggtttttttttgtaagtagttcggacgtggttcgtttcggtttaacgcgatcggagaattcgtatttttatttgtaaattaaagtaattacgtagtagatattatatgatgtgtattgtggtttttagatagttattaattatttttaatcgagttgttaaaagagtaggtagatttcgtttttgggaggtaggtttgtagttggggagagggcgaggacgttattattaattagagggtgattttggggcgatttataggtttgaatttaggaatttttttgagtaagtttgtataacgttgttttgtacggttttttttttaatttattacgggaggtcggtttagggggcgagggtaatcggggcgagtttcggtttcggagggcgatggcgtagaaggcggggaacgggttcgggatggttcgggcgtttttttgtcgtttttttgtcgtttgtttattggttttcgttttgaatttgggtaaggttttagggagggtattggtcgagggagttttggggtgggcgttcggttttttttttcgattgtttcgtgcgttttagatagaaagttgggtaaaatggataggggagggcgttttcgttaggtatttaacgttttttttttcgtagttagttttgcggggcgtcgggagggacgagtttagcgggaggggtcggggtttgggttgaggaatttgttttttcgagcgcgtagggtcgttcggtagttttcggtttagtcgcgaggggtagggggaagtcggcggagtacggtcggcggaaaggggatcggggaggaaagtcggggaggcgaggtgggggcggtgggttgagcgggaatttaaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaaggtcgaggcgttaagaaaattcgacgggtcgggttcgggttttttgatgtttgaattataaggtttaggttgtgttttaggggagttttaggattttaaggaatttttggggaaggaggtttggcgcgtaaatggcgttagaggttttggaaatttttcggggaagggtgtaggtgttcggttgggttttacgtggcggaggaggttagacgcgtataagttagtggaaaggggcgagtattttggtgtggacggcgggaggttcgggggtattcggggtacgttttcgtgggcggcgcgcgggattggtaaggtttagggttttagtttttagttcggtttttcgttagttttcgcggtttttttttgtagtttttgatggttattaattttttgagtacgtgttgcgagttcggaggtcgtacgttggcggatttcgggttcgtcgtttcggtttaggcgtcggtttattgttcggtttacgagagtcggttgttggttatcgcgcgttacgagtttaattcggtcgcggcgttgggcgtttatgggggtttttatggcggatcgtagggttatggtaattacgtgatttacggttcggaggcgttcgttttttattcg

SEQ ID NO: 7959 - DNA, 2001 bp, synthetic construct
  misc_feature 1..2001: note = Description of Artificial Sequence: Synthetic polynucleotide
  source 1..2001: mol_type = other DNA
cgttttcgtttcgtgttaagcgggtttaaggttcgaggttttttcgtttataatttcggtgttcggaatacgttttcgaggggtcgtgttgtcggggttattattcgcgattggatttcgcgtcgtgttgtttttttcgggtttcgagttcgtttagcggtttgtacggtttaggtttgagttgcgggttttttttgtggggcgcgttgggagtgagttttatttttaaagtttattttaacgttttaggtatgattacgacggtagaggtcggtcgtttattttcgttttttttttcggttagagcgtttttgtcgggagtcgacgatcgcggtttgatttcgggttttatcgtttattttcggttttcgttttttttttacggttaggggttatatatagcggacgtttcgtttttagtcgtttttttgatttttgaatttgggagttagcgtgttcgttggggtatgtattgttacgggtattgggatttttttgttgttgcggggaggagtttcgacggtaggtgggaagatttagtttgttcgcgttttcgttttttagtttttgcgattcgggtcgaggtttttagtttttgggttttttcgtttcgggtttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggggttaggatttcggttggagtttggttttttatggcgaggaagtcgattgggaagggttttttggcgaggtttttttgttgtgttattttttttcggtagcgtcgggcgcggggaacgcggggttgtatcggggcgggggagggggttttattcggcggtttcgaggattcgattttggggtcgggttcggcgggtaggtttgtttaggagttagttggtaaatgtagcggattgttacgttattttattgttattatttattgtaaattattgttttaagttttcgggagaattcgtcgaatttgagaggggggagggggatgggggtgggcgcgtaggaagttttataggtattagggattggtgatttaggatattagtttttcgagttttttttgggaatttttagtatttagattgtttttgattgtagggattacggtggggcgttttttttttaagtttttttcgggatatcgggcgcgtttttttcgtttttgggttagcgtatatttttttacgcgatgattagtatagttattgtgaggttcggttttggtcgcgtttgttttttgcgagtgataataataaaaattattggaattgtaaggaagtttttggtttcggttttttagtcgttgttgttttgggtgtttcggttgcggaaagatttcgtagtcgggttcgatttacgagtggaatatcgggttgcggatttagtcgggtttataggattggcgcggggtttcggggataggtttcgtagggtttttttgcgtatcgtttgggacgtcgattttgttaatttggaggataatttttgtttttattttattagtagatttttaaaaatttagtcgtcgttgaaacgtgttttttattcgttcggtttgtttgtagtttttgacgagtttcggtatagttttcg

SEQ ID NO: 7960 - DNA, 1265 bp, synthetic construct
  misc_feature 1..1265: note = Description of Artificial Sequence: Synthetic polynucleotide
  source 1..1265: mol_type = other DNA
cggttcgggcgttaggtagaattttagttcgatgttgtcgtcgtcgggggagagggaattcgttgggagggatagtcgggggttggggaaggaagagcgggtgttgggagggtttaatattggcggagttttaggtggcgacgcgggcggcgagagttgtttcgaggcgggggtttcgggtaggtcgttttttacgtagtatacggagtagaagatttgttttttggcgagggacgggcgtcgttgatttagtacgtttaggattagttcgtcggcggtttttacgcgggttttgggttttagtttttcgtcggggggcgttttttgttgtttatttttttttttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgttgtttatttagtcgtcgggatttttattcggcgttcgcgggtagcgggggtagtggttcggttcgattcgcggtttcgtttttgttttcgggtttttttttttgggttgggacgttttaagtttttttcggggagttcgtgtttcgaggttgcggcgcgtggggagtttggttcggttcgtcgttttttttcgtattttggcgcggcggggtatcgtttcgggggcgtcgagggtcgttcgttttgggttcgggcgcgttcgttttatatgtagttcggggcggcgtcgtagttttagcgagttttaggcgggatagaggggtttgggaggagacggtcgttagtttcgcgttattatcggtttcggttgtcggacgcgcggttcgagggcggtggttaaagggtcgaggggtttgtggcgtcgtcgcggcgcgtattaggaggtgtagtcggagcgttggttagtcgtagggtttttgggggagaggtcggagcgggcgattttttttttttcgcgttttatttatagtttttttcgtcg

SEQ ID NO: 7961 - DNA, 1360 bp, synthetic construct
  misc_feature 1..1360: note = Description of Artificial Sequence: Synthetic polynucleotide
  source 1..1360: mol_type = other DNA
cgtcgaggatgtggttttcgtttttcgtagtcgtcgtaggagtttttgtttttaaagcggtaggtaggggttttagcgggtttattttaatttgggaaggtcggtgcgtttttttatagatttcgtagggcgttttttttggggattattgaagttttggtatttttaattttagttttttcgcgttacgggaaacgaagacgatatttttttgaataatttcggatgtgttattatagaggggtattttatattggtttttattttaatttttatttagtatattgtttgtttattttttaaatttcgtgcggattgcggtatttagtttcgggggattttttagttttgttttttcgattcgcgtaggtgcgttcgtttatttaagggtagggaggtatgttttttcgggttttttcggtcgtatggtttgtttgtttttttggtttttttttttcgtattaggaggggcgtgagatagttaggtcgatttttatttcggtagtttgcggcgatcggtcgtttcgagcgtagcgttagatatttgggttggggggtgttagtttgacgcgtaggaagggcgtagcggcgggagggggttttattttagatttgggaggtttgtttggcgtcggttttcgttcgtttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgagtcgggttttcgcgtttgtgtggtcggttggcggtcggggttcgtgtgtttttgcgcggcggcgtgtgcgtgtgcgtacgcggggattacgttcgttcggagtcgtcgtcgtcgtcgttattttttgttcggggtcgagcgtagcgttttttttgttcgtttcgcgcggcgcggtagtttagtttggtttcgttttgcgggagaggcgtcgttttcgtcgcgaagttaggttgggcgttggagggaggcgatcgattatcgtttttttttgtttattttataggttggggagggggtgttgtaggttaatgagcgttcgggggcggggttagatcgagggcggtgcggtggggggcgcggtggggggcgtcgggttgtttaattcgattttattcgtagtatagattggagtaggagttgcggcgggaaattttagcggcgggggtcgggggcg

SEQ ID NO: 7962 - DNA, 362 bp, synthetic construct
  misc_feature 1..362: note = Description of Artificial Sequence: Synthetic polynucleotide
  source 1..362: mol_type = other DNA
cgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttttttggagttcgttgagtacgtatacgcgtaggcgaagttgtttttttaggtttttggcgttttcggcgcggttgttttcgcggttgttttcgtttatggtcggcggcggtgcgtagcgcggcgttgttcgtcgtgttgagcg

SEQ ID NO: 7963 - DNA, 56 bp, Homo sapiens; identical to SEQ ID NO: 112
  source 1..56: mol_type = unassigned DNA

SEQ ID NO: 7964 - DNA, 431 bp, Homo sapiens; identical to SEQ ID NO: 374
  source 1..431: mol_type = unassigned DNA

SEQ ID NO: 7965 - DNA, 84 bp, Homo sapiens; identical to SEQ ID NO: 396
  source 1..84: mol_type = unassigned DNA

SEQ ID NO: 7966 - DNA, 50 bp, Homo sapiens; identical to SEQ ID NO: 418
  source 1..50: mol_type = unassigned DNA

SEQ ID NO: 7967 - DNA, 166 bp, Homo sapiens; identical to SEQ ID NO: 2
  source 1..166: mol_type = unassigned DNA

SEQ ID NO: 7968 - DNA, 125 bp, Homo sapiens; identical to SEQ ID NO: 13
  source 1..125: mol_type = unassigned DNA

SEQ ID NO: 7969 - DNA, 396 bp, Homo sapiens; identical to SEQ ID NO: 35
  source 1..396: mol_type = unassigned DNA

SEQ ID NO: 7970 - DNA, 173 bp, Homo sapiens; identical to SEQ ID NO: 46
  source 1..173: mol_type = unassigned DNA

SEQ ID NO: 7971 - DNA, 97 bp, Homo sapiens; identical to SEQ ID NO: 57
  source 1..97: mol_type = unassigned DNA

SEQ ID NO: 7972 - DNA, 208 bp, Homo sapiens; identical to SEQ ID NO: 68
  source 1..208: mol_type = unassigned DNA

SEQ ID NO: 7973 - DNA, 647 bp, Homo sapiens; identical to SEQ ID NO: 79
  source 1..647: mol_type = unassigned DNA

SEQ ID NO: 7974 - DNA, 282 bp, Homo sapiens; identical to SEQ ID NO: 90
  source 1..282: mol_type = unassigned DNA

SEQ ID NO: 7975 - DNA, 141 bp, Homo sapiens; identical to SEQ ID NO: 135
  source 1..141: mol_type = unassigned DNA

SEQ ID NO: 7976 - DNA, 25 bp, Homo sapiens
  source 1..25: mol_type = unassigned DNA
cgtgcaccctgaggtctggttggcg

SEQ ID NO: 7977 - DNA, 56 bp, Homo sapiens; identical to SEQ ID NO: 540
  source 1..56: mol_type = unassigned DNA

SEQ ID NO: 7978 - DNA, 431 bp, Homo sapiens; identical to SEQ ID NO: 802
  source 1..431: mol_type = unassigned DNA

SEQ ID NO: 7979 - DNA, 84 bp, Homo sapiens; identical to SEQ ID NO: 824
  source 1..84: mol_type = unassigned DNA

SEQ ID NO: 7980 - DNA, 50 bp, Homo sapiens; identical to SEQ ID NO: 846
  source 1..50: mol_type = unassigned DNA

SEQ ID NO: 7981 - DNA, 166 bp, Homo sapiens; identical to SEQ ID NO: 430
  source 1..166: mol_type = unassigned DNA

SEQ ID NO: 7982 - DNA, 125 bp, Homo sapiens; identical to SEQ ID NO: 441
  source 1..125: mol_type = unassigned DNA

SEQ ID NO: 7983 - DNA, 396 bp, Homo sapiens; identical to SEQ ID NO: 463
  source 1..396: mol_type = unassigned DNA

SEQ ID NO: 7984 - DNA, 173 bp, Homo sapiens; identical to SEQ ID NO: 474
  source 1..173: mol_type = unassigned DNA

SEQ ID NO: 7985 - DNA, 97 bp, Homo sapiens; identical to SEQ ID NO: 485
  source 1..97: mol_type = unassigned DNA

SEQ ID NO: 7986 - DNA, 208 bp, Homo sapiens; identical to SEQ ID NO: 496
  source 1..208: mol_type = unassigned DNA

SEQ ID NO: 7987 - DNA, 647 bp, Homo sapiens; identical to SEQ ID NO: 507
  source 1..647: mol_type = unassigned DNA

SEQ ID NO: 7988 - DNA, 282 bp, Homo sapiens; identical to SEQ ID NO: 518
  source 1..282: mol_type = unassigned DNA

SEQ ID NO: 7989 - DNA, 141 bp, Homo sapiens; identical to SEQ ID NO: 563
  source 1..141: mol_type = unassigned DNA

SEQ ID NO: 7990 - DNA, 25 bp, Homo sapiens
  source 1..25: mol_type = unassigned DNA
cgccaaccagacctcagggtgcacg

SEQ ID NO: 7991 - DNA, 56 bp, synthetic construct; identical to SEQ ID NO: 968
  misc_feature 1..56: note = Description of Artificial Sequence: Synthetic oligonucleotide
  source 1..56: mol_type = other DNA

SEQ ID NO: 7992 - DNA, 431 bp, synthetic construct; identical to SEQ ID NO: 1230
  misc_feature 1..431: note = Description of Artificial Sequence: Synthetic polynucleotide
  source 1..431: mol_type = other DNA

SEQ ID NO: 7993 - DNA, 84 bp, synthetic construct; identical to SEQ ID NO: 1252
  misc_feature 1..84: note = Description of Artificial Sequence: Synthetic oligonucleotide
  source 1..84: mol_type = other DNA

SEQ ID NO: 7994 - DNA, 50 bp, synthetic construct; identical to SEQ ID NO: 1274
  misc_feature 1..50: note = Description of Artificial Sequence: Synthetic oligonucleotide
  source 1..50: mol_type = other DNA

SEQ ID NO: 7995 - DNA, 166 bp, synthetic construct; identical to SEQ ID NO: 858
  misc_feature 1..166: note = Description of Artificial Sequence: Synthetic polynucleotide
  source 1..166: mol_type = other DNA

SEQ ID NO: 7996 - DNA, 125 bp, synthetic construct; identical to SEQ ID NO: 869
  misc_feature 1..125: note = Description of Artificial Sequence: Synthetic polynucleotide
  source 1..125: mol_type = other DNA

SEQ ID NO: 7997 - DNA, 396 bp, synthetic construct; identical to SEQ ID NO: 891
  misc_feature 1..396: note = Description of Artificial Sequence: Synthetic polynucleotide
  source 1..396: mol_type = other DNA

SEQ ID NO: 7998 - DNA, 173 bp, synthetic construct; identical to SEQ ID NO: 902
  misc_feature 1..173: note = Description of Artificial Sequence: Synthetic polynucleotide
  source 1..173: mol_type = other DNA

SEQ ID NO: 7999 - DNA, 97 bp, synthetic construct; identical to SEQ ID NO: 913
  misc_feature 1..97: note = Description of Artificial Sequence: Synthetic oligonucleotide
  source 1..97: mol_type = other DNA

SEQ ID NO: 8000 - DNA, 208 bp, synthetic construct; identical to SEQ ID NO: 924
  misc_feature 1..208: note = Description of Artificial Sequence: Synthetic polynucleotide
  source 1..208: mol_type = other DNA

SEQ ID NO: 8001 - DNA, 647 bp, synthetic construct; identical to SEQ ID NO: 935
  misc_feature 1..647: note = Description of Artificial Sequence: Synthetic polynucleotide
  source 1..647: mol_type = other DNA

SEQ ID NO: 8002 - DNA, 282 bp, synthetic construct; identical to SEQ ID NO: 946
  misc_feature 1..282: note = Description of Artificial Sequence: Synthetic polynucleotide
  source 1..282: mol_type = other DNA

SEQ ID NO: 8003 - DNA, 141 bp, synthetic construct; identical to SEQ ID NO: 991
  misc_feature 1..141: note = Description of Artificial Sequence: Synthetic polynucleotide
  source 1..141: mol_type = other DNA

SEQ ID NO: 8004 - DNA, 25 bp, synthetic construct
  misc_feature 1..25: note = Description of Artificial Sequence: Synthetic oligonucleotide
  source 1..25: mol_type = other DNA
ygtgtattttgaggtttggttggyg

SEQ ID NO: 8005 - DNA, 56 bp, synthetic construct; identical to SEQ ID NO: 1396
  misc_feature 1..56: note = Description of Artificial Sequence: Synthetic oligonucleotide
  source 1..56: mol_type = other DNA

SEQ ID NO: 8006 - DNA, 431 bp, synthetic construct; identical to SEQ ID NO: 1658
  misc_feature 1..431: note = Description of Artificial Sequence: Synthetic polynucleotide
  source 1..431: mol_type = other DNA

SEQ ID NO: 8007 - DNA, 84 bp, synthetic construct; identical to SEQ ID NO: 1680
  misc_feature 1..84: note = Description of Artificial Sequence: Synthetic oligonucleotide
  source 1..84: mol_type = other DNA

SEQ ID NO: 8008 - DNA, 50 bp, synthetic construct; identical to SEQ ID NO: 1702
  misc_feature 1..50: note = Description of Artificial Sequence: Synthetic oligonucleotide
  source 1..50: mol_type = other DNA

SEQ ID NO: 8009 - DNA, 166 bp, synthetic construct; identical to SEQ ID NO: 1286
  misc_feature 1..166: note = Description of Artificial Sequence: Synthetic polynucleotide
  source 1..166: mol_type = other DNA

SEQ ID NO: 8010 - DNA, 125 bp, synthetic construct; identical to SEQ ID NO: 1297
  misc_feature 1..125: note = Description of Artificial Sequence: Synthetic polynucleotide
  source 1..125: mol_type = other DNA

SEQ ID NO: 8011 - DNA, 396 bp, synthetic construct; identical to SEQ ID NO: 1319
  misc_feature 1..396: note = Description of Artificial Sequence: Synthetic polynucleotide
  source 1..396: mol_type = other DNA

SEQ ID NO: 8012 - DNA, 173 bp, synthetic construct; identical to SEQ ID NO: 1330
  misc_feature 1..173: note = Description of Artificial Sequence: Synthetic polynucleotide
  source 1..173: mol_type = other DNA

SEQ ID NO: 8013 - DNA, 97 bp, synthetic construct; identical to SEQ ID NO: 1341
  misc_feature 1..97: note = Description of Artificial Sequence: Synthetic oligonucleotide
  source 1..97: mol_type = other DNA

SEQ ID NO: 8014 - DNA, 208 bp, synthetic construct; identical to SEQ ID NO: 1352
  misc_feature 1..208: note = Description of Artificial Sequence: Synthetic polynucleotide
  source 1..208: mol_type = other DNA

SEQ ID NO: 8015 - DNA, 647 bp, synthetic construct; identical to SEQ ID NO: 1363
  misc_feature 1..647: note = Description of Artificial Sequence: Synthetic polynucleotide
  source 1..647: mol_type = other DNA

SEQ ID NO: 8016 - DNA, 282 bp, synthetic construct; identical to SEQ ID NO: 1374
  misc_feature 1..282: note = Description of Artificial Sequence: Synthetic polynucleotide
  source 1..282: mol_type = other DNA

SEQ ID NO: 8017 - DNA, 141 bp, synthetic construct; identical to SEQ ID NO: 1419
  misc_feature 1..141: note = Description of Artificial Sequence: Synthetic polynucleotide
  source 1..141: mol_type = other DNA

SEQ ID NO: 8018 - DNA, 25 bp, synthetic construct
  misc_feature 1..25: note = Description of Artificial Sequence: Synthetic oligonucleotide
  source 1..25: mol_type = other DNA
cgtgtattttgaggtttggttggcg

SEQ ID NO: 8019 - DNA, 56 bp, synthetic construct; identical to SEQ ID NO: 1824
  misc_feature 1..56: note = Description of Artificial Sequence: Synthetic oligonucleotide
  source 1..56: mol_type = other DNA

SEQ ID NO: 8020 - DNA, 431 bp, synthetic construct; identical to SEQ ID NO: 2086
  misc_feature 1..431: note = Description of Artificial Sequence: Synthetic polynucleotide
  source 1..431: mol_type = other DNA

SEQ ID NO: 8021 - DNA, 84 bp, synthetic construct; identical to SEQ ID NO: 2108
  misc_feature 1..84: note = Description of Artificial Sequence: Synthetic oligonucleotide
  source 1..84: mol_type = other DNA

SEQ ID NO: 8022 - DNA, 50 bp, synthetic construct; identical to SEQ ID NO: 2130
  misc_feature 1..50: note = Description of Artificial Sequence: Synthetic oligonucleotide
  source 1..50: mol_type = other DNA

SEQ ID NO: 8023 - DNA, 166 bp, synthetic construct; identical to SEQ ID NO: 1714
  misc_feature 1..166: note = Description of Artificial Sequence: Synthetic polynucleotide
  source 1..166: mol_type = other DNA

SEQ ID NO: 8024 - DNA, 125 bp, synthetic construct; identical to SEQ ID NO: 1725
  misc_feature 1..125: note = Description of Artificial Sequence: Synthetic polynucleotide
  source 1..125: mol_type = other DNA

SEQ ID NO: 8025 - DNA, 396 bp, synthetic construct; identical to SEQ ID NO: 1747
  misc_feature 1..396: note = Description of Artificial Sequence: Synthetic polynucleotide
  source 1..396: mol_type = other DNA

SEQ ID NO: 8026 - DNA, 173 bp, synthetic construct; identical to SEQ ID NO: 1758
  misc_feature 1..173: note = Description of Artificial Sequence: Synthetic polynucleotide
  source 1..173: mol_type = other DNA

SEQ ID NO: 8027 - DNA, 97 bp, synthetic construct; identical to SEQ ID NO: 1769
  misc_feature 1..97: note = Description of Artificial Sequence: Synthetic oligonucleotide
  source 1..97: mol_type = other DNA

SEQ ID NO: 8028 - DNA, 208 bp, synthetic construct; identical to SEQ ID NO: 1780
  misc_feature 1..208: note = Description of Artificial Sequence: Synthetic polynucleotide
  source 1..208: mol_type = other DNA

SEQ ID NO: 8029 - DNA, 647 bp, synthetic construct; identical to SEQ ID NO: 1791
  misc_feature 1..647: note = Description of Artificial Sequence: Synthetic polynucleotide
  source 1..647: mol_type = other DNA

SEQ ID NO: 8030 - DNA, 282 bp, synthetic construct; identical to SEQ ID NO: 1802
  misc_feature 1..282: note = Description of Artificial Sequence: Synthetic polynucleotide
  source 1..282: mol_type = other DNA

SEQ ID NO: 8031 - DNA, 141 bp, synthetic construct; identical to SEQ ID NO: 1847
  misc_feature 1..141: note = Description of Artificial Sequence: Synthetic polynucleotide
  source 1..141: mol_type = other DNA

SEQ ID NO: 8032 - DNA, 25 bp, synthetic construct
  misc_feature 1..25: note = Description of Artificial Sequence: Synthetic oligonucleotide
  source 1..25: mol_type = other DNA
ygttaattagattttagggtgtayg

SEQ ID NO: 8033 - DNA, 56 bp, synthetic construct; identical to SEQ ID NO: 2252
  misc_feature 1..56: note = Description of Artificial Sequence: Synthetic oligonucleotide
  source 1..56: mol_type = other DNA

SEQ ID NO: 8034 - DNA, 431 bp, synthetic construct; identical to SEQ ID NO: 2514
  misc_feature 1..431: note = Description of Artificial Sequence: Synthetic polynucleotide
  source 1..431: mol_type = other DNA

SEQ ID NO: 8035 - DNA, 84 bp, synthetic construct; identical to SEQ ID NO: 2536
  misc_feature 1..84: note = Description of Artificial Sequence: Synthetic oligonucleotide
  source 1..84: mol_type = other DNA

SEQ ID NO: 8036 - DNA, 50 bp, synthetic construct; identical to SEQ ID NO: 2558
  misc_feature 1..50: note = Description of Artificial Sequence: Synthetic oligonucleotide
  source 1..50: mol_type = other DNA

SEQ ID NO: 8037 - DNA, 166 bp, synthetic construct; identical to SEQ ID NO: 2142
  misc_feature 1..166: note = Description of Artificial Sequence: Synthetic polynucleotide
  source 1..166: mol_type = other DNA

SEQ ID NO: 8038 - DNA, 125 bp, synthetic construct; identical to SEQ ID NO: 2153
  misc_feature 1..125: note = Description of Artificial Sequence: Synthetic polynucleotide
  source 1..125: mol_type = other DNA

SEQ ID NO: 8039 - DNA, 396 bp, synthetic construct; identical to SEQ ID NO: 2175
  misc_feature 1..396: note = Description of Artificial Sequence: Synthetic polynucleotide
  source 1..396: mol_type = other DNA

SEQ ID NO: 8040 - DNA, 173 bp, synthetic construct; identical to SEQ ID NO: 2186
  misc_feature 1..173: note = Description of Artificial Sequence: Synthetic polynucleotide
  source 1..173: mol_type = other DNA

SEQ ID NO: 8041 - DNA, 97 bp, synthetic construct; identical to SEQ ID NO: 2197
  misc_feature 1..97: note = Description of Artificial Sequence: Synthetic oligonucleotide
  source 1..97: mol_type = other DNA

SEQ ID NO: 8042 - DNA, 208 bp, synthetic construct; identical to SEQ ID NO: 2208
  misc_feature 1..208: note = Description of Artificial Sequence: Synthetic polynucleotide
  source 1..208: mol_type = other DNA

SEQ ID NO: 8043 - DNA, 647 bp, synthetic construct; identical to SEQ ID NO: 2219
  misc_feature 1..647: note = Description of Artificial Sequence: Synthetic polynucleotide
  source 1..647: mol_type = other DNA

SEQ ID NO: 8044 - DNA, 282 bp, synthetic construct; identical to SEQ ID NO: 2230
  misc_feature 1..282: note = Description of Artificial Sequence: Synthetic polynucleotide
  source 1..282: mol_type = other DNA

SEQ ID NO: 8045 - DNA, 141 bp, synthetic construct; identical to SEQ ID NO: 2275
  misc_feature 1..141: note = Description of Artificial Sequence: Synthetic polynucleotide
  source 1..141: mol_type = other DNA

SEQ ID NO: 8046 - DNA, 25 bp, synthetic construct
  misc_feature 1..25: note = Description of Artificial Sequence: Synthetic oligonucleotide
  source 1..25: mol_type = other DNA
cgttaattagattttagggtgtacg

SEQ ID NO: 8047 - DNA, 255 bp, Homo sapiens; identical to SEQ ID NO: 2680
  source 1..255: mol_type = unassigned DNA

SEQ ID NO: 8048 - DNA, 630 bp, Homo sapiens; identical to SEQ ID NO: 2942
  source 1..630: mol_type = unassigned DNA

SEQ ID NO: 8049 - DNA, 283 bp, Homo sapiens; identical to SEQ ID NO: 2964
  source 1..283: mol_type = unassigned DNA

SEQ ID NO: 8050 - DNA, 249 bp, Homo sapiens; identical to SEQ ID NO: 2986
  source 1..249: mol_type = unassigned DNA

SEQ ID NO: 8051 - DNA, 365 bp, Homo sapiens; identical to SEQ ID NO: 2570
  source 1..365: mol_type = unassigned DNA

SEQ ID NO: 8052 - DNA, 324 bp, Homo sapiens; identical to SEQ ID NO: 2581
  source 1..324: mol_type = unassigned DNA

SEQ ID NO: 8053 - DNA, 595 bp, Homo sapiens; identical to SEQ ID NO: 2603
  source 1..595: mol_type = unassigned DNA

SEQ ID NO: 8054 - DNA, 372 bp, Homo sapiens; identical to SEQ ID NO: 2614
  source 1..372: mol_type = unassigned DNA

SEQ ID NO: 8055 - DNA, 296 bp, Homo sapiens; identical to SEQ ID NO: 2625
  source 1..296: mol_type = unassigned DNA

SEQ ID NO: 8056 - DNA, 407 bp, Homo sapiens; identical to SEQ ID NO: 2636
  source 1..407: mol_type = unassigned DNA

SEQ ID NO: 8057 - DNA, 846 bp, Homo sapiens; identical to SEQ ID NO: 2647
  source 1..846: mol_type = unassigned DNA

SEQ ID NO: 8058 - DNA, 481 bp, Homo sapiens; identical to SEQ ID NO: 2658
  source 1..481: mol_type = unassigned DNA

SEQ ID NO: 8059 - DNA, 340 bp, Homo sapiens; identical to SEQ ID NO: 2703
  source 1..340: mol_type = unassigned DNA

SEQ ID NO: 8060 - DNA, 224 bp, Homo sapiens; identical to SEQ ID NO: 2714
  source 1..224: mol_type = unassigned DNA

SEQ ID NO: 8061 - DNA, 255 bp, Homo sapiens; identical to SEQ ID NO: 3108
  source 1..255: mol_type = unassigned DNA

SEQ ID NO: 8062 - DNA, 630 bp, Homo sapiens; identical to SEQ ID NO: 3370
  source 1..630: mol_type = unassigned DNA

SEQ ID NO: 8063 - DNA, 283 bp, Homo sapiens; identical to SEQ ID NO: 3392
  source 1..283: mol_type = unassigned DNA

SEQ ID NO: 8064 - DNA, 249 bp, Homo sapiens; identical to SEQ ID NO: 3414
  source 1..249: mol_type = unassigned DNA

SEQ ID NO: 8065 - DNA, 365 bp, Homo sapiens; identical to SEQ ID NO: 2998
  source 1..365: mol_type = unassigned DNA

SEQ ID NO: 8066 - DNA, 324 bp, Homo sapiens; identical to SEQ ID NO: 3009
  source 1..324: mol_type = unassigned DNA

SEQ ID NO: 8067 - DNA, 595 bp, Homo sapiens; identical to SEQ ID NO: 3031
  source 1..595: mol_type = unassigned DNA

SEQ ID NO: 8068 - DNA, 372 bp, Homo sapiens; identical to SEQ ID NO: 3042
  source 1..372: mol_type = unassigned DNA

SEQ ID NO: 8069 - DNA, 296 bp, Homo sapiens; identical to SEQ ID NO: 3053
  source 1..296: mol_type = unassigned DNA

SEQ ID NO: 8070 - DNA, 407 bp, Homo sapiens; identical to SEQ ID NO: 3064
  source 1..407: mol_type = unassigned DNA

SEQ ID NO: 8071 - DNA, 846 bp, Homo sapiens; identical to SEQ ID NO: 3075
  source 1..846: mol_type = unassigned DNA

SEQ ID NO: 8072 - DNA, 481 bp, Homo sapiens; identical to SEQ ID NO: 3086
  source 1..481: mol_type = unassigned DNA

SEQ ID NO: 8073 - DNA, 340 bp, Homo sapiens; identical to SEQ ID NO: 3131
  source 1..340: mol_type = unassigned DNA

SEQ ID NO: 8074 - DNA, 224 bp, Homo sapiens; identical to SEQ ID NO: 3142
  source 1..224: mol_type = unassigned DNA

SEQ ID NO: 8075 - DNA, 255 bp, synthetic construct; identical to SEQ ID NO: 3536
  misc_feature 1..255: note = Description of Artificial Sequence: Synthetic polynucleotide
  source 1..255: mol_type = other DNA

SEQ ID NO: 8076 - DNA, 630 bp, synthetic construct; identical to SEQ ID NO: 3798
  misc_feature 1..630: note = Description of Artificial Sequence: Synthetic polynucleotide
  source 1..630: mol_type = other DNA

SEQ ID NO: 8077 - DNA, 283 bp, synthetic construct; identical to SEQ ID NO: 3820
  misc_feature 1..283: note = Description of Artificial Sequence: Synthetic polynucleotide
  source 1..283: mol_type = other DNA

SEQ ID NO: 8078 - DNA, 249 bp, synthetic construct; identical to SEQ ID NO: 3842
  misc_feature 1..249: note = Description of Artificial Sequence: Synthetic polynucleotide
  source 1..249: mol_type = other DNA

SEQ ID NO: 8079 - DNA, 365 bp, synthetic construct; identical to SEQ ID NO: 3426
  misc_feature 1..365: note = Description of Artificial Sequence: Synthetic polynucleotide
  source 1..365: mol_type = other DNA

SEQ ID NO: 8080 - DNA, 324 bp, synthetic construct; identical to SEQ ID NO: 3437
  misc_feature 1..324: note = Description of Artificial Sequence: Synthetic polynucleotide
  source 1..324: mol_type = other DNA

SEQ ID NO: 8081 - DNA, 595 bp, synthetic construct; identical to SEQ ID NO: 3459
  misc_feature 1..595: note = Description of Artificial Sequence: Synthetic polynucleotide
  source 1..595: mol_type = other DNA

SEQ ID NO: 8082 - DNA, 372 bp, synthetic construct; identical to SEQ ID NO: 3470
  misc_feature 1..372: note = Description of Artificial Sequence: Synthetic polynucleotide
  source 1..372: mol_type = other DNA

SEQ ID NO: 8083 - DNA, 296 bp, synthetic construct; identical to SEQ ID NO: 3481
  misc_feature 1..296: note = Description of Artificial Sequence: Synthetic polynucleotide
  source 1..296: mol_type = other DNA

SEQ ID NO: 8084 - DNA, 407 bp, synthetic construct; identical to SEQ ID NO: 3492
  misc_feature 1..407: note = Description of Artificial Sequence: Synthetic polynucleotide
  source 1..407: mol_type = other DNA

SEQ ID NO: 8085 - DNA, 846 bp, synthetic construct; identical to SEQ ID NO: 3503
  misc_feature 1..846: note = Description of Artificial Sequence: Synthetic polynucleotide
  source 1..846: mol_type = other DNA

SEQ ID NO: 8086 - DNA, 481 bp, synthetic construct; identical to SEQ ID NO: 3514
  misc_feature 1..481: note = Description of Artificial Sequence: Synthetic polynucleotide
  source 1..481: mol_type = other DNA

SEQ ID NO: 8087 - DNA, 340 bp, synthetic construct; identical to SEQ ID NO: 3559
  misc_feature 1..340: note = Description of Artificial Sequence: Synthetic polynucleotide
  source 1..340: mol_type = other DNA

SEQ ID NO: 8088 - DNA, 224 bp, synthetic construct; identical to SEQ ID NO: 3570
  misc_feature 1..224: note = Description of Artificial Sequence: Synthetic polynucleotide
  source 1..224: mol_type = other DNA

SEQ ID NO: 8089 - DNA, 255 bp, synthetic construct; identical to SEQ ID NO: 3964
  misc_feature 1..255: note = Description of Artificial Sequence: Synthetic polynucleotide
  source 1..255: mol_type = other DNA

SEQ ID NO: 8090 - DNA, 630 bp, synthetic construct; identical to SEQ ID NO: 4226
  misc_feature 1..630: note = Description of Artificial Sequence: Synthetic polynucleotide
  source 1..630: mol_type = other DNA

SEQ ID NO: 8091 - DNA, 283 bp, synthetic construct; identical to SEQ ID NO: 4248
  misc_feature 1..283: note = Description of Artificial Sequence: Synthetic polynucleotide
  source 1..283: mol_type = other DNA

SEQ ID NO: 8092 - DNA, 249 bp, synthetic construct; identical to SEQ ID NO: 4270
  misc_feature 1..249: note = Description of Artificial Sequence: Synthetic polynucleotide
  source 1..249: mol_type = other DNA

SEQ ID NO: 8093 - DNA, 365 bp, synthetic construct; identical to SEQ ID NO: 3854
  misc_feature 1..365: note = Description of Artificial Sequence: Synthetic polynucleotide
  source 1..365: mol_type = other DNA

SEQ ID NO: 8094 - DNA, 324 bp, synthetic construct; identical to SEQ ID NO: 3865
  misc_feature 1..324: note = Description of Artificial Sequence: Synthetic polynucleotide
  source 1..324: mol_type = other DNA

SEQ ID NO: 8095 - DNA, 595 bp, synthetic construct; identical to SEQ ID NO: 3887
  misc_feature 1..595: note = Description of Artificial Sequence: Synthetic polynucleotide
  source 1..595: mol_type = other DNA

SEQ ID NO: 8096 - DNA, 372 bp, synthetic construct; identical to SEQ ID NO: 3898
  misc_feature 1..372: note = Description of Artificial Sequence: Synthetic polynucleotide
  source 1..372: mol_type = other DNA

SEQ ID NO: 8097 - DNA, 296 bp, synthetic construct; identical to SEQ ID NO: 3909
  misc_feature 1..296: note = Description of Artificial Sequence: Synthetic polynucleotide
  source 1..296: mol_type = other DNA

SEQ ID NO: 8098 - DNA, 407 bp, synthetic construct; identical to SEQ ID NO: 3920
  misc_feature 1..407: note = Description of Artificial Sequence: Synthetic polynucleotide
  source 1..407: mol_type = other DNA

SEQ ID NO: 8099 - DNA, 846 bp, synthetic construct; identical to SEQ ID NO: 3931
  misc_feature 1..846: note = Description of Artificial Sequence: Synthetic polynucleotide
  source 1..846: mol_type = other DNA

SEQ ID NO: 8100 - DNA, 481 bp, synthetic construct; identical to SEQ ID NO: 3942
  misc_feature 1..481: note = Description of Artificial Sequence: Synthetic polynucleotide
  source 1..481: mol_type = other DNA

SEQ ID NO: 8101 - DNA, 340 bp, synthetic construct; identical to SEQ ID NO: 3987
  misc_feature 1..340: note = Description of Artificial Sequence: Synthetic polynucleotide
  source 1..340: mol_type = other DNA

SEQ ID NO: 8102 - DNA, 224 bp, synthetic construct; identical to SEQ ID NO: 3998
  misc_feature 1..224: note = Description of Artificial Sequence: Synthetic polynucleotide
  source 1..224: mol_type = other DNA

SEQ ID NO: 8103 - DNA, 255 bp, synthetic construct; identical to SEQ ID NO: 4392
  misc_feature 1..255: note = Description of Artificial Sequence: Synthetic polynucleotide
  source 1..255: mol_type = other DNA

SEQ ID NO: 8104 - DNA, 630 bp, synthetic construct; identical to SEQ ID NO: 4654
  misc_feature 1..630: note = Description of Artificial Sequence: Synthetic polynucleotide
  source 1..630: mol_type = other DNA

SEQ ID NO: 8105 - DNA, 283 bp, synthetic construct; identical to SEQ ID NO: 4676
  misc_feature 1..283: note = Description of Artificial Sequence: Synthetic polynucleotide
  source 1..283: mol_type = other DNA

SEQ ID NO: 8106 - DNA, 249 bp, synthetic construct; identical to SEQ ID NO: 4698
  misc_feature 1..249: note = Description of Artificial Sequence: Synthetic polynucleotide
  source 1..249: mol_type = other DNA

SEQ ID NO: 8107 - DNA, 365 bp, synthetic construct; identical to SEQ ID NO: 4282
  misc_feature 1..365: note = Description of Artificial Sequence: Synthetic polynucleotide
  source 1..365: mol_type = other DNA

SEQ ID NO: 8108 - DNA, 324 bp, synthetic construct; identical to SEQ ID NO: 4293
  misc_feature 1..324: note = Description of Artificial Sequence: Synthetic polynucleotide
  source 1..324: mol_type = other DNA

SEQ ID NO: 8109 - DNA, 595 bp, synthetic construct; identical to SEQ ID NO: 4315
  misc_feature 1..595: note = Description of Artificial Sequence: Synthetic polynucleotide
  source 1..595: mol_type = other DNA

SEQ ID NO: 8110 - DNA, 372 bp, synthetic construct; identical to SEQ ID NO: 4326
  misc_feature 1..372: note = Description of Artificial Sequence: Synthetic polynucleotide
  source 1..372: mol_type = other DNA

SEQ ID NO: 8111 - DNA, 296 bp, synthetic construct; identical to SEQ ID NO: 4337
  misc_feature 1..296: note = Description of Artificial Sequence: Synthetic polynucleotide
  source 1..296: mol_type = other DNA

SEQ ID NO: 8112 - DNA, 407 bp, synthetic construct; identical to SEQ ID NO: 4348
  misc_feature 1..407: note = Description of Artificial Sequence: Synthetic polynucleotide
  source 1..407: mol_type = other DNA

SEQ ID NO: 8113 - DNA, 846 bp, synthetic construct; identical to SEQ ID NO: 4359
  misc_feature 1..846: note = Description of Artificial Sequence: Synthetic polynucleotide
  source 1..846: mol_type = other DNA

SEQ ID NO: 8114 - DNA, 481 bp, synthetic construct; identical to SEQ ID NO: 4370
  misc_feature 1..481: note = Description of Artificial Sequence: Synthetic polynucleotide
  source 1..481: mol_type = other DNA

SEQ ID NO: 8115 - DNA, 340 bp, synthetic construct; identical to SEQ ID NO: 4415
  misc_feature 1..340: note = Description of Artificial Sequence: Synthetic polynucleotide
  source 1..340: mol_type = other DNA

SEQ ID NO: 8116 - DNA, 224 bp, synthetic construct; identical to SEQ ID NO: 4426
  misc_feature 1..224: note = Description of Artificial Sequence: Synthetic polynucleotide
  source 1..224: mol_type = other DNA

SEQ ID NO: 8117 - DNA, 255 bp, synthetic construct; identical to SEQ ID NO: 4820
  misc_feature 1..255: note = Description of Artificial Sequence: Synthetic polynucleotide
  source 1..255: mol_type = other DNA

SEQ ID NO: 8118 - DNA, 630 bp, synthetic construct; identical to SEQ ID NO: 5082
  misc_feature 1..630: note = Description of Artificial Sequence: Synthetic polynucleotide
  source 1..630: mol_type = other DNA

SEQ ID NO: 8119 - DNA, 283 bp, synthetic construct; identical to SEQ ID NO: 5104
  misc_feature 1..283: note = Description of Artificial Sequence: Synthetic polynucleotide
  source 1..283: mol_type = other DNA

SEQ ID NO: 8120 - DNA, 249 bp, synthetic construct; identical to SEQ ID NO: 5126
  misc_feature 1..249: note = Description of Artificial Sequence: Synthetic polynucleotide
  source 1..249: mol_type = other DNA

SEQ ID NO: 8121 - DNA, 365 bp, synthetic construct; identical to SEQ ID NO: 4710
  misc_feature 1..365: note = Description of Artificial Sequence: Synthetic polynucleotide
  source 1..365: mol_type = other DNA

SEQ ID NO: 8122 - DNA, 324 bp, synthetic construct; identical to SEQ ID NO: 4721
  misc_feature 1..324: note = Description of Artificial Sequence: Synthetic polynucleotide
  source 1..324: mol_type = other DNA

SEQ ID NO: 8123 - DNA, 595 bp, synthetic construct; identical to SEQ ID NO: 4743
  misc_feature 1..595: note = Description of Artificial Sequence: Synthetic polynucleotide
  source 1..595: mol_type = other DNA

SEQ ID NO: 8124 - DNA, 372 bp, synthetic construct; identical to SEQ ID NO: 4754
  misc_feature 1..372: note = Description of Artificial Sequence: Synthetic polynucleotide
  source 1..372: mol_type = other DNA

SEQ ID NO: 8125 - DNA, 296 bp, synthetic construct; identical to SEQ ID NO: 4765
  misc_feature 1..296: note = Description of Artificial Sequence: Synthetic polynucleotide
  source 1..296: mol_type = other DNA

SEQ ID NO: 8126 - DNA, 407 bp, synthetic construct; identical to SEQ ID NO: 4776
  misc_feature 1..407: note = Description of Artificial Sequence: Synthetic polynucleotide
  source 1..407: mol_type = other DNA

SEQ ID NO: 8127 - DNA, 846 bp, synthetic construct; identical to SEQ ID NO: 4787
  misc_feature 1..846: note = Description of Artificial Sequence: Synthetic polynucleotide
  source 1..846: mol_type = other DNA

SEQ ID NO: 8128 - DNA, 481 bp, synthetic construct; identical to SEQ ID NO: 4798
  misc_feature 1..481: note = Description of Artificial Sequence: Synthetic polynucleotide
  source 1..481: mol_type = other DNA

SEQ ID NO: 8129 - DNA, 340 bp, synthetic construct; identical to SEQ ID NO: 4843
  misc_feature 1..340: note = Description of Artificial Sequence: Synthetic polynucleotide
  source 1..340: mol_type = other DNA

SEQ ID NO: 8130 - DNA, 224 bp, synthetic construct; identical to SEQ ID NO: 4854
  misc_feature 1..224: note = Description of Artificial Sequence: Synthetic polynucleotide
  source 1..224: mol_type = other DNA

SEQ ID NO: 8131 - DNA, 395 bp, Homo sapiens; identical to SEQ ID NO: 7829
  source 1..395: mol_type = unassigned DNA

SEQ ID NO: 8132 - DNA, 5819 bp, Homo sapiens; identical to SEQ ID NO: 7838
  source 1..5819: mol_type = unassigned DNA

SEQ ID NO: 8133 - DNA, 1265 bp, Homo sapiens; identical to SEQ ID NO: 7840
  source 1..1265: mol_type = unassigned DNA

SEQ ID NO: 8134 - DNA, 362 bp, Homo sapiens; identical to SEQ ID NO: 7842
  source 1..362: mol_type = unassigned DNA

SEQ ID NO: 8135 - DNA, 572 bp, Homo sapiens; identical to SEQ ID NO: 7820
  source 1..572: mol_type = unassigned DNA

SEQ ID NO: 8136 - DNA, 2400 bp, Homo sapiens; identical to SEQ ID NO: 7822
  source 1..2400: mol_type = unassigned DNA

SEQ ID NO: 8137 - DNA, 1859 bp, Homo sapiens; identical to SEQ ID NO: 7823
  source 1..1859: mol_type = unassigned DNA

SEQ ID NO: 8138 - DNA, 902 bp, Homo sapiens; identical to SEQ ID NO: 7824
  source 1..902: mol_type = unassigned DNA

SEQ ID NO: 8139 - DNA, 2044 bp, Homo sapiens; identical to SEQ ID NO: 7825
  source 1..2044: mol_type = unassigned DNA

SEQ ID NO: 8140 - DNA, 1152 bp, Homo sapiens; identical to SEQ ID NO: 7826
  source 1..1152: mol_type = unassigned DNA

SEQ ID NO: 8141 - DNA, 872 bp, Homo sapiens; identical to SEQ ID NO: 7827
  source 1..872: mol_type = unassigned DNA

SEQ ID NO: 8142 - DNA, 1743 bp, Homo sapiens; identical to SEQ ID NO: 7832
  source 1..1743: mol_type = unassigned DNA

SEQ ID NO: 8143 - DNA, 2405 bp, Homo sapiens; identical to SEQ ID NO: 7833
  source 1..2405: mol_type = unassigned DNA

SEQ ID NO: 8144 - DNA, 395 bp, Homo sapiens; identical to SEQ ID NO: 7853
  source 1..395: mol_type = unassigned DNA

SEQ ID NO: 8145 - DNA, 5819 bp, Homo sapiens; identical to SEQ ID NO: 7862
  source 1..5819: mol_type = unassigned DNA

SEQ ID NO: 8146 - DNA, 1265 bp, Homo sapiens; identical to SEQ ID NO: 7864
  source 1..1265: mol_type = unassigned DNA

SEQ ID NO: 8147 - DNA, 362 bp, Homo sapiens; identical to SEQ ID NO: 7866
  source 1..362: mol_type = unassigned DNA

SEQ ID NO: 8148 - DNA, 572 bp, Homo sapiens; identical to SEQ ID NO: 7844
  source 1..572: mol_type = unassigned DNA

SEQ ID NO: 8149 - DNA, 2400 bp, Homo sapiens; identical to SEQ ID NO: 7846
  source 1..2400: mol_type = unassigned DNA

SEQ ID NO: 8150 - DNA, 1859 bp, Homo sapiens; identical to SEQ ID NO: 7847
  source 1..1859: mol_type = unassigned DNA

SEQ ID NO: 8151 - DNA, 902 bp, Homo sapiens; identical to SEQ ID NO: 7848
  source 1..902: mol_type = unassigned DNA

SEQ ID NO: 8152 - DNA, 2044 bp, Homo sapiens; identical to SEQ ID NO: 7849
  source 1..2044: mol_type = unassigned DNA

SEQ ID NO: 8153 - DNA, 1152 bp, Homo sapiens; identical to SEQ ID NO: 7850
  source 1..1152: mol_type = unassigned DNA

SEQ ID NO: 8154 - DNA, 872 bp, Homo sapiens; identical to SEQ ID NO: 7851
  source 1..872: mol_type = unassigned DNA

SEQ ID NO: 8155 - DNA, 1743 bp, Homo sapiens; identical to SEQ ID NO: 7856
  source 1..1743: mol_type = unassigned DNA

SEQ ID NO: 8156 - DNA, 2405 bp, Homo sapiens; identical to SEQ ID NO: 7857
  source 1..2405: mol_type = unassigned DNA

SEQ ID NO: 8157 - DNA, 395 bp, synthetic construct; identical to SEQ ID NO: 7877
  misc_feature 1..395: note = Description of Artificial Sequence: Synthetic polynucleotide
  source 1..395: mol_type = other DNA

SEQ ID NO: 8158 - DNA, 5819 bp, synthetic construct; identical to SEQ ID NO: 7886
  misc_feature 1..5819: note = Description of Artificial Sequence: Synthetic polynucleotide
  source 1..5819: mol_type = other DNA

SEQ ID NO: 8159 - DNA, 1265 bp, synthetic construct; identical to SEQ ID NO: 7888
  misc_feature 1..1265: note = Description of Artificial Sequence: Synthetic polynucleotide
  source 1..1265: mol_type = other DNA

SEQ ID NO: 8160 - DNA, 362 bp, synthetic construct; identical to SEQ ID NO: 7890
  misc_feature 1..362: note = Description of Artificial Sequence: Synthetic polynucleotide
  source 1..362: mol_type = other DNA

SEQ ID NO: 8161 - DNA, 572 bp, synthetic construct; identical to SEQ ID NO: 7868
  misc_feature 1..572: note = Description of Artificial Sequence: Synthetic polynucleotide
  source 1..572: mol_type = other DNA

SEQ ID NO: 8162 - DNA, 2400 bp, synthetic construct; identical to SEQ ID NO: 7870
  misc_feature 1..2400: note = Description of Artificial Sequence: Synthetic polynucleotide
  source 1..2400: mol_type = other DNA

SEQ ID NO: 8163 - DNA, 1859 bp, synthetic construct; identical to SEQ ID NO: 7871
  misc_feature 1..1859: note = Description of Artificial Sequence: Synthetic polynucleotide
  source 1..1859: mol_type = other DNA

SEQ ID NO: 8164 - DNA, 902 bp, synthetic construct; identical to SEQ ID NO: 7872
  misc_feature 1..902: note = Description of Artificial Sequence: Synthetic polynucleotide
  source 1..902: mol_type = other DNA

SEQ ID NO: 8165 - DNA, 2044 bp, synthetic construct; identical to SEQ ID NO: 7873
  misc_feature 1..2044: note = Description of Artificial Sequence: Synthetic polynucleotide
  source 1..2044: mol_type = other DNA

SEQ ID NO: 8166 - DNA, 1152 bp, synthetic construct; identical to SEQ ID NO: 7874
  misc_feature 1..1152: note = Description of Artificial Sequence: Synthetic polynucleotide
  source 1..1152: mol_type = other DNA

SEQ ID NO: 8167 - DNA, 872 bp, synthetic construct; identical to SEQ ID NO: 7875
  misc_feature 1..872: note = Description of Artificial Sequence: Synthetic polynucleotide
  source 1..872: mol_type = other DNA

SEQ ID NO: 8168 - DNA, 1743 bp, synthetic construct; identical to SEQ ID NO: 7880
  misc_feature 1..1743: note = Description of Artificial Sequence: Synthetic polynucleotide
  source 1..1743: mol_type = other DNA

SEQ ID NO: 8169 - DNA, 2405 bp, synthetic construct; identical to SEQ ID NO: 7881
  misc_feature 1..2405: note = Description of Artificial Sequence: Synthetic polynucleotide
  source 1..2405: mol_type = other DNA

SEQ ID NO: 8170 - DNA, 395 bp, synthetic construct; identical to SEQ ID NO: 7901
  misc_feature 1..395: note = Description of Artificial Sequence: Synthetic polynucleotide
  source 1..395: mol_type = other DNA

SEQ ID NO: 8171 - DNA, 5819 bp, synthetic construct; identical to SEQ ID NO: 7910
  misc_feature 1..5819: note = Description of Artificial Sequence: Synthetic polynucleotide
  source 1..5819: mol_type = other DNA

SEQ ID NO: 8172 - DNA, 1265 bp, synthetic construct; identical to SEQ ID NO: 7912
  misc_feature 1..1265: note = Description of Artificial Sequence: Synthetic polynucleotide
  source 1..1265: mol_type = other DNA

SEQ ID NO: 8173 - DNA, 362 bp, synthetic construct; identical to SEQ ID NO: 7914
  misc_feature 1..362: note = Description of Artificial Sequence: Synthetic polynucleotide
  source 1..362: mol_type = other DNA

SEQ ID NO: 8174 - DNA, 572 bp, synthetic construct; identical to SEQ ID NO: 7892
  misc_feature 1..572: note = Description of Artificial Sequence: Synthetic polynucleotide
  source 1..572: mol_type = other DNA

SEQ ID NO: 8175 - DNA, 2400 bp, synthetic construct; identical to SEQ ID NO: 7894
  misc_feature 1..2400: note = Description of Artificial Sequence: Synthetic polynucleotide
  source 1..2400: mol_type = other DNA

SEQ ID NO: 8176 - DNA, 1859 bp, synthetic construct; identical to SEQ ID NO: 7895
  misc_feature 1..1859: note = Description of Artificial Sequence: Synthetic polynucleotide
  source 1..1859: mol_type = other DNA

SEQ ID NO: 8177 - DNA, 902 bp, synthetic construct; identical to SEQ ID NO: 7896
  misc_feature 1..902: note = Description of Artificial Sequence: Synthetic polynucleotide
  source 1..902: mol_type = other DNA

SEQ ID NO: 8178 - DNA, 2044 bp, synthetic construct; identical to SEQ ID NO: 7897
  misc_feature 1..2044: note = Description of Artificial Sequence: Synthetic polynucleotide
  source 1..2044: mol_type = other DNA

SEQ ID NO: 8179 - DNA, 1152 bp, synthetic construct; identical to SEQ ID NO: 7898
  misc_feature 1..1152: note = Description of Artificial Sequence: Synthetic polynucleotide
  source 1..1152: mol_type = other DNA

SEQ ID NO: 8180 - DNA, 872 bp, synthetic construct; identical to SEQ ID NO: 7899
  misc_feature 1..872: note = Description of Artificial Sequence: Synthetic polynucleotide
  source 1..872: mol_type = other DNA

SEQ ID NO: 8181 - DNA, 1743 bp, synthetic construct; identical to SEQ ID NO: 7904
  misc_feature 1..1743: note = Description of Artificial Sequence: Synthetic polynucleotide
  source 1..1743: mol_type = other DNA

SEQ ID NO: 8182 - DNA, 2405 bp, synthetic construct; identical to SEQ ID NO: 7905
  misc_feature 1..2405: note = Description of Artificial Sequence: Synthetic polynucleotide
  source 1..2405: mol_type = other DNA

SEQ ID NO: 8183 - DNA, 395 bp, synthetic construct; identical to SEQ ID NO: 7925
  misc_feature 1..395: note = Description of Artificial Sequence: Synthetic polynucleotide
  source 1..395: mol_type = other DNA

SEQ ID NO: 8184 - DNA, 5819 bp, synthetic construct; identical to SEQ ID NO: 7934
  misc_feature 1..5819: note = Description of Artificial Sequence: Synthetic polynucleotide
  source 1..5819: mol_type = other DNA

SEQ ID NO: 8185 - DNA, 1265 bp, synthetic construct; identical to SEQ ID NO: 7936
  misc_feature 1..1265: note = Description of Artificial Sequence: Synthetic polynucleotide
  source 1..1265: mol_type = other DNA

SEQ ID NO: 8186 - DNA, 362 bp, synthetic construct; identical to SEQ ID NO: 7938
  misc_feature 1..362: note = Description of Artificial Sequence: Synthetic polynucleotide
  source 1..362: mol_type = other DNA

SEQ ID NO: 8187 - DNA, 572 bp, synthetic construct; identical to SEQ ID NO: 7916
  misc_feature 1..572: note = Description of Artificial Sequence: Synthetic polynucleotide
  source 1..572: mol_type = other DNA

SEQ ID NO: 8188 - DNA, 2400 bp, synthetic construct; identical to SEQ ID NO: 7918
  misc_feature 1..2400: note = Description of Artificial Sequence: Synthetic polynucleotide
  source 1..2400: mol_type = other DNA

SEQ ID NO: 8189 - DNA, 1859 bp, synthetic construct; identical to SEQ ID NO: 7919
  misc_feature 1..1859: note = Description of Artificial Sequence: Synthetic polynucleotide
  source 1..1859: mol_type = other DNA

SEQ ID NO: 8190 - DNA, 902 bp, synthetic construct; identical to SEQ ID NO: 7920
  misc_feature 1..902: note = Description of Artificial Sequence: Synthetic polynucleotide
  source 1..902: mol_type = other DNA

SEQ ID NO: 8191 - DNA, 2044 bp, synthetic construct; identical to SEQ ID NO: 7921
  misc_feature 1..2044: note = Description of Artificial Sequence: Synthetic polynucleotide
  source 1..2044: mol_type = other DNA

SEQ ID NO: 8192 - DNA, 1152 bp, synthetic construct; identical to SEQ ID NO: 7922
  misc_feature 1..1152: note = Description of Artificial Sequence: Synthetic polynucleotide
  source 1..1152: mol_type = other DNA

SEQ ID NO: 8193 - DNA, 872 bp, synthetic construct; identical to SEQ ID NO: 7923
  misc_feature 1..872: note = Description of Artificial Sequence: Synthetic polynucleotide
  source 1..872: mol_type = other DNA

SEQ ID NO: 8194 - DNA, 1743 bp, synthetic construct; identical to SEQ ID NO: 7928
  misc_feature 1..1743: note = Description of Artificial Sequence: Synthetic polynucleotide
  source 1..1743: mol_type = other DNA

SEQ ID NO: 8195 - DNA, 2405 bp, synthetic construct; identical to SEQ ID NO: 7929
  misc_feature 1..2405: note = Description of Artificial Sequence: Synthetic polynucleotide
  source 1..2405: mol_type = other DNA

SEQ ID NO: 8196 - DNA, 395 bp, synthetic construct; identical to SEQ ID NO: 7949
  misc_feature 1..395: note = Description of Artificial Sequence: Synthetic polynucleotide
  source 1..395: mol_type = other DNA

SEQ ID NO: 8197 - DNA, 5819 bp, synthetic construct; identical to SEQ ID NO: 7958
  misc_feature 1..5819: note = Description of Artificial Sequence: Synthetic polynucleotide
  source 1..5819: mol_type = other DNA

SEQ ID NO: 8198 - DNA, 1265 bp, synthetic construct; identical to SEQ ID NO: 7960
  misc_feature 1..1265: note = Description of Artificial Sequence: Synthetic polynucleotide
  source 1..1265: mol_type = other DNA

SEQ ID NO: 8199 - DNA, 362 bp, synthetic construct; identical to SEQ ID NO: 7962
  misc_feature 1..362: note = Description of Artificial Sequence: Synthetic polynucleotide
  source 1..362: mol_type = other DNA

SEQ ID NO: 8200 - DNA, 572 bp, synthetic construct; identical to SEQ ID NO: 7940
  misc_feature 1..572: note = Description of Artificial Sequence: Synthetic polynucleotide
  source 1..572: mol_type = other DNA

SEQ ID NO: 8201 - DNA, 2400 bp, synthetic construct; identical to SEQ ID NO: 7942
  misc_feature 1..2400: note = Description of Artificial Sequence: Synthetic polynucleotide
  source 1..2400: mol_type = other DNA

SEQ ID NO: 8202 - DNA, 1859 bp, synthetic construct; identical to SEQ ID NO: 7943
  misc_feature 1..1859: note = Description of Artificial Sequence: Synthetic polynucleotide
  source 1..1859: mol_type = other DNA

SEQ ID NO: 8203 - DNA, 902 bp, synthetic construct; identical to SEQ ID NO: 7944
  misc_feature 1..902: note = Description of Artificial Sequence: Synthetic polynucleotide
  source 1..902: mol_type = other DNA

SEQ ID NO: 8204 - DNA, 2044 bp, synthetic construct; identical to SEQ ID NO: 7945
  misc_feature 1..2044: note = Description of Artificial Sequence: Synthetic polynucleotide
  source 1..2044: mol_type = other DNA

SEQ ID NO: 8205 - DNA, 1152 bp, synthetic construct; identical to SEQ ID NO: 7946
  misc_feature 1..1152: note = Description of Artificial Sequence: Synthetic polynucleotide
  source 1..1152: mol_type = other DNA

SEQ ID NO: 8206 - DNA, 872 bp, synthetic construct; identical to SEQ ID NO: 7947
  misc_feature 1..872: note = Description of Artificial Sequence: Synthetic polynucleotide
  source 1..872: mol_type = other DNA

SEQ ID NO: 8207 - DNA, 1743 bp, synthetic construct; identical to SEQ ID NO: 7952
  misc_feature 1..1743: note = Description of Artificial Sequence: Synthetic polynucleotide
  source 1..1743: mol_type = other DNA

SEQ ID NO: 8208 - DNA, 2405 bp, synthetic construct; identical to SEQ ID NO: 7953
  misc_feature 1..2405: note = Description of Artificial Sequence: Synthetic polynucleotide
  source 1..2405: mol_type = other DNA

SEQ ID NO: 8209 - DNA, 355 bp, Homo sapiens
  source 1..355: mol_type = unassigned DNA
tcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagg

SEQ ID NO: 8210 - DNA, 730 bp, Homo sapiens
  source 1..730: mol_type = unassigned DNA
ctgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagc

SEQ ID NO: 8211 - DNA, 383 bp, Homo sapiens
  source 1..383: mol_type = unassigned DNA
agcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagag

SEQ ID NO: 8212 - DNA, 349 bp, Homo sapiens
  source 1..349: mol_type = unassigned DNA
agaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagttagctctagagaagagagctccagtccagggaatcccggctgccctatcttccctcactttt

SEQ ID NO: 8213 - DNA, 465 bp, Homo sapiens
  source 1..465: mol_type = unassigned DNA
ccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggcgagagctcccagagcctctgtttcc

SEQ ID NO: 8214 - DNA, 424 bp, Homo sapiens
  source 1..424: mol_type = unassigned DNA
acacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccgcccaccccacggacccagcccggaccccgcccaccccgcggtcccagccc

SEQ ID NO: 8215 - DNA, 540 bp, Homo sapiens
  source 1..540: mol_type = unassigned DNA
acgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgc

SEQ ID NO: 8216 - DNA, 472 bp, Homo sapiens
  source 1..472: mol_type = unassigned DNA
tctttttaatcccatgtcttaaaagccaaactctagttctaaagtgcagtgtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggagg

SEQ ID NO: 8217 - DNA, 396 bp, Homo sapiens
  source 1..396: mol_type = unassigned DNA
ggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgagg

SEQ ID NO: 8218 - DNA, 507 bp, Homo sapiens
  source 1..507: mol_type = unassigned DNA
tgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcct

SEQ ID NO: 8219 - DNA, 946 bp, Homo sapiens
  source 1..946: mol_type = unassigned DNA
cgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggaga

SEQ ID NO: 8220 - DNA, 390 bp, Homo sapiens
  source 1..390: mol_type = unassigned DNA
cggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagcccc

SEQ ID NO: 8221 - DNA, 440 bp, Homo sapiens
  source 1..440: mol_type = unassigned DNA
ctggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacag

SEQ ID NO: 8222 - DNA, 324 bp, Homo sapiens
  source 1..324: mol_type = unassigned DNA
aattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctc

SEQ ID NO: 8223 - DNA, 355 bp, synthetic construct
  misc_feature 1..355: note = Description of Artificial Sequence: Synthetic polynucleotide
  source 1..355: mol_type = other DNA
tygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagg

SEQ ID NO: 8224 - DNA, 730 bp, synthetic construct
  misc_feature 1..730: note = Description of Artificial Sequence: Synthetic polynucleotide
  source 1..730: mol_type = other DNA
ttgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagt

SEQ ID NO: 8225 - DNA, 383 bp, synthetic construct
  misc_feature 1..383: note = Description of Artificial Sequence: Synthetic polynucleotide
  source 1..383: mol_type = other DNA
agyggyggygygggcygygggyggygatgggygaggagtagagtayggtgagyggyggyggygggttttaggagtygtagattttggttagtggtattgygggttattttgagttttygaggttttagggggatagygccygggygccccygctgygygcygccttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagag

SEQ ID NO: 8226 - DNA, 349 bp, synthetic construct
  misc_feature 1..349: note = Description of Artificial Sequence: Synthetic polynucleotide
  source 1..349: mol_type = other DNA
agatygagygggattatgtgggtaygttggagtttttggtgtyggtgagtgttttyggtagaygtagggggaygtcygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagttagttttagagaagagagttttagtttagggaatttyggttgttttatttttttttattttt

SEQ ID NO: 8227 - DNA, 465 bp, synthetic construct
  misc_feature 1..465: note = Description of Artificial Sequence: Synthetic polynucleotide
  source 1..465: mol_type = other DNA
tygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagygagtggcttcaggygagagctcccagagcctctgtttcc

SEQ ID NO: 8228 - DNA, 424 bp, synthetic construct
  misc_feature 1..424: note = Description of Artificial Sequence: Synthetic polynucleotide
  source 1..424: mol_type = other DNA
atatagaggtgaygtaygagtgatttatagagagggatttttgggtttttggtgggggtttgggagayggtygaagggggttygggtagaagttcygyggcygggcyggyggagggaagggggyggcygygccygggattyggtttttttyggttttatttatttgtttygaagagtggttttagttttgygtttttttttgygattttatatatagggatagttttaggtatagttttagtagtaggagtatggyggggygagggygygggaygttyggggattyggygggataygttttgtagygtttagggttttagttattgygggaygttttyggggtygcccacccygyggtcccagccyggacccygcccaccccayggacccagccyggacccygcccacccygyggtcccagccc

SEQ ID NO: 8229 - DNA, 540 bp, synthetic construct
  misc_feature 1..540: note = Description of Artificial Sequence: Synthetic polynucleotide
  source 1..540: mol_type = other DNA
aygaggaggaagaggaggaggaagaagaagaagaggaagaggaggaggaggaggaggaggaygygtttaggttgagatggttygygtggatattgttatttattttaagattgctgcctcygcygcygcygcygcygcygctgctgcygcygcygcygcygccaccatttgttatagttagtaaygggtagtyggygtaggggttygggggagtttttttygtygttagygttattttaaatatttattaatagttatattgttgttattgctgcygcygcygcygcygcygyggagygygggaggggggyggggaggygtttgggttyggggygttgtgygygatttggyggggtgygtygagatatatatagygagcygcygcygccygccygggggggagggggatggagtgygygggtagttttttttcccyggccygygcccygctygcccygggctgygctggcccygagygcygagagccagggggygcygygggcygccygygccyggggtctgygcygccccygggccygc

SEQ ID NO: 8230 - DNA, 472 bp, synthetic construct
  misc_feature 1..472: note = Description of Artificial Sequence: Synthetic polynucleotide
  source 1..472: mol_type = other DNA
tttttttaattttatgttttaaaagttaaattttagttttaaagtgtagtgtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggagg

SEQ ID NO: 8231 - DNA, 396 bp, synthetic construct
  misc_feature 1..396: note = Description of Artificial Sequence: Synthetic polynucleotide
  source 1..396: mol_type = other DNA
ggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgagg

SEQ ID NO: 8232 - DNA, 507 bp, synthetic construct
  misc_feature 1..507: note = Description of Artificial Sequence: Synthetic polynucleotide
  source 1..507: mol_type = other DNA
tgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygcyggcagtgggggctgyggyggyggagggcaygggccccygcttagygtttttatttttttggtgtagttgtttttygygagtygagatatttttgttagggaagaggagygtttyggttgtttttttagagtttttt

SEQ ID NO: 8233 - DNA, 946 bp, synthetic construct
  misc_feature 1..946: note = Description of Artificial Sequence: Synthetic polynucleotide
  source 1..946: mol_type = other DNA
ygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggcygygcygygctgygcygagygcygggctctcccygygagctcccygggccygygygygygccccccactgccccygcccccygygyggygygtgccccccacccccygcygygygccctygcaccygccyggctccaygyggygygygcctgttttggyggcagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggaga

SEQ ID NO: 8234 - DNA, 390 bp, synthetic construct
  misc_feature 1..390: note = Description of Artificial Sequence: Synthetic polynucleotide
  source 1..390: mol_type = other DNA
yggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagtttt

SEQ ID NO: 8235 - DNA, 440 bp, synthetic construct
  misc_feature 1..440: note = Description of Artificial Sequence: Synthetic polynucleotide
  source 1..440: mol_type = other DNA
ttggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttatag

SEQ ID NO: 8236 - DNA, 324 bp, synthetic construct
  misc_feature 1..324: note = Description of Artificial Sequence: Synthetic polynucleotide
  source 1..324: mol_type = other DNA
aattttagtattyggttgtattttyggyggtttttttagttatttgaggatagtatagggggtgagatggggtggtggttggtgaaygttggttactttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagttttt

SEQ ID NO: 8237 - DNA, 355 bp, synthetic construct
  misc_feature 1..355: note = Description of Artificial Sequence: Synthetic polynucleotide
  source 1..355: mol_type = other DNA
tcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagg

SEQ ID NO: 8238 - DNA, 730 bp, synthetic construct
  misc_feature 1..730: note = Description of Artificial Sequence: Synthetic polynucleotide
  source 1..730: mol_type = other DNA
ttgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagt

SEQ ID NO: 8239 - DNA, 383 bp, synthetic construct
  misc_feature 1..383: note = Description of Artificial Sequence: Synthetic polynucleotide
  source 1..383: mol_type = other DNA
agcggcggcgcgggccgcgggcggcgatgggcgaggagtagagtacggtgagcggcggcggcgggttttaggagtcgtagattttggttagtggtattgcgggttattttgagttttcgaggttttagggggatagcgcccgggcgcccccgctgcgcgccgccttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagag

SEQ ID NO: 8240 - DNA, 349 bp, synthetic construct
  misc_feature 1..349: note = Description of Artificial Sequence: Synthetic polynucleotide
  source 1..349: mol_type = other DNA
agatcgagcgggattatgtgggtacgttggagtttttggtgtcggtgagtgttttcggtagacgtagggggacgtccgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagttagttttagagaagagagttttagtttagggaatttcggttgttttatttttttttattttt

SEQ ID NO: 8241 - DNA, 465 bp, synthetic construct
  misc_feature 1..465: note = Description of Artificial Sequence: Synthetic polynucleotide
  source 1..465: mol_type = other DNA
tcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcgagtggcttcaggcgagagctcccagagcctctgtttcc

SEQ ID NO: 8242 - DNA, 424 bp, synthetic construct
  misc_feature 1..424: note = Description of Artificial Sequence: Synthetic polynucleotide
  source 1..424: mol_type = other DNA
atatagaggtgacgtacgagtgatttatagagagggatttttgggtttttggtgggggtttgggagacggtcgaagggggttcgggtagaagttccgcggccgggccggcggagggaagggggcggccgcgcccgggattcggtttttttcggttttatttatttgtttcgaagagtggttttagttttgcgtttttttttgcgattttatatatagggatagttttaggtatagttttagtagtaggagtatggcggggcgagggcgcgggacgttcggggattcggcgggatacgttttgtagcgtttagggttttagttattgcgggacgttttcggggtcgcccaccccgcggtcccagcccggaccccgcccaccccacggacccagcccggaccccgcccaccccgcggtcccagccc

SEQ ID NO: 8243 - DNA, 540 bp, synthetic construct
  misc_feature 1..540: note = Description of Artificial Sequence: Synthetic polynucleotide
  source 1..540: mol_type = other DNA
acgaggaggaagaggaggaggaagaagaagaagaggaagaggaggaggaggaggaggaggacgcgtttaggttgagatggttcgcgtggatattgttatttattttaagattgctgcctccgccgccgccgccgccgccgctgctgccgccgccgccgccgccaccatttgttatagttagtaacgggtagtcggcgtaggggttcgggggagtttttttcgtcgttagcgttattttaaatatttattaatagttatattgttgttattgctgccgccgccgccgccgccgcggagcgcgggaggggggcggggaggcgtttgggttcggggcgttgtgcgcgatttggcggggtgcgtcgagatatatatagcgagccgccgccgcccgcccgggggggagggggatggagtgcgcgggtagttttttttccccggcccgcgccccgctcgccccgggctgcgctggccccgagcgccgagagccagggggcgccgcgggccgcccgcgcccggggtctgcgccgcccccgggcccgc

SEQ ID NO: 8244 - DNA, 472 bp, synthetic construct
  misc_feature 1..472: note = Description of Artificial Sequence: Synthetic polynucleotide
  source 1..472: mol_type = other DNA
tttttttaattttatgttttaaaagttaaattttagttttaaagtgtagtgtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggagg

SEQ ID NO: 8245 - DNA, 396 bp, synthetic construct
  misc_feature 1..396: note = Description of Artificial Sequence: Synthetic polynucleotide
  source 1..396: mol_type = other DNA
ggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgagg

SEQ ID NO: 8246 - DNA, 507 bp, synthetic construct
  misc_feature 1..507: note = Description of Artificial Sequence: Synthetic polynucleotide
  source 1..507: mol_type = other DNA
tgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgccggcagtgggggctgcggcggcggagggcacgggcccccgcttagcgtttttatttttttggtgtagttgtttttcgcgagtcgagatatttttgttagggaagaggagcgtttcggttgtttttttagagtttttt

SEQ ID NO: 8247 - DNA, 946 bp, synthetic construct
  misc_feature 1..946: note = Description of Artificial Sequence: Synthetic polynucleotide
  source 1..946: mol_type = other DNA
cgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgttttggcggcagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggaga

SEQ ID NO: 8248 - DNA, 390 bp, synthetic construct
  misc_feature 1..390: note = Description of Artificial Sequence: Synthetic polynucleotide
  source 1..390: mol_type = other DNA
cggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagtttt

SEQ ID NO: 8249 - DNA, 440 bp, synthetic construct
  misc_feature 1..440: note = Description of Artificial Sequence: Synthetic polynucleotide
  source 1..440: mol_type = other DNA
ttggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttatag

SEQ ID NO: 8250 - DNA, 324 bp, synthetic construct
  misc_feature 1..324: note = Description of Artificial Sequence: Synthetic polynucleotide
  source 1..324: mol_type = other DNA
aattttagtattcggttgtattttcggcggtttttttagttatttgaggatagtatagggggtgagatggggtggtggttggtgaacgttggttactttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagttttt

SEQ ID NO: 8251 - DNA, 355 bp, Homo sapiens
  source 1..355: mol_type = unassigned DNA
cctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcga

SEQ ID NO: 8252 - DNA, 730 bp, Homo sapiens
  source 1..730: mol_type = unassigned DNA
gctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcag

SEQ ID NO: 8253 - DNA, 383 bp, Homo sapiens
  source 1..383: mol_type = unassigned DNA
ctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgct

SEQ ID NO: 8254 - DNA, 349 bp, Homo sapiens
  source 1..349: mol_type = unassigned DNA
aaaagtgagggaagatagggcagccgggattccctggactggagctctcttctctagagctaacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtct

SEQ ID NO: 8255 - DNA, 465 bp, Homo sapiens
  source 1..465: mol_type = unassigned DNA
ggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcgg

SEQ ID NO: 8256 - DNA, 424 bp, Homo sapiens
  source 1..424: mol_type = unassigned DNA
gggctgggaccgcggggtgggcggggtccgggctgggtccgtggggtgggcggggtccgggctgggaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccaccagaggcccaggggtccctctctgtgggtcactcgtgcgtcacctctgtgt

SEQ ID NO: 8257 - DNA, 540 bp, Homo sapiens
  source 1..540: mol_type = unassigned DNA
gcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgt

SEQ ID NO: 8258 - DNA, 472 bp, Homo sapiens
  source 1..472: mol_type = unassigned DNA
cctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccacactgcactttagaactagagtttggcttttaagacatgggattaaaaaga

SEQ ID NO: 8259 - DNA, 396 bp, Homo sapiens
  source 1..396: mol_type = unassigned DNA
cctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactcccc

SEQ ID NO: 8260 - DNA, 507 bp, Homo sapiens
  source 1..507: mol_type = unassigned DNA
aggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtca

SEQ ID NO: 8261 - DNA, 946 bp, Homo sapiens
  source 1..946: mol_type = unassigned DNA
tctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcg

SEQ ID NO: 8262 - DNA, 390 bp, Homo sapiens
  source 1..390: mol_type = unassigned DNA
ggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccg

SEQ ID NO: 8263 - DNA, 440 bp, Homo sapiens
  source 1..440: mol_type = unassigned DNA
ctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccag

SEQ ID NO: 8264 - DNA, 324 bp, Homo sapiens
  source 1..324: mol_type = unassigned DNA
gagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaatt

SEQ ID NO: 8265 - DNA, 355 bp, synthetic construct
  misc_feature 1..355: note = Description of Artificial Sequence: Synthetic polynucleotide
  source 1..355: mol_type = other DNA
tttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttyga

SEQ ID NO: 8266 - DNA, 730 bp, synthetic construct
  misc_feature 1..730: note = Description of Artificial Sequence: Synthetic polynucleotide
  source 1..730: mol_type = other DNA
gttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtag

SEQ ID NO: 8267 - DNA, 383 bp, synthetic construct
  misc_feature 1..383: note = Description of Artificial Sequence: Synthetic polynucleotide
  source 1..383: mol_type = other DNA
tttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygtt

SEQ ID NO: 8268 - DNA, 349 bp, synthetic construct
  misc_feature 1..349: note = Description of Artificial Sequence: Synthetic polynucleotide
  source 1..349: mol_type = other DNA
aaaagtgagggaagatagggtagtygggattttttggattggagtttttttttttagagttaattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttt

SEQ ID NO: 8269 - DNA, 465 bp, synthetic construct
  misc_feature 1..465: note = Description of Artificial Sequence: Synthetic polynucleotide
  source 1..465: mol_type = other DNA
ggaaatagaggttttgggagttttygtttgaagttattygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgygg

SEQ ID NO: 8270 - DNA, 424 bp, synthetic construct
  misc_feature 1..424: note = Description of Artificial Sequence: Synthetic polynucleotide
  source 1..424: mol_type = other DNA
gggttgggatygyggggtgggyggggttygggttgggttygtggggtgggyggggttygggttgggatygyggggtgggyggtttygagagygtttygtagtggttggagttttgggygttgtaaagygtgtttygtygggttttygagygtttygygttttygtttygttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttattagaggtttaggggtttttttttgtgggttattygtgygttatttttgtgt

SEQ ID NO: 8271 - DNA, 540 bp, synthetic construct
  misc_feature 1..540: note = Description of Artificial Sequence: Synthetic polynucleotide
  source 1..540: mol_type = other DNA
gygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygtttygyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygt

SEQ ID NO: 8272 - DNA, 472 bp, synthetic construct
  misc_feature 1..472: note = Description of Artificial Sequence: Synthetic polynucleotide
  source 1..472: mol_type = other DNA
ttttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttatattgtattttagaattagagtttggtttttaagatatgggattaaaaaga

SEQ ID NO: 8273 - DNA, 396 bp, synthetic construct
  misc_feature 1..396: note = Description of Artificial Sequence: Synthetic polynucleotide
  source 1..396: mol_type = other DNA
ttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttt

SEQ ID NO: 8274 - DNA, 507 bp, synthetic construct
  misc_feature 1..507: note = Description of Artificial Sequence: Synthetic polynucleotide
  source 1..507: mol_type = other DNA
aggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagtta

SEQ ID NO: 8275 - DNA, 946 bp, synthetic construct
  misc_feature 1..946: note = Description of Artificial Sequence: Synthetic polynucleotide
  source 1..946: mol_type = other DNA
ttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyg

SEQ ID NO: 8276 - DNA, 390 bp, synthetic construct
  misc_feature 1..390: note = Description of Artificial Sequence: Synthetic polynucleotide
  source 1..390: mol_type = other DNA
ggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttyg

SEQ ID NO: 8277 - DNA, 440 bp, synthetic construct
  misc_feature 1..440: note = Description of Artificial Sequence: Synthetic polynucleotide
  source 1..440: mol_type = other DNA
ttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattag

SEQ ID NO: 8278 - DNA, 324 bp, synthetic construct
  misc_feature 1..324: note = Description of Artificial Sequence: Synthetic polynucleotide
  source 1..324: mol_type = other DNA
gagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatt

SEQ ID NO: 8279 - DNA, 355 bp, synthetic construct
  misc_feature 1..355: note = Description of Artificial Sequence: Synthetic polynucleotide
  source 1..355: mol_type = other DNA
tttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcga

SEQ ID NO: 8280 - DNA, 730 bp, synthetic construct
  misc_feature 1..730: note = Description of Artificial Sequence: Synthetic polynucleotide
  source 1..730: mol_type = other DNA
gttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtag

SEQ ID NO: 8281 - DNA, 383 bp, synthetic construct
  misc_feature 1..383: note = Description of Artificial Sequence: Synthetic polynucleotide
  source 1..383: mol_type = other DNA
tttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgtt

SEQ ID NO: 8282 - DNA, 349 bp, synthetic construct
  misc_feature 1..349: note = Description of Artificial Sequence: Synthetic polynucleotide
  source 1..349: mol_type = other DNA
aaaagtgagggaagatagggtagtcgggattttttggattggagtttttttttttagagttaattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttt

SEQ ID NO: 8283 - DNA, 465 bp, synthetic construct
  misc_feature 1..465: note = Description of Artificial Sequence: Synthetic polynucleotide
  source 1..465: mol_type = other DNA
ggaaatagaggttttgggagttttcgtttgaagttattcgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcgg

SEQ ID NO: 8284 - DNA, 424 bp, synthetic construct
  misc_feature 1..424: note = Description of Artificial Sequence: Synthetic polynucleotide
  source 1..424: mol_type = other DNA
gggttgggatcgcggggtgggcggggttcgggttgggttcgtggggtgggcggggttcgggttgggatcgcggggtgggcggtttcgagagcgtttcgtagtggttggagttttgggcgttgtaaagcgtgtttcgtcgggttttcgagcgtttcgcgttttcgtttcgttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttattagaggtttaggggtttttttttgtgggttattcgtgcgttatttttgtgt

SEQ ID NO: 8285 - DNA, 540 bp, synthetic construct
  misc_feature 1..540: note = Description of Artificial Sequence: Synthetic polynucleotide
  source 1..540: mol_type = other DNA
gcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgtttcgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgt

SEQ ID NO: 8286 - DNA, 472 bp, synthetic construct
  misc_feature 1..472: note = Description of Artificial Sequence: Synthetic polynucleotide
  source 1..472: mol_type = other DNA
ttttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttatattgtattttagaattagagtttggtttttaagatatgggattaaaaaga

SEQ ID NO: 8287 - DNA, 396 bp, synthetic construct
  misc_feature 1..396: note = Description of Artificial Sequence: Synthetic polynucleotide
  source 1..396: mol_type = other DNA
ttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttt

SEQ ID NO: 8288 - DNA, 507 bp, synthetic construct
  misc_feature 1..507: note = Description of Artificial Sequence: Synthetic polynucleotide
  source 1..507: mol_type = other DNA
aggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagtta

SEQ ID NO: 8289 - DNA, 946 bp, synthetic construct
  misc_feature 1..946: note = Description of Artificial Sequence: Synthetic polynucleotide
  source 1..946: mol_type = other DNA
ttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcg

SEQ ID NO: 8290 - DNA, 390 bp, synthetic construct
  misc_feature 1..390: note = Description of Artificial Sequence: Synthetic polynucleotide
  source 1..390: mol_type = other DNA
ggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcg

SEQ ID NO: 8291 - DNA, 440 bp, synthetic construct
  misc_feature 1..440: note = Description of Artificial Sequence: Synthetic polynucleotide
  source 1..440: mol_type = other DNA
ttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattag

SEQ ID NO: 8292 - DNA, 324 bp, synthetic construct
  misc_feature 1..324: note = Description of Artificial Sequence: Synthetic polynucleotide
  source 1..324: mol_type = other DNA
gagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatt

SEQ ID NO: 8293 - DNA, 265 bp, Homo sapiens
  source 1..265: mol_type = unassigned DNA
ttagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggt

SEQ ID NO: 8294 - DNA, 235 bp, Homo sapiens
  source 1..235: mol_type = unassigned DNA
tcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacac

SEQ ID NO: 8295 - DNA, 270 bp, Homo sapiens
  source 1..270: mol_type = unassigned DNA
gtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttgga

SEQ ID NO: 8296 - DNA, 270 bp, Homo sapiens
  source 1..270: mol_type = unassigned DNA
tgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagtt

SEQ ID NO: 8297 - DNA, 149 bp, Homo sapiens
  source 1..149: mol_type = unassigned DNA
gggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccggg

SEQ ID NO: 8298 - DNA, 232 bp, Homo sapiens
  source 1..232: mol_type = unassigned DNA
cccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 8299 - DNA, 189 bp, Homo sapiens
  source 1..189: mol_type = unassigned DNA
tggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgc

SEQ ID NO: 8300 - DNA, 260 bp, Homo sapiens
  source 1..260: mol_type = unassigned DNA
gccaaactctagttctaaagtgcagtgtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactg

SEQ ID NO: 8301 - DNA, 187 bp, Homo sapiens
  source 1..187: mol_type = unassigned DNA
aggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaag

SEQ ID NO: 8302 - DNA, 249 bp, Homo sapiens
  source 1..249: mol_type = unassigned DNA
cacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggc

SEQ ID NO: 8303 - DNA, 196 bp, Homo sapiens
  source 1..196: mol_type = unassigned DNA
gccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccgg

SEQ ID NO: 8304 - DNA, 176 bp, Homo sapiens
  source 1..176: mol_type = unassigned DNA
gcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcggg

SEQ ID NO: 8305 - DNA, 152 bp, Homo sapiens
  source 1..152: mol_type = unassigned DNA
aaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggaccc

SEQ ID NO: 8306 - DNA, 232 bp, Homo sapiens
  source 1..232: mol_type = unassigned DNA
ctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgc

SEQ ID NO: 8307 - DNA, 265 bp, synthetic construct
  misc_feature 1..265: note = Description of Artificial Sequence: Synthetic polynucleotide
  source 1..265: mol_type = other DNA
ttagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggt

SEQ ID NO: 8308 - DNA, 235 bp, synthetic construct
  misc_feature 1..235: note = Description of Artificial Sequence: Synthetic polynucleotide
  source 1..235: mol_type = other DNA
ttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggatat

SEQ ID NO: 8309 - DNA, 270 bp, synthetic construct
  misc_feature 1..270: note = Description of Artificial Sequence: Synthetic polynucleotide
  source 1..270: mol_type = other DNA
gtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttgga

SEQ ID NO: 8310 - DNA, 270 bp, synthetic construct
  misc_feature 1..270: note = Description of Artificial Sequence: Synthetic polynucleotide
  source 1..270: mol_type = other DNA
tgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagtt

SEQ ID NO: 8311 - DNA, 149 bp, synthetic construct
  misc_feature 1..149: note = Description of Artificial Sequence: Synthetic polynucleotide
  source 1..149: mol_type = other DNA
gggygttaggttttgggtttttgggygaagtygaygttagaatatgtttggtttygtatttagtttatygtatttttagygygygtgggtggggggygtyggttgaggtggggagggtatagtttagttttaggttatagtgtttyggg

SEQ ID NO: 8312 - DNA, 232 bp, synthetic construct
  misc_feature 1..232: note = Description of Artificial Sequence: Synthetic polynucleotide
  source 1..232: mol_type = other DNA
tttatagagagggatttttgggtttttggtgggggtttgggagayggtygaagggggttygggtagaagtttygyggtygggtyggyggagggaagggggyggtygygttygggattyggtttttttyggttttatttatttgtttygaagagtggttttagttttgygtttttttttgygattttatatatagggatagttttaggtatagttttagtagtaggagtatgg

SEQ ID NO: 8313 - DNA, 189 bp, synthetic construct
  misc_feature 1..189: note = Description of Artificial Sequence: Synthetic polynucleotide
  source 1..189: mol_type = other DNA
tggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgt

SEQ ID NO: 8314 - DNA, 260 bp, synthetic construct
  misc_feature 1..260: note = Description of Artificial Sequence: Synthetic polynucleotide
  source 1..260: mol_type = other DNA
gttaaattttagttttaaagtgtagtgtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattg

SEQ ID NO: 8315 - DNA, 187 bp, synthetic construct
  misc_feature 1..187: note = Description of Artificial Sequence: Synthetic polynucleotide
  source 1..187: mol_type = other DNA
aggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaag

SEQ ID NO: 8316 - DNA, 249 bp, synthetic construct
  misc_feature 1..249: note = Description of Artificial Sequence: Synthetic polynucleotide
  source 1..249: mol_type = other DNA
tatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggt

SEQ ID NO: 8317 - DNA, 196 bp, synthetic construct
  misc_feature 1..196: note = Description of Artificial Sequence: Synthetic polynucleotide
  source 1..196: mol_type = other DNA
gtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtygg

SEQ ID NO: 8318 - DNA, 176 bp, synthetic construct
  misc_feature 1..176: note = Description of Artificial Sequence: Synthetic polynucleotide
  source 1..176: mol_type = other DNA
gygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagyggg

SEQ ID NO: 8319 - DNA, 152 bp, synthetic construct
  misc_feature 1..152: note = Description of Artificial Sequence: Synthetic polynucleotide
  source 1..152: mol_type = other DNA
aaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattt

SEQ ID NO: 8320 - DNA, 232 bp, synthetic construct
  misc_feature 1..232: note = Description of Artificial Sequence: Synthetic polynucleotide
  source 1..232: mol_type = other DNA
ttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgt

SEQ ID NO: 8321 - DNA, 265 bp, synthetic construct
  misc_feature 1..265: note = Description of Artificial Sequence: Synthetic polynucleotide
  source 1..265: mol_type = other DNA
ttagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggt

SEQ ID NO: 8322 - DNA, 235 bp, synthetic construct
  misc_feature 1..235: note = Description of Artificial Sequence: Synthetic polynucleotide
  source 1..235: mol_type = other DNA
ttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatat

SEQ ID NO: 8323 - DNA, 270 bp, synthetic construct
  misc_feature 1..270: note = Description of Artificial Sequence: Synthetic polynucleotide
  source 1..270: mol_type = other DNA
gtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttgga

SEQ ID NO: 8324 - DNA, 270 bp, synthetic construct
  misc_feature 1..270: note = Description of Artificial Sequence: Synthetic polynucleotide
  source 1..270: mol_type = other DNA
tgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagtt

SEQ ID NO: 8325 - DNA, 149 bp, synthetic construct
  misc_feature 1..149: note = Description of Artificial Sequence: Synthetic polynucleotide
  source 1..149: mol_type = other DNA
gggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcggg

SEQ ID NO: 8326 - DNA, 232 bp, synthetic construct
  misc_feature 1..232: note = Description of Artificial Sequence: Synthetic polynucleotide
  source 1..232: mol_type = other DNA
tttatagagagggatttttgggtttttggtgggggtttgggagacggtcgaagggggttcgggtagaagtttcgcggtcgggtcggcggagggaagggggcggtcgcgttcgggattcggtttttttcggttttatttatttgtttcgaagagtggttttagttttgcgtttttttttgcgattttatatatagggatagttttaggtatagttttagtagtaggagtatgg

SEQ ID NO: 8327 - DNA, 189 bp, synthetic construct
  misc_feature 1..189: note = Description of Artificial Sequence: Synthetic polynucleotide
  source 1..189: mol_type = other DNA
tggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgt

SEQ ID NO: 8328 - DNA, 260 bp, synthetic construct
  misc_feature 1..260: note = Description of Artificial Sequence: Synthetic polynucleotide
  source 1..260: mol_type = other DNA
gttaaattttagttttaaagtgtagtgtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattg

SEQ ID NO: 8329 - DNA, 187 bp, synthetic construct
  misc_feature 1..187: note = Description of Artificial Sequence: Synthetic polynucleotide
  source 1..187: mol_type = other DNA
aggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaag

SEQ ID NO: 8330 - DNA, 249 bp, synthetic construct
  misc_feature 1..249: note = Description of Artificial Sequence: Synthetic polynucleotide
  source 1..249: mol_type = other DNA
tatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggt

SEQ ID NO: 8331 - DNA, 196 bp, synthetic construct
  misc_feature 1..196: note = Description of Artificial Sequence: Synthetic polynucleotide
  source 1..196: mol_type = other DNA
gtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcgg

SEQ ID NO: 8332 - DNA, 176 bp, synthetic construct
  misc_feature 1..176: note = Description of Artificial Sequence: Synthetic polynucleotide
  source 1..176: mol_type = other DNA
gcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcggg

SEQ ID NO: 8333 - DNA, 152 bp, synthetic construct
  misc_feature 1..152: note = Description of Artificial Sequence: Synthetic polynucleotide
  source 1..152: mol_type = other DNA
aaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattt

SEQ ID NO: 8334 - DNA, 232 bp, synthetic construct
  misc_feature 1..232: note = Description of Artificial Sequence: Synthetic polynucleotide
  source 1..232: mol_type = other DNA
ttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgt

SEQ ID NO: 8335 - DNA, 265 bp, Homo sapiens
  source 1..265: mol_type = unassigned DNA
accgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaa

SEQ ID NO: 8336 - DNA, 235 bp, Homo sapiens
  source 1..235: mol_type = unassigned DNA
gtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctga

SEQ ID NO: 8337 - DNA, 270 bp, Homo sapiens
  source 1..270: mol_type = unassigned DNA
tccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgac

SEQ ID NO: 8338 - DNA, 270 bp, Homo sapiens
  source 1..270: mol_type = unassigned DNA
aacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgccca

SEQ ID NO: 8339 - DNA, 149 bp, Homo sapiens
  source 1..149: mol_type = unassigned DNA
cccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgccc

SEQ ID NO: 8340 - DNA, 232 bp, Homo sapiens
  source 1..232: mol_type = unassigned DNA
ccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccaccagaggcccaggggtccctctctgtggg

SEQ ID NO: 8341 - DNA, 189 bp, Homo sapiens
  source 1..189: mol_type = unassigned DNA
gcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatcca

SEQ ID NO: 8342 - DNA, 260 bp, Homo sapiens
  source 1..260: mol_type = unassigned DNA
cagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccacactgcactttagaactagagtttggc

SEQ ID NO: 8343 - DNA, 187 bp, Homo sapiens
  source 1..187: mol_type = unassigned DNA
cttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcct

SEQ ID NO: 8344 - DNA, 249 bp, Homo sapiens
  source 1..249: mol_type = unassigned DNA
gcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtg

SEQ ID NO: 8345 - DNA, 196 bp, Homo sapiens
  source 1..196: mol_type = unassigned DNA
ccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggc

SEQ ID NO: 8346 - DNA, 176 bp, Homo sapiens
  source 1..176: mol_type = unassigned DNA
cccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgc

SEQ ID NO: 8347 - DNA, 152 bp, Homo sapiens
  source 1..152: mol_type = unassigned DNA
gggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagcttt

SEQ ID NO: 8348 - DNA, 232 bp, Homo sapiens
  source 1..232: mol_type = unassigned DNA
gcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtag

SEQ ID NO: 8349 - DNA, 265 bp, synthetic construct
  misc_feature 1..265: note = Description of Artificial Sequence: Synthetic polynucleotide
  source 1..265: mol_type = other DNA
atygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaa

SEQ ID NO: 8350 - DNA, 235 bp, synthetic construct
  misc_feature 1..235: note = Description of Artificial Sequence: Synthetic polynucleotide
  source 1..235: mol_type = other DNA
gtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttga

SEQ ID NO: 8351 - DNA, 270 bp, synthetic construct
  misc_feature 1..270: note = Description of Artificial Sequence: Synthetic polynucleotide
  source 1..270: mol_type = other DNA
tttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygat

SEQ ID NO: 8352 - DNA, 270 bp, synthetic construct
  misc_feature 1..270: note = Description of Artificial Sequence: Synthetic polynucleotide
  source 1..270: mol_type = other DNA
aattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgttta

SEQ ID NO: 8353 - DNA, 149 bp, synthetic construct
  misc_feature 1..149: note = Description of Artificial Sequence: Synthetic polynucleotide
  source 1..149: mol_type = other DNA
ttyggggtattatggtttggggttggattatgttttttttattttagtyggygttttttatttaygygygttgagggtgyggtgagttgagtgyggggttaagtatgttttggygtygatttygtttaggggtttaggatttggygttt

SEQ ID NO: 8354 - DNA, 232 bp, synthetic construct
  misc_feature 1..232: note = Description of Artificial Sequence: Synthetic polynucleotide
  source 1..232: mol_type = other DNA
ttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttattagaggtttaggggtttttttttgtggg

SEQ ID NO: 8355 - DNA, 189 bp, synthetic construct
  misc_feature 1..189: note = Description of Artificial Sequence: Synthetic polynucleotide
  source 1..189: mol_type = other DNA
gtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatattta

SEQ ID NO: 8356 - DNA, 260 bp, synthetic construct
  misc_feature 1..260: note = Description of Artificial Sequence: Synthetic polynucleotide
  source 1..260: mol_type = other DNA
tagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttatattgtattttagaattagagtttggt

SEQ ID NO: 8357 - DNA, 187 bp, synthetic construct
  misc_feature 1..187: note = Description of Artificial Sequence: Synthetic polynucleotide
  source 1..187: mol_type = other DNA
tttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggtttttt

SEQ ID NO: 8358 - DNA, 249 bp, synthetic construct
  misc_feature 1..249: note = Description of Artificial Sequence: Synthetic polynucleotide
  source 1..249: mol_type = other DNA
gtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtg

SEQ ID NO: 8359 - DNA, 196 bp, synthetic construct
  misc_feature 1..196: note = Description of Artificial Sequence: Synthetic polynucleotide
  source 1..196: mol_type = other DNA
tyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggt

SEQ ID NO: 8360 - DNA, 176 bp, synthetic construct
  misc_feature 1..176: note = Description of Artificial Sequence: Synthetic polynucleotide
  source 1..176: mol_type = other DNA
ttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygt

SEQ ID NO: 8361 - DNA, 152 bp, synthetic construct
  misc_feature 1..152: note = Description of Artificial Sequence: Synthetic polynucleotide
  source 1..152: mol_type = other DNA
gggttttttttaagtagttgtttyggtttyggatttttatttgatttttttaatygatttggtagggtaygtatatttgaygtttattttgtagtygagtatataaggttygtygaagttatygagtaggttttgtagttgtaggtagtttt

SEQ ID NO: 8362 - DNA, 232 bp, synthetic construct
  misc_feature 1..232: note = Description of Artificial Sequence: Synthetic polynucleotide
  source 1..232: mol_type = other DNA
gtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtag

SEQ ID NO: 8363 - DNA, 265 bp, synthetic construct
  misc_feature 1..265: note = Description of Artificial Sequence: Synthetic polynucleotide
  source 1..265: mol_type = other DNA
atcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaa

SEQ ID NO: 8364 - DNA, 235 bp, synthetic construct
  misc_feature 1..235: note = Description of Artificial Sequence: Synthetic polynucleotide
  source 1..235: mol_type = other DNA
gtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttga

SEQ ID NO: 8365 - DNA, 270 bp, synthetic construct
  misc_feature 1..270: note = Description of Artificial Sequence: Synthetic polynucleotide
  source 1..270: mol_type = other DNA
tttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgat

SEQ ID NO: 8366 - DNA, 270 bp, synthetic construct
  misc_feature 1..270: note = Description of Artificial Sequence: Synthetic polynucleotide
  source 1..270: mol_type = other DNA
aattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgttta

SEQ ID NO: 8367 - DNA, 149 bp, synthetic construct
  misc_feature 1..149: note = Description of Artificial Sequence: Synthetic polynucleotide
  source 1..149: mol_type = other DNA
ttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgttt

SEQ ID NO: 8368 - DNA, 232 bp, synthetic construct
  misc_feature 1..232: note = Description of Artificial Sequence: Synthetic polynucleotide
  source 1..232: mol_type = other DNA
ttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttattagaggtttaggggtttttttttgtggg

SEQ ID NO: 8369 - DNA, 189 bp, synthetic construct
  misc_feature 1..189: note = Description of Artificial Sequence: Synthetic polynucleotide
  source 1..189: mol_type = other DNA
gtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatattta

SEQ ID NO: 8370 - DNA, 260 bp, synthetic construct
  misc_feature 1..260: note = Description of Artificial Sequence: Synthetic polynucleotide
  source 1..260: mol_type = other DNA
tagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttatattgtattttagaattagagtttggt

SEQ ID NO: 8371 - DNA, 187 bp, synthetic construct
  misc_feature 1..187: note = Description of Artificial Sequence: Synthetic polynucleotide
  source 1..187: mol_type = other DNA
tttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggtttttt

SEQ ID NO: 8372 - DNA, 249 bp, synthetic construct
  misc_feature 1..249: note = Description of Artificial Sequence: Synthetic polynucleotide
  source 1..249: mol_type = other DNA
gtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtg

SEQ ID NO: 8373 - DNA, 196 bp, synthetic construct
  misc_feature 1..196: note = Description of Artificial Sequence: Synthetic polynucleotide
  source 1..196: mol_type = other DNA
tcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggt

SEQ ID NO: 8374 - DNA, 176 bp, synthetic construct
  misc_feature 1..176: note = Description of Artificial Sequence: Synthetic polynucleotide
  source 1..176: mol_type = other DNA
ttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgt

SEQ ID NO: 8375 - DNA, 152 bp, synthetic construct
  misc_feature 1..152: note = Description of Artificial Sequence: Synthetic polynucleotide
  source 1..152: mol_type = other DNA
gggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagtttt

SEQ ID NO: 8376 - DNA, 232 bp, synthetic construct
  misc_feature 1..232: note = Description of Artificial Sequence: Synthetic polynucleotide
  source 1..232: mol_type = other DNA
gtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtag

SEQ ID NO: 8377 - DNA, 28 bp, synthetic construct
  misc_feature 1..28: note = Description of Artificial Sequence: Synthetic primer
  source 1..28: mol_type = other DNA
ttagattgygtttagtatagtagatggt

SEQ ID NO: 8378 - DNA, 24 bp, synthetic construct
  misc_feature 1..24: note = Description of Artificial Sequence: Synthetic primer
  source 1..24: mol_type = other DNA
ttaggtygggaggggttaggatag

SEQ ID NO: 8379 - DNA, 25 bp, synthetic construct
  misc_feature 1..25: note = Description of Artificial Sequence: Synthetic primer
  source 1..25: mol_type = other DNA
gtygtagattttggttagtggtatt

SEQ ID NO: 8380 - DNA, 22 bp, synthetic construct
  misc_feature 1..22: note = Description of Artificial Sequence: Synthetic primer
  source 1..22: mol_type = other DNA
tgggtaygttggagtttttggt

SEQ ID NO: 8381 - DNA, 22 bp, synthetic construct
  misc_feature 1..22: note = Description of Artificial Sequence: Synthetic primer
  source 1..22: mol_type = other DNA
gggygttaggttttgggttttt

SEQ ID NO: 8382 - DNA, 29 bp, synthetic construct
  misc_feature 1..29: note = Description of Artificial Sequence: Synthetic primer
  source 1..29: mol_type = other DNA
tttatagagagggatttttgggtttttgg

SEQ ID NO: 8383 - DNA, 32 bp, synthetic construct
  misc_feature 1..32: note = Description of Artificial Sequence: Synthetic primer
  source 1..32: mol_type = other DNA
ggatattgttatttattttaagattgttgttt

SEQ ID NO: 8384 - DNA, 31 bp, synthetic construct
  misc_feature 1..31: note = Description of Artificial Sequence: Synthetic primer
  source 1..31: mol_type = other DNA
gttaaattttagttttaaagtgtagtgtggt

SEQ ID NO: 8385 - DNA, 25 bp, synthetic construct
  misc_feature 1..25: note = Description of Artificial Sequence: Synthetic primer
  source 1..25: mol_type = other DNA
aggaggtyggaatttttgtttttat

SEQ ID NO: 8386 - DNA, 22 bp, synthetic construct
  misc_feature 1..22: note = Description of Artificial Sequence: Synthetic primer
  source 1..22: mol_type = other DNA
tatttygggaggtttaggggta

SEQ ID NO: 8387 - DNA, 22 bp, synthetic construct
  misc_feature 1..22: note = Description of Artificial Sequence: Synthetic primer
  source 1..22: mol_type = other DNA
gtygtttttagggttgttggtt

SEQ ID NO: 8388 - DNA, 22 bp, synthetic construct
  misc_feature 1..22: note = Description of Artificial Sequence: Synthetic primer
  source 1..22: mol_type = other DNA
gygattgtatttggggtagttt

SEQ ID NO: 8389 - DNA, 28 bp, synthetic construct
  misc_feature 1..28: note = Description of Artificial Sequence: Synthetic primer
  source 1..28: mol_type = other DNA
aaagttatttgtagttgtaggatttgtt

SEQ ID NO: 8390 - DNA, 27 bp, synthetic construct
  misc_feature 1..27: note = Description of Artificial Sequence: Synthetic primer
  source 1..27: mol_type = other DNA
ttatttgaggatagtatagggggtgag

SEQ ID NO: 8391 - DNA, 24 bp, synthetic construct
  misc_feature 1..24: note = Description of Artificial Sequence: Synthetic primer
  source 1..24: mol_type = other DNA
accraaaacccaaaaccctaccaa

SEQ ID NO: 8392 - DNA, 33 bp, synthetic construct
  misc_feature 1..33: note = Description of Artificial Sequence: Synthetic primer
  source 1..33: mol_type = other DNA
atatcctttcataaatctcatttataattaaaa

SEQ ID NO: 8393 - DNA, 33 bp, synthetic construct
  misc_feature 1..33: note = Description of Artificial Sequence: Synthetic primer
  source 1..33: mol_type = other DNA
tccaactacaataacaaaatctaaaaattaaaa

SEQ ID NO: 8394 - DNA, 30 bp, synthetic construct
  misc_feature 1..30: note = Description of Artificial Sequence: Synthetic primer
  source 1..30: mol_type = other DNA
aacttttcaaacctaaaaatctccaaaacc

SEQ ID NO: 8395 - DNA, 34 bp, synthetic construct
  misc_feature 1..34: note = Description of Artificial Sequence: Synthetic primer
  source 1..34: mol_type = other DNA
cccraaacactataacctaaaactaaactatacc

SEQ ID NO: 8396 - DNA, 36 bp, synthetic construct
  misc_feature 1..36: note = Description of Artificial Sequence: Synthetic primer
  source 1..36: mol_type = other DNA
ccatactcctactactaaaactatacctaaaactat

SEQ ID NO: 8397 - DNA, 36 bp, synthetic construct
  misc_feature 1..36: note = Description of Artificial Sequence: Synthetic primer
  source 1..36: mol_type = other DNA
acaacaataacaacaatataactattaataaatatt

SEQ ID NO: 8398 - DNA, 31 bp, synthetic construct
  misc_feature 1..31: note = Description of Artificial Sequence: Synthetic primer
  source 1..31: mol_type = other DNA
caatctctaccaaacttaaaaacaaactaaa

SEQ ID NO: 8399 - DNA, 22 bp, synthetic construct
  misc_feature 1..22: note = Description of Artificial Sequence: Synthetic primer
  source 1..22: mol_type = other DNA
cttcccraaacttactctaccc

SEQ ID NO: 8400 - DNA, 25 bp, synthetic construct
  misc_feature 1..25: note = Description of Artificial Sequence: Synthetic primer
  source 1..25: mol_type = other DNA
acccctaataaaaatcccaaaacac

SEQ ID NO: 8401 - DNA, 22 bp, synthetic construct
  misc_feature 1..22: note = Description of Artificial Sequence: Synthetic primer
  source 1..22: mol_type = other DNA
ccracaacccccaatactaaac

SEQ ID NO: 8402 - DNA, 22 bp, synthetic construct
  misc_feature 1..22: note = Description of Artificial Sequence: Synthetic primer
  source 1..22: mol_type = other DNA
cccrctcctaaaaaccctaact

SEQ ID NO: 8403 - DNA, 22 bp, synthetic construct
  misc_feature 1..22: note = Description of Artificial Sequence: Synthetic primer
  source 1..22: mol_type = other DNA
aaatccccctcaaacaactatc

SEQ ID NO: 8404 - DNA, 28 bp, synthetic construct
  misc_feature 1..28: note = Description of Artificial Sequence: Synthetic primer
  source 1..28: mol_type = other DNA
acaactatttaaaaactcccataatccc

SEQ ID NO: 8405 - DNA, 116 bp, Homo sapiens
  source 1..116: mol_type = unassigned DNA
agggacagccccaggcacagccccagcagcaggagcatggcggggcgagggcgcgggacgctcggggacccggcgggacacgctttgcagcgcccagggctccagccactgcggga

SEQ ID NO: 8406 - DNA, 272 bp, Homo sapiens
  source 1..272: mol_type = unassigned DNA
gggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcgga

SEQ ID NO: 8407 - DNA, 209 bp, Homo sapiens
  source 1..209: mol_type = unassigned DNA
agtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagc

SEQ ID NO: 8408 - DNA, 114 bp, Homo sapiens
  source 1..114: mol_type = unassigned DNA
ggcagcggcagagcagtggcagcagccgccactgccgctgttactgcggtcgccgccgctggagagaggaggacgaggagggcaaggggcagaagcaggtcctgctctgtctgc

SEQ ID NO: 8409 - DNA, 184 bp, Homo sapiens
  source 1..184: mol_type = unassigned DNA
gatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgct

SEQ ID NO: 8410 - DNA, 116 bp, synthetic construct
  misc_feature 1..116: note = Description of Artificial Sequence: Synthetic polynucleotide
  source 1..116: mol_type = other DNA
agggatagttttaggtatagttttagtagtaggagtatggyggggygagggygygggaygttyggggattyggygggataygttttgtagygtttagggttttagttattgyggga

SEQ ID NO: 8411 - DNA, 272 bp, synthetic construct
  misc_feature 1..272: note = Description of Artificial Sequence: Synthetic polynucleotide
  source 1..272: mol_type = other DNA
gggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgygga

SEQ ID NO: 8412 - DNA, 209 bp, synthetic construct
  misc_feature 1..209: note = Description of Artificial Sequence: Synthetic polynucleotide
  source 1..209: mol_type = other DNA
agtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagt

SEQ ID NO: 8413 - DNA, 114 bp, synthetic construct
  misc_feature 1..114: note = Description of Artificial Sequence: Synthetic polynucleotide
  source 1..114: mol_type = other DNA
ggtagyggtagagtagtggtagtagtygttattgtygttgttattgyggtygtygtygttggagagaggaggaygaggagggtaaggggtagaagtaggttttgttttgtttgt

SEQ ID NO: 8414 - DNA, 184 bp, synthetic construct
  misc_feature 1..184: note = Description of Artificial Sequence: Synthetic polynucleotide
  source 1..184: mol_type = other DNA
gatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgtt

SEQ ID NO: 8415 - DNA, 116 bp, synthetic construct
  misc_feature 1..116: note = Description of Artificial Sequence: Synthetic polynucleotide
  source 1..116: mol_type = other DNA
agggatagttttaggtatagttttagtagtaggagtatggcggggcgagggcgcgggacgttcggggattcggcgggatacgttttgtagcgtttagggttttagttattgcggga

SEQ ID NO: 8416 - DNA, 272 bp, synthetic construct
  misc_feature 1..272: note = Description of Artificial Sequence: Synthetic polynucleotide
  source 1..272: mol_type = other DNA
gggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcgga

SEQ ID NO: 8417 - DNA, 209 bp, synthetic construct
  misc_feature 1..209: note = Description of Artificial Sequence: Synthetic polynucleotide
  source 1..209: mol_type = other DNA
agtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagt

SEQ ID NO: 8418 - DNA, 114 bp, synthetic construct
  misc_feature 1..114: note = Description of Artificial Sequence: Synthetic polynucleotide
  source 1..114: mol_type = other DNA
ggtagcggtagagtagtggtagtagtcgttattgtcgttgttattgcggtcgtcgtcgttggagagaggaggacgaggagggtaaggggtagaagtaggttttgttttgtttgt

SEQ ID NO: 8419 - DNA, 184 bp, synthetic construct
  misc_feature 1..184: note = Description of Artificial Sequence: Synthetic polynucleotide
  source 1..184: mol_type = other DNA
gatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgtt

SEQ ID NO: 8420 - DNA, 116 bp, Homo sapiens
  source 1..116: mol_type = unassigned DNA
tcccgcagtggctggagccctgggcgctgcaaagcgtgtcccgccgggtccccgagcgtcccgcgccctcgccccgccatgctcctgctgctggggctgtgcctggggctgtccct

SEQ ID NO: 8421 - DNA, 272 bp, Homo sapiens
  source 1..272: mol_type = unassigned DNA
tccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccc

SEQ ID NO: 8422 - DNA, 209 bp, Homo sapiens
  source 1..209: mol_type = unassigned DNA
gctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacact

SEQ ID NO: 8423 - DNA, 114 bp, Homo sapiens
  source 1..114: mol_type = unassigned DNA
gcagacagagcaggacctgcttctgccccttgccctcctcgtcctcctctctccagcggcggcgaccgcagtaacagcggcagtggcggctgctgccactgctctgccgctgcc

SEQ ID NO: 8424 - DNA, 184 bp, Homo sapiens
  source 1..184: mol_type = unassigned DNA
agcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatc

SEQ ID NO: 8425 - DNA, 116 bp, synthetic construct
  misc_feature 1..116: note = Description of Artificial Sequence: Synthetic polynucleotide
  source 1..116: mol_type = other DNA
tttygtagtggttggagttttgggygttgtaaagygtgtttygtygggttttygagygtttygygttttygtttygttatgtttttgttgttggggttgtgtttggggttgttttt

SEQ ID NO: 8426 - DNA, 272 bp, synthetic construct
  misc_feature 1..272: note = Description of Artificial Sequence: Synthetic polynucleotide
  source 1..272: mol_type = other DNA
ttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggtttttttttt

SEQ ID NO: 8427 - DNA, 209 bp, synthetic construct
  misc_feature 1..209: note = Description of Artificial Sequence: Synthetic polynucleotide
  source 1..209: mol_type = other DNA
gttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatt

SEQ ID NO: 8428 - DNA, 114 bp, synthetic construct
  misc_feature 1..114: note = Description of Artificial Sequence: Synthetic polynucleotide
  source 1..114: mol_type = other DNA
gtagatagagtaggatttgtttttgttttttgtttttttygtttttttttttttagyggyggygatygtagtaatagyggtagtggyggttgttgttattgttttgtygttgtt

SEQ ID NO: 8429 - DNA, 184 bp, synthetic construct
  misc_feature 1..184: note = Description of Artificial Sequence: Synthetic polynucleotide
  source 1..184: mol_type = other DNA
agtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtatt

SEQ ID NO: 8430 - DNA, 116 bp, synthetic construct
  misc_feature 1..116: note = Description of Artificial Sequence: Synthetic polynucleotide
  source 1..116: mol_type = other DNA
tttcgtagtggttggagttttgggcgttgtaaagcgtgtttcgtcgggttttcgagcgtttcgcgttttcgtttcgttatgtttttgttgttggggttgtgtttggggttgttttt

SEQ ID NO: 8431 - DNA, 272 bp, synthetic construct
  misc_feature 1..272: note = Description of Artificial Sequence: Synthetic polynucleotide
  source 1..272: mol_type = other DNA
ttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggtttttttttt

SEQ ID NO: 8432 - DNA, 209 bp, synthetic construct
  misc_feature 1..209: note = Description of Artificial Sequence: Synthetic polynucleotide
  source 1..209: mol_type = other DNA
gttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatt

SEQ ID NO: 8433 - DNA, 114 bp, synthetic construct
  misc_feature 1..114: note = Description of Artificial Sequence: Synthetic polynucleotide
  source 1..114: mol_type = other DNA
gtagatagagtaggatttgtttttgttttttgtttttttcgtttttttttttttagcggcggcgatcgtagtaatagcggtagtggcggttgttgttattgttttgtcgttgtt

SEQ ID NO: 8434 - DNA, 184 bp, synthetic construct
  misc_feature 1..184: note = Description of Artificial Sequence: Synthetic polynucleotide
  source 1..184: mol_type = other DNA
agtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtatt

SEQ ID NO: 8435 - DNA, 30 bp, synthetic construct
  misc_feature 1..30: note = Description of Artificial Sequence: Synthetic primer
  source 1..30: mol_type = other DNA
agggatagttttaggtatagttttagtagt

SEQ ID NO: 8436 - DNA, 31 bp, synthetic construct
  misc_feature 1..31: note = Description of Artificial Sequence: Synthetic primer
  source 1..31: mol_type = other DNA
gggggaaaaatttaaattagattagaatttg

SEQ ID NO: 8437 - DNA, 25 bp, synthetic construct
  misc_feature 1..25: note = Description of Artificial Sequence: Synthetic primer
  source 1..25: mol_type = other DNA
agtgttttgggatttttattagggg

SEQ ID NO: 8438 - DNA, 25 bp, synthetic construct
  misc_feature 1..25: note = Description of Artificial Sequence: Synthetic primer
  source 1..25: mol_type = other DNA
ggtagyggtagagtagtggtagtag

SEQ ID NO: 8439 - DNA, 22 bp, synthetic construct
  misc_feature 1..22: note = Description of Artificial Sequence: Synthetic primer
  source 1..22: mol_type = other DNA
gatgtyggtttttagggagttt

SEQ ID NO: 8440 - DNA, 23 bp, synthetic construct
  misc_feature 1..23: note = Description of Artificial Sequence: Synthetic primer
  source 1..23: mol_type = other DNA
tcccrcaataactaaaaccctaa

SEQ ID NO: 8441 - DNA, 23 bp, synthetic construct
  misc_feature 1..23: note = Description of Artificial Sequence: Synthetic primer
  source 1..23: mol_type = other DNA
tccrcaactttaacaaatacctc

SEQ ID NO: 8442 - DNA, 25 bp, synthetic construct
  misc_feature 1..25: note = Description of Artificial Sequence: Synthetic primer
  source 1..25: mol_type = other DNA
actcctcttccctaacaaaaatatc

SEQ ID NO: 8443 - DNA, 27 bp, synthetic construct
  misc_feature 1..27: note = Description of Artificial Sequence: Synthetic primer
  source 1..27: mol_type = other DNA
acaaaacaaaacctacttctacccctt

SEQ ID NO: 8444 - DNA, 28 bp, synthetic construct
  misc_feature 1..28: note = Description of Artificial Sequence: Synthetic primer
  source 1..28: mol_type = other DNA
aacaaatcctacaactacaaataacttt

SEQ ID NO: 8445 - DNA, 22 bp, synthetic construct
  misc_feature 1..22: note = Description of Artificial Sequence: Synthetic primer
  source 1..22: mol_type = other DNA
ctcrtcctcctaccrcaaaata

SEQ ID NO: 8446 - DNA, 19 bp, synthetic construct
  misc_feature 1..19: note = Description of Artificial Sequence: Synthetic primer
  source 1..19: mol_type = other DNA
gttgtttaggttgtaggtg

SEQ ID NO: 8447 - DNA, 20 bp, Homo sapiens
  source 1..20: mol_type = unassigned DNA
cgtggtgcgcgcggcgggcg

SEQ ID NO: 8448 - DNA, 116 bp, Homo sapiens
  source 1..116: mol_type = unassigned DNA
cgagcgccgtgggcggggctccagggcggcggcgcctcgcggggagggtcctccgtgctgggggcgaggccacccgaggcagctccccgcccgcccccaaccccgccccgctctcg

SEQ ID NO: 8449-8458 - skipped (10 entries)

SEQ ID NO: 8459 - DNA, 44 bp, Homo sapiens
  source 1..44: mol_type = unassigned DNA
cgcgcgccccccgggccccgctcgcacccctcacgcgccccccg

SEQ ID NO: 8460-8469 - skipped (10 entries)

SEQ ID NO: 8470 - DNA, 34 bp, Homo sapiens
  source 1..34: mol_type = unassigned DNA
cgtctgctcggcggctctagaaggtcgggctgcg

SEQ ID NO: 8471-8480 - skipped (10 entries)

SEQ ID NO: 8481 - DNA, 211 bp, Homo sapiens
  source 1..211: mol_type = unassigned DNA
cgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcg

SEQ ID NO: 8482-8491 - skipped (10 entries)

SEQ ID NO: 8492 - DNA, 95 bp, Homo sapiens
  source 1..95: mol_type = unassigned DNA
cgggaaaaggggcgcggaagaggggcggggcgggccacggcgcgcagggcccttccctcccgcctcggactcaattaattgggcttgagcttccg

SEQ ID NO: 8493-8502 - skipped (10 entries)

SEQ ID NO: 8503 - DNA, 264 bp, Homo sapiens
  source 1..264: mol_type = unassigned DNA
cgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccg

SEQ ID NO: 8504-8513 - skipped (10 entries)

SEQ ID NO: 8514 - DNA, 59 bp, Homo sapiens
  source 1..59: mol_type = unassigned DNA
cgttccccgtcccggagctgccggcggcatgatccgacacgccggggcgcccgcgcgcg

SEQ ID NO: 8515-8535 - skipped (21 entries)

SEQ ID NO: 8536 - DNA, 324 bp, Homo sapiens
  source 1..324: mol_type = unassigned DNA
cggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcg

SEQ ID NO: 8537-8543 - skipped (7 entries)

SEQ ID NO: 8544 - DNA, 102 bp, Homo sapiens
  source 1..102: mol_type = unassigned DNA
cgttgagtccgcgctgaacaagattctctcgcagctctgcgtcccgcgccgggtgaaggggcgtgttcctgcaggcgctcggggctcggcctggagctggcg

SEQ ID NO: 8545 - DNA, 24 bp, Homo sapiens
  source 1..24: mol_type = unassigned DNA
cgcaacgactcgctgccgcccacg

SEQ ID NO: 8546 - DNA, 521 bp, Homo sapiens
  source 1..521: mol_type = unassigned DNA
cgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcg

SEQ ID NO: 8547 - DNA, 1484 bp, Homo sapiens
  source 1..1484: mol_type = unassigned DNA
cgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcg

SEQ ID NO: 8548 - DNA, 34 bp, Homo sapiens
  source 1..34: mol_type = unassigned DNA
cgcgtcgcccgctcccgctccccccgcctccccg

SEQ ID NO: 8549 - DNA, 14 bp, Homo sapiens
  source 1..14: mol_type = unassigned DNA
cggcgaggggctcg

SEQ ID NO: 8550 - DNA, 37 bp, Homo sapiens
  source 1..37: mol_type = unassigned DNA
cgtggcgcgcccactccacggtgctgaagagcagccg

SEQ ID NO: 8551 - DNA, 34 bp, Homo sapiens
  source 1..34: mol_type = unassigned DNA
cgggatttgtccgcttctttgtctttggctgccg

SEQ ID NO: 8552 - DNA, 538 bp, Homo sapiens
  source 1..538: mol_type = unassigned DNA
cgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccg

SEQ ID NO: 8553 - DNA, 109 bp, Homo sapiens
  source 1..109: mol_type = unassigned DNA
cggcgtccggagcgctggactacatttcccagaggcaccgctcccggagcgtagcttcatttccgttagtttgcgagatttggaggcctcgcgtggggagagggccgcg

SEQ ID NO: 8554 - DNA, 901 bp, Homo sapiens
  source 1..901: mol_type = unassigned DNA
cgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcg

SEQ ID NO: 8555 - DNA, 15 bp, Homo sapiens
  source 1..15: mol_type = unassigned DNA
cgggcggcgcgggcg

SEQ ID NO: 8556 - DNA, 383 bp, Homo sapiens
  source 1..383: mol_type = unassigned DNA
cgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcg

SEQ ID NO: 8557 - skipped

SEQ ID NO: 8558 - DNA, 624 bp, Homo sapiens
  source 1..624: mol_type = unassigned DNA
cgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcg

SEQ ID NO: 8559 - DNA, 94 bp, Homo sapiens
  source 1..94: mol_type = unassigned DNA
cgagatagccagcgagttcaggcggtccttgcagcgctgggagaggaatgtgcgcgaaatcaaccagagcgaaatcagccggaggagccggccg

SEQ ID NO: 8560 - DNA, 63 bp, Homo sapiens
  source 1..63: mol_type = unassigned DNA
cgtgcagggcgcagagctgggccgagccgtcgccggcgccacgcgagtcccgcagccgccgcg

SEQ ID NO: 8561 - DNA, 41 bp, Homo sapiens
  source 1..41: mol_type = unassigned DNA
cgccgcggcttctggggtccccgccctcttgtccgccatcg

SEQ ID NO: 8562 - DNA, 1041 bp, Homo sapiens
  source 1..1041: mol_type = unassigned DNA
cgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacg

SEQ ID NO: 8563 - DNA, 23 bp, Homo sapiens
  source 1..23: mol_type = unassigned DNA
cgccttcggctcgggccatggcg

SEQ ID NO: 8564 - DNA, 515 bp, Homo sapiens
  source 1..515: mol_type = unassigned DNA
cgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcg

SEQ ID NO: 8565 - DNA, 1017 bp, Homo sapiens
  source 1..1017: mol_type = unassigned DNA
cgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccg

SEQ ID NO: 8566 - skipped

SEQ ID NO: 8567 - DNA, 54 bp, Homo sapiens
  source 1..54: mol_type = unassigned DNA
cgagcgcaggcgggcggagagcagaccacgcggaagaggccgagagagaaagcg

SEQ ID NO: 8568 - DNA, 10 bp, Homo sapiens
  source 1..10: mol_type = unassigned DNA
cgcgttgtcg

SEQ ID NO: 8569 - DNA, 26 bp, Homo sapiens
  source 1..26: mol_type = unassigned DNA
cgggcaggttcgaccaggcggccgcg

SEQ ID NO: 8570 - DNA, 934 bp, Homo sapiens
  source 1..934: mol_type = unassigned DNA
cgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcg

SEQ ID NO: 8571 - DNA, 279 bp, Homo sapiens
  source 1..279: mol_type = unassigned DNA
cgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccg

SEQ ID NO: 8572-8573 - skipped (2 entries)

SEQ ID NO: 8574 - DNA, 11 bp, Homo sapiens
  source 1..11: mol_type = unassigned DNA
cgagcgcatcg

SEQ ID NO: 8575 - DNA, 30 bp, Homo sapiens
  source 1..30: mol_type = unassigned DNA
cgcttgtaatctcagctactcaggaggccg

SEQ ID NO: 8576 - DNA, 10 bp, Homo sapiens
  source 1..10: mol_type = unassigned DNA
cgctcccgcg

SEQ ID NO: 8577 - DNA, 56 bp, Homo sapiens
  source 1..56: mol_type = unassigned DNA
cggcgtctgatgagcggcgggcccggacacgaggggacggggccgatttgtgggcg

SEQ ID NO: 8578 - DNA, 98 bp, Homo sapiens
  source 1..98: mol_type = unassigned DNA
cggccagcagggcggggcaggaggctgggagagggacgggtgcgggggtgggggagaggaagggagcggtcacgtgtgaggggcggcccgaggtcacg

SEQ ID NO: 8579 - DNA, 33 bp, Homo sapiens
  source 1..33: mol_type = unassigned DNA
cgggaggacgcgcaggggcggccgccgccgtcg

SEQ ID NO: 8580 - DNA, 48 bp, Homo sapiens
  source 1..48: mol_type = unassigned DNA
cgtcccaccccctccaccacacacgcaccccccaccccaattccttcg

SEQ ID NO: 8581 - DNA, 93 bp, Homo sapiens
  source 1..93: mol_type = unassigned DNA
cgacctgccccggccgcacccgcctccgctccagcacgcgacgctgcccggcgcgacccctgctcccccggcccagccccaccgctgccctcg

SEQ ID NO: 8582-8588 - skipped (7 entries)

SEQ ID NO: 8589 - DNA, 42 bp, Homo sapiens
  source 1..42: mol_type = unassigned DNA
cggagcgaggcgcgcgcccggccagagagcgagcgcgcaacg

SEQ ID NO: 8590-8599 - skipped (10 entries)

SEQ ID NO: 8600 - DNA, 40 bp, Homo sapiens
  source 1..40: mol_type = unassigned DNA
cggcgcactggcgctgggagcagggccgcactccggcgcg

SEQ ID NO: 8601-8621 - skipped (21 entries)

SEQ ID NO: 8622 - DNA, 42 bp, Homo sapiens
  source 1..42: mol_type = unassigned DNA
cgggcgggcggcgttcggtctgagggagcggggcggtctccg

SEQ ID NO: 8623-8632 - skipped (10 entries)

SEQ ID NO: 8633 - DNA, 20 bp, Homo sapiens
  source 1..20: mol_type = unassigned DNA
cgcccgccgcgcgcaccacg

SEQ ID NO: 8634 - DNA, 116 bp, Homo sapiens
  source 1..116: mol_type = unassigned DNA
cgagagcggggcggggttgggggcgggcggggagctgcctcgggtggcctcgcccccagcacggaggaccctccccgcgaggcgccgccgccctggagccccgcccacggcgctcg

SEQ ID NO: 8635-8644 - skipped (10 entries)

SEQ ID NO: 8645 - DNA, 44 bp, Homo sapiens
  source 1..44: mol_type = unassigned DNA
cggggggcgcgtgaggggtgcgagcggggcccggggggcgcgcg

SEQ ID NO: 8646-8655 - skipped (10 entries)

SEQ ID NO: 8656 - DNA, 34 bp, Homo sapiens
  source 1..34: mol_type = unassigned DNA
cgcagcccgaccttctagagccgccgagcagacg

SEQ ID NO: 8657-8666 - skipped (10 entries)

SEQ ID NO: 8667 - DNA, 211 bp, Homo sapiens
  source 1..211: mol_type = unassigned DNA
cgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcg

SEQ ID NO: 8668-8677 - skipped (10 entries)

SEQ ID NO: 8678 - DNA, 95 bp, Homo sapiens
  source 1..95: mol_type = unassigned DNA
cggaagctcaagcccaattaattgagtccgaggcgggagggaagggccctgcgcgccgtggcccgccccgcccctcttccgcgccccttttcccg

SEQ ID NO: 8679-8688 - skipped (10 entries)

SEQ ID NO: 8689 - DNA, 264 bp, Homo sapiens
  source 1..264: mol_type = unassigned DNA
cggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccg

SEQ ID NO: 8690-8699 - skipped (10 entries)

SEQ ID NO: 8700 - DNA, 59 bp, Homo sapiens
  source 1..59: mol_type = unassigned DNA
cgcgcgcgggcgccccggcgtgtcggatcatgccgccggcagctccgggacggggaacg

SEQ ID NO: 8701-8721 - skipped (21 entries)

SEQ ID NO: 8722 - DNA, 324 bp, Homo sapiens
  source 1..324: mol_type = unassigned DNA
cgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccg

SEQ ID NO: 8723-8729 - skipped (7 entries)

SEQ ID NO: 8730 - DNA, 102 bp, Homo sapiens
  source 1..102: mol_type = unassigned DNA
cgccagctccaggccgagccccgagcgcctgcaggaacacgccccttcacccggcgcgggacgcagagctgcgagagaatcttgttcagcgcggactcaacg

SEQ ID NO: 8731 - DNA, 24 bp, Homo sapiens
  source 1..24: mol_type = unassigned DNA
cgtgggcggcagcgagtcgttgcg

SEQ ID NO: 8732 - DNA, 521 bp, Homo sapiens
  source 1..521: mol_type = unassigned DNA
cgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacg

SEQ ID NO: 8733 - DNA, 1484 bp, Homo sapiens
  source 1..1484: mol_type = unassigned DNA
cgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcg

SEQ ID NO: 8734 - DNA, 34 bp, Homo sapiens
  source 1..34: mol_type = unassigned DNA
cggggaggcggggggagcgggagcgggcgacgcg

SEQ ID NO: 8735 - DNA, 14 bp, Homo sapiens
  source 1..14: mol_type = unassigned DNA
cgagcccctcgccg

SEQ ID NO: 8736 - DNA, 37 bp, Homo sapiens
  source 1..37: mol_type = unassigned DNA
cggctgctcttcagcaccgtggagtgggcgcgccacg

SEQ ID NO: 8737 - DNA, 34 bp, Homo sapiens
  source 1..34: mol_type = unassigned DNA
cggcagccaaagacaaagaagcggacaaatcccg

SEQ ID NO: 8738 - DNA, 538 bp, Homo sapiens
  source 1..538: mol_type = unassigned DNA
cggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcg

SEQ ID NO: 8739 - DNA, 109 bp, Homo sapiens
  source 1..109: mol_type = unassigned DNA
cgcggccctctccccacgcgaggcctccaaatctcgcaaactaacggaaatgaagctacgctccgggagcggtgcctctgggaaatgtagtccagcgctccggacgccg

SEQ ID NO: 8740 - DNA, 901 bp, Homo sapiens
  source 1..901: mol_type = unassigned DNA
cgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcg

SEQ ID NO: 8741 - DNA, 15 bp, Homo sapiens
  source 1..15: mol_type = unassigned DNA
cgcccgcgccgcccg

SEQ ID NO: 8742 - DNA, 383 bp, Homo sapiens
  source 1..383: mol_type = unassigned DNA
cgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccg

SEQ ID NO: 8743 - skipped

SEQ ID NO: 8744 - DNA, 624 bp, Homo sapiens
  source 1..624: mol_type = unassigned DNA
cgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcg

SEQ ID NO: 8745 - DNA, 94 bp, Homo sapiens
  source 1..94: mol_type = unassigned DNA
cggccggctcctccggctgatttcgctctggttgatttcgcgcacattcctctcccagcgctgcaaggaccgcctgaactcgctggctatctcg

SEQ ID NO: 8746 - DNA, 63 bp, Homo sapiens
  source 1..63: mol_type = unassigned DNA
cgcggcggctgcgggactcgcgtggcgccggcgacggctcggcccagctctgcgccctgcacg

SEQ ID NO: 8747 - DNA, 41 bp, Homo sapiens
  source 1..41: mol_type = unassigned DNA
cgatggcggacaagagggcggggaccccagaagccgcggcg

SEQ ID NO: 8748 - DNA, 1041 bp, Homo sapiens
  source 1..1041: mol_type = unassigned DNA
cgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcg

SEQ ID NO: 8749 - DNA, 23 bp, Homo sapiens
  source 1..23: mol_type = unassigned DNA
cgccatggcccgagccgaaggcg

SEQ ID NO: 8750 - DNA, 515 bp, Homo sapiens
  source 1..515: mol_type = unassigned DNA
cgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcg

SEQ ID NO: 8751 - DNA, 1017 bp, Homo sapiens
  source 1..1017: mol_type = unassigned DNA
cggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccg

SEQ ID NO: 8752 - skipped

SEQ ID NO: 8753 - DNA, 54 bp, Homo sapiens
  source 1..54: mol_type = unassigned DNA
cgctttctctctcggcctcttccgcgtggtctgctctccgcccgcctgcgctcg

SEQ ID NO: 8754 - DNA, 10 bp, Homo sapiens
  source 1..10: mol_type = unassigned DNA
cgacaacgcg

SEQ ID NO: 8755 - DNA, 26 bp, Homo sapiens
  source 1..26: mol_type = unassigned DNA
cgcggccgcctggtcgaacctgcccg

SEQ ID NO: 8756 - DNA, 934 bp, Homo sapiens
  source 1..934: mol_type = unassigned DNA
cgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcg

SEQ ID NO: 8757 - DNA, 279 bp, Homo sapiens
  source 1..279: mol_type = unassigned DNA
cggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcg

SEQ ID NO: 8758-8759 - skipped (2 entries)

SEQ ID NO: 8760 - DNA, 11 bp, Homo sapiens
  source 1..11: mol_type = unassigned DNA
cgatgcgctcg

SEQ ID NO: 8761 - DNA, 30 bp, Homo sapiens
  source 1..30: mol_type = unassigned DNA
cggcctcctgagtagctgagattacaagcg

SEQ ID NO: 8762 - DNA, 10 bp, Homo sapiens
  source 1..10: mol_type = unassigned DNA
cgcgggagcg

SEQ ID NO: 8763 - DNA, 56 bp, Homo sapiens
  source 1..56: mol_type = unassigned DNA
cgcccacaaatcggccccgtcccctcgtgtccgggcccgccgctcatcagacgccg

SEQ ID NO: 8764 - DNA, 98 bp, Homo sapiens
  source 1..98: mol_type = unassigned DNA
cgtgacctcgggccgcccctcacacgtgaccgctcccttcctctcccccacccccgcacccgtccctctcccagcctcctgccccgccctgctggccg

SEQ ID NO: 8765 - DNA, 33 bp, Homo sapiens
  source 1..33: mol_type = unassigned DNA
cgacggcggcggccgcccctgcgcgtcctcccg

SEQ ID NO: 8766 - DNA, 48 bp, Homo sapiens
  source 1..48: mol_type = unassigned DNA
cgaaggaattggggtggggggtgcgtgtgtggtggagggggtgggacg

SEQ ID NO: 8767 - DNA, 93 bp, Homo sapiens
  source 1..93: mol_type = unassigned DNA
cgagggcagcggtggggctgggccgggggagcaggggtcgcgccgggcagcgtcgcgtgctggagcggaggcgggtgcggccggggcaggtcg

SEQ ID NO: 8768-8774 - skipped (7 entries)

SEQ ID NO: 8775 - DNA, 42 bp, Homo sapiens
  source 1..42: mol_type = unassigned DNA
cgttgcgcgctcgctctctggccgggcgcgcgcctcgctccg

SEQ ID NO: 8776-8785 - skipped (10 entries)

SEQ ID NO: 8786 - DNA, 40 bp, Homo sapiens
  source 1..40: mol_type = unassigned DNA
cgcgccggagtgcggccctgctcccagcgccagtgcgccg

SEQ ID NO: 8787-8807 - skipped (21 entries)

SEQ ID NO: 8808 - DNA, 42 bp, Homo sapiens
  source 1..42: mol_type = unassigned DNA
cggagaccgccccgctccctcagaccgaacgccgcccgcccg

SEQ ID NO: 8809-8818 - skipped (10 entries)

SEQ ID NO: 8819 - DNA, 20 bp, synthetic construct
  misc_feature 1..20: note = Description of Artificial Sequence: Synthetic oligonucleotide
  source 1..20: mol_type = other DNA
ygtggtgygygyggygggyg

SEQ ID NO: 8820 - DNA, 116 bp, synthetic construct
  misc_feature 1..116: note = Description of Artificial Sequence: Synthetic polynucleotide
  source 1..116: mol_type = other DNA
ygagygtygtgggyggggttttagggyggyggygtttygyggggagggtttttygtgttgggggygaggttattygaggtagtttttygttygtttttaatttygtttygttttyg

SEQ ID NO: 8821-8830 - skipped (10 entries)

SEQ ID NO: 8831 - DNA, 44 bp, synthetic construct
  misc_feature 1..44: note = Description of Artificial Sequence: Synthetic oligonucleotide
  source 1..44: mol_type = other DNA
ygygygtttttygggtttygttygtattttttaygygtttttyg

SEQ ID NO: 8832-8841 - skipped (10 entries)

SEQ ID NO: 8842 - DNA, 34 bp, synthetic construct
  misc_feature 1..34: note = Description of Artificial Sequence: Synthetic oligonucleotide
  source 1..34: mol_type = other DNA
ygtttgttyggyggttttagaaggtygggttgyg

SEQ ID NO: 8843-8852 - skipped (10 entries)

SEQ ID NO: 8853 - DNA, 211 bp, synthetic construct
  misc_feature 1..211: note = Description of Artificial Sequence: Synthetic polynucleotide
  source 1..211: mol_type = other DNA
ygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtyg

SEQ ID NO: 8854-8863 - skipped (10 entries)

SEQ ID NO: 8864 - DNA, 95 bp, synthetic construct
  misc_feature 1..95: note = Description of Artificial Sequence: Synthetic oligonucleotide
  source 1..95: mol_type = other DNA
ygggaaaaggggygyggaagaggggyggggygggttayggygygtagggtttttttttttygtttyggatttaattaattgggtttgagtttttg

SEQ ID NO: 8865-8874 - skipped (10 entries)

SEQ ID NO: 8875 - DNA, 264 bp, synthetic construct
  misc_feature 1..264: note = Description of Artificial Sequence: Synthetic polynucleotide
  source 1..264: mol_type = other DNA
ygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtyg

SEQ ID NO: 8876-8885 - skipped (10 entries)

SEQ ID NO: 8886 - DNA, 59 bp, synthetic construct
  misc_feature 1..59: note = Description of Artificial Sequence: Synthetic oligonucleotide
  source 1..59: mol_type = other DNA
ygtttttygtttyggagttgtyggyggtatgattygataygtyggggygttygygygyg

SEQ ID NO: 8887-8907 - skipped (21 entries)

SEQ ID NO: 8908 - DNA, 324 bp, synthetic construct
  misc_feature 1..324: note = Description of Artificial Sequence: Synthetic polynucleotide
  source 1..324: mol_type = other DNA
yggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggyg

SEQ ID NO: 8909-8915 - skipped (7 entries)

SEQ ID NO: 8916 - DNA, 102 bp, synthetic construct
  misc_feature 1..102: note = Description of Artificial Sequence: Synthetic polynucleotide
  source 1..102: mol_type = other DNA
ygttgagttygygttgaataagattttttygtagttttgygtttygygtygggtgaaggggygtgtttttgtaggygttyggggttyggtttggagttggyg

SEQ ID NO: 8917 - DNA, 24 bp, synthetic construct
  misc_feature 1..24: note = Description of Artificial Sequence: Synthetic oligonucleotide
  source 1..24: mol_type = other DNA
ygtaaygattygttgtygtttayg

SEQ ID NO: 8918 - DNA, 521 bp, synthetic construct
  misc_feature 1..521: note = Description of Artificial Sequence: Synthetic polynucleotide
  source 1..521: mol_type = other DNA
ygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgyg

SEQ ID NO: 8919 - DNA, 1484 bp, synthetic construct
  misc_feature 1..1484: note = Description of Artificial Sequence: Synthetic polynucleotide
  source 1..1484: mol_type = other DNA
ygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggyg

SEQ ID NO: 8920 - DNA, 34 bp, synthetic construct
  misc_feature 1..34: note = Description of Artificial Sequence: Synthetic oligonucleotide
  source 1..34: mol_type = other DNA
ygygtygttygttttygtttttttygttttttyg

SEQ ID NO: 8921 - DNA, 14 bp, synthetic construct
  misc_feature 1..14: note = Description of Artificial Sequence: Synthetic oligonucleotide
  source 1..14: mol_type = other DNA
yggygaggggttyg

SEQ ID NO: 8922 - DNA, 37 bp, synthetic construct
  misc_feature 1..37: note = Description of Artificial Sequence: Synthetic oligonucleotide
  source 1..37: mol_type = other DNA
ygtggygygtttattttayggtgttgaagagtagtyg

SEQ ID NO: 8923 - DNA, 34 bp, synthetic construct
  misc_feature 1..34: note = Description of Artificial Sequence: Synthetic oligonucleotide
  source 1..34: mol_type = other DNA
ygggatttgttygtttttttgtttttggttgtyg

SEQ ID NO: 8924 - DNA, 538 bp, synthetic construct
  misc_feature 1..538: note = Description of Artificial Sequence: Synthetic polynucleotide
  source 1..538: mol_type = other DNA
ygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtyg

SEQ ID NO: 8925 - DNA, 109 bp, synthetic construct
  misc_feature 1..109: note = Description of Artificial Sequence: Synthetic polynucleotide
  source 1..109: mol_type = other DNA
yggygttyggagygttggattatattttttagaggtatygttttyggagygtagttttattttygttagtttgygagatttggaggtttygygtggggagagggtygyg

SEQ ID NO: 8926 - DNA, 901 bp, synthetic construct
  misc_feature 1..901: note = Description of Artificial Sequence: Synthetic polynucleotide
  source 1..901: mol_type = other DNA
ygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygyg

SEQ ID NO: 8927 - DNA, 15 bp, synthetic construct
  misc_feature 1..15: note = Description of Artificial Sequence: Synthetic oligonucleotide
  source 1..15: mol_type = other DNA
ygggyggygygggyg

SEQ ID NO: 8928 - DNA, 383 bp, synthetic construct
  misc_feature 1..383: note = Description of Artificial Sequence: Synthetic polynucleotide
  source 1..383: mol_type = other DNA
ygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggyg

SEQ ID NO: 8929 - skipped

SEQ ID NO: 8930 - DNA, 624 bp, synthetic construct
  misc_feature 1..624: note = Description of Artificial Sequence: Synthetic polynucleotide
  source 1..624: mol_type = other DNA
ygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggyg

SEQ ID NO: 8931 - DNA, 94 bp, synthetic construct
  misc_feature 1..94: note = Description of Artificial Sequence: Synthetic oligonucleotide
  source 1..94: mol_type = other DNA
ygagatagttagygagtttaggyggtttttgtagygttgggagaggaatgtgygygaaattaattagagygaaattagtyggaggagtyggtyg

SEQ ID NO: 8932 - DNA, 63 bp, synthetic construct
  misc_feature 1..63: note = Description of Artificial Sequence: Synthetic oligonucleotide
  source 1..63: mol_type = other DNA
ygtgtagggygtagagttgggtygagtygtygtyggygttaygygagtttygtagtygtygyg

SEQ ID NO: 8933 - DNA, 41 bp, synthetic construct
  misc_feature 1..41: note = Description of Artificial Sequence: Synthetic oligonucleotide
  source 1..41: mol_type = other DNA
ygtygyggtttttggggttttygtttttttgttygttatyg

SEQ ID NO: 8934 - DNA, 1041 bp, synthetic construct
  misc_feature 1..1041: note = Description of Artificial Sequence: Synthetic polynucleotide
  source 1..1041: mol_type = other DNA
ygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaayg

SEQ ID NO: 8935 - DNA, 23 bp, synthetic construct
  misc_feature 1..23: note = Description of Artificial Sequence: Synthetic oligonucleotide
  source 1..23: mol_type = other DNA
ygttttyggttygggttatggyg

SEQ ID NO: 8936 - DNA, 515 bp, synthetic construct
  misc_feature 1..515: note = Description of Artificial Sequence: Synthetic polynucleotide
  source 1..515: mol_type = other DNA
ygtagtagaatattttgatttaaaataaaaatattatgataaaaatattttaggaggtagtyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtyg

SEQ ID NO: 8937 - DNA, 1017 bp, synthetic construct
  misc_feature 1..1017: note = Description of Artificial Sequence: Synthetic polynucleotide
  source 1..1017: mol_type = other DNA
ygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyg

SEQ ID NO: 8938 - skipped

SEQ ID NO: 8939 - DNA, 54 bp, synthetic construct
  misc_feature 1..54: note = Description of Artificial Sequence: Synthetic oligonucleotide
  source 1..54: mol_type = other DNA
ygagygtaggygggyggagagtagattaygyggaagaggtygagagagaaagyg

SEQ ID NO: 8940 - DNA, 10 bp, synthetic construct
  misc_feature 1..10: note = Description of Artificial Sequence: Synthetic oligonucleotide
  source 1..10: mol_type = other DNA
ygygttgtyg

SEQ ID NO: 8941 - DNA, 26 bp, synthetic construct
  misc_feature 1..26: note = Description of Artificial Sequence: Synthetic oligonucleotide
  source 1..26: mol_type = other DNA
ygggtaggttygattaggyggtygyg

SEQ ID NO: 8942 - DNA, 934 bp, synthetic construct
  misc_feature 1..934: note = Description of Artificial Sequence: Synthetic polynucleotide
  source 1..934: mol_type = other DNA
ygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygyg

SEQ ID NO: 8943 - DNA, 279 bp, synthetic construct
  misc_feature 1..279: note = Description of Artificial Sequence: Synthetic polynucleotide
  source 1..279: mol_type = other DNA
ygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttyg

SEQ ID NO: 8944-8945 - skipped (2 entries)

SEQ ID NO: 8946 - DNA, 11 bp, synthetic construct
  misc_feature 1..11: note = Description of Artificial Sequence: Synthetic oligonucleotide
  source 1..11: mol_type = other DNA
ygagygtatyg

SEQ ID NO: 8947 - DNA, 30 bp, synthetic construct
  misc_feature 1..30: note = Description of Artificial Sequence: Synthetic oligonucleotide
  source 1..30: mol_type = other DNA
ygtttgtaattttagttatttaggaggtyg

SEQ ID NO: 8948 - DNA, 10 bp, synthetic construct
  misc_feature 1..10: note = Description of Artificial Sequence: Synthetic oligonucleotide
  source 1..10: mol_type = other DNA
ygttttygyg

SEQ ID NO: 8949 - DNA, 56 bp, synthetic construct
  misc_feature 1..56: note = Description of Artificial Sequence: Synthetic oligonucleotide
  source 1..56: mol_type = other DNA
yggygtttgatgagyggygggttyggataygaggggayggggtygatttgtgggyg

SEQ ID NO: 8950 - DNA, 98 bp, synthetic construct
  misc_feature 1..98: note = Description of Artificial Sequence: Synthetic oligonucleotide
  source 1..98: mol_type = other DNA
yggttagtagggyggggtaggaggttgggagagggaygggtgygggggtgggggagaggaagggagyggttaygtgtgaggggyggttygaggttayg

SEQ ID NO: 8951 - DNA, 33 bp, synthetic construct
  misc_feature 1..33: note = Description of Artificial Sequence: Synthetic oligonucleotide
  source 1..33: mol_type = other DNA
ygggaggaygygtaggggyggtygtygtygtyg

SEQ ID NO: 8952 - DNA, 48 bp, synthetic construct
  misc_feature 1..48: note = Description of Artificial Sequence: Synthetic oligonucleotide
  source 1..48: mol_type = other DNA
ygttttattttttttattatataygtattttttattttaattttttyg

SEQ ID NO: 8953 - DNA, 93 bp, synthetic construct
  misc_feature 1..93: note = Description of Artificial Sequence: Synthetic oligonucleotide
  source 1..93: mol_type = other DNA
ygatttgtttyggtygtattygttttygttttagtaygygaygttgttyggygygatttttgttttttyggtttagttttatygttgttttyg

SEQ ID NO: 8954-8960 - skipped (7 entries)

SEQ ID NO: 8961 - DNA, 42 bp, synthetic construct
  misc_feature 1..42: note = Description of Artificial Sequence: Synthetic oligonucleotide
  source 1..42: mol_type = other DNA
yggagygaggygygygttyggttagagagygagygygtaayg

SEQ ID NO: 8962-8971 - skipped (10 entries)

SEQ ID NO: 8972 - DNA, 40 bp, synthetic construct
  misc_feature 1..40: note = Description of Artificial Sequence: Synthetic oligonucleotide
  source 1..40: mol_type = other DNA
yggygtattggygttgggagtagggtygtatttyggygyg

SEQ ID NO: 8973-8993 - skipped (21 entries)

SEQ ID NO: 8994 - DNA, 42 bp, synthetic construct
  misc_feature 1..42: note = Description of Artificial Sequence: Synthetic oligonucleotide
  source 1..42: mol_type = other DNA
ygggygggyggygttyggtttgagggagyggggyggttttyg

SEQ ID NO: 8995-9004 - skipped (10 entries)

SEQ ID NO: 9005 - DNA, 20 bp, synthetic construct
  misc_feature 1..20: note = Description of Artificial Sequence: Synthetic oligonucleotide
  source 1..20: mol_type = other DNA
cgtggtgcgcgcggcgggcg

SEQ ID NO: 9006 - DNA, 116 bp, synthetic construct
  misc_feature 1..116: note = Description of Artificial Sequence: Synthetic polynucleotide
  source 1..116: mol_type = other DNA
cgagcgtcgtgggcggggttttagggcggcggcgtttcgcggggagggtttttcgtgttgggggcgaggttattcgaggtagtttttcgttcgtttttaatttcgtttcgttttcg

SEQ ID NO: 9007-9016 - skipped (10 entries)

SEQ ID NO: 9017 - DNA, 44 bp, synthetic construct
  misc_feature 1..44: note = Description of Artificial Sequence: Synthetic oligonucleotide
  source 1..44: mol_type = other DNA
cgcgcgtttttcgggtttcgttcgtattttttacgcgtttttcg

SEQ ID NO: 9018-9027 - skipped (10 entries)

SEQ ID NO: 9028 - DNA, 34 bp, synthetic construct
  misc_feature 1..34: note = Description of Artificial Sequence: Synthetic oligonucleotide
  source 1..34: mol_type = other DNA
cgtttgttcggcggttttagaaggtcgggttgcg

SEQ ID NO: 9029-9038 - skipped (10 entries)

SEQ ID NO: 9039 - DNA, 211 bp, synthetic construct
  misc_feature 1..211: note = Description of Artificial Sequence: Synthetic polynucleotide
  source 1..211: mol_type = other DNA
cgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcg

SEQ ID NO: 9040-9049 - skipped (10 entries)

SEQ ID NO: 9050 - DNA, 95 bp, synthetic construct
  misc_feature 1..95: note = Description of Artificial Sequence: Synthetic oligonucleotide
  source 1..95: mol_type = other DNA
cgggaaaaggggcgcggaagaggggcggggcgggttacggcgcgtagggtttttttttttcgtttcggatttaattaattgggtttgagtttttg

SEQ ID NO: 9051-9060 - skipped (10 entries)

SEQ ID NO: 9061 - DNA, 264 bp, synthetic construct
  misc_feature 1..264: note = Description of Artificial Sequence: Synthetic polynucleotide
  source 1..264: mol_type = other DNA
cgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcg

SEQ ID NO: 9062-9071 - skipped (10 entries)

SEQ ID NO: 9072 - DNA, 59 bp, synthetic construct
  misc_feature 1..59: note = Description of Artificial Sequence: Synthetic oligonucleotide
  source 1..59: mol_type = other DNA
cgtttttcgtttcggagttgtcggcggtatgattcgatacgtcggggcgttcgcgcgcg

SEQ ID NO: 9073-9093 - skipped (21 entries)

SEQ ID NO: 9094 - DNA, 324 bp, synthetic construct
  misc_feature 1..324: note = Description of Artificial Sequence: Synthetic polynucleotide
  source 1..324: mol_type = other DNA
cggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcg

SEQ ID NO: 9095-9101 - skipped (7 entries)

SEQ ID NO: 9102 - DNA, 102 bp, synthetic construct
  misc_feature 1..102: note = Description of Artificial Sequence: Synthetic polynucleotide
  source 1..102: mol_type = other DNA
cgttgagttcgcgttgaataagattttttcgtagttttgcgtttcgcgtcgggtgaaggggcgtgtttttgtaggcgttcggggttcggtttggagttggcg

SEQ ID NO: 9103 - DNA, 24 bp, synthetic construct
  misc_feature 1..24: note = Description of Artificial Sequence: Synthetic oligonucleotide
  source 1..24: mol_type = other DNA
cgtaacgattcgttgtcgtttacg

SEQ ID NO: 9104 - DNA, 521 bp, synthetic construct
  misc_feature 1..521: note = Description of Artificial Sequence: Synthetic polynucleotide
  source 1..521: mol_type = other DNA
cgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcg

SEQ ID NO: 9105 - DNA, 1484 bp, synthetic construct
  misc_feature 1..1484: note = Description of Artificial Sequence: Synthetic polynucleotide
  source 1..1484: mol_type = other DNA
cgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcg

SEQ ID NO: 9106 - DNA, 34 bp, synthetic construct
  misc_feature 1..34: note = Description of Artificial Sequence: Synthetic oligonucleotide
  source 1..34: mol_type = other DNA
cgcgtcgttcgttttcgtttttttcgttttttcg

SEQ ID NO: 9107 - DNA, 14 bp, synthetic construct
  misc_feature 1..14: note = Description of Artificial Sequence: Synthetic oligonucleotide
  source 1..14: mol_type = other DNA
cggcgaggggttcg

SEQ ID NO: 9108 - DNA, 37 bp, synthetic construct
  misc_feature 1..37: note = Description of Artificial Sequence: Synthetic oligonucleotide
  source 1..37: mol_type = other DNA
cgtggcgcgtttattttacggtgttgaagagtagtcg

SEQ ID NO: 9109 - DNA, 34 bp, synthetic construct
  misc_feature 1..34: note = Description of Artificial Sequence: Synthetic oligonucleotide
  source 1..34: mol_type = other DNA
cgggatttgttcgtttttttgtttttggttgtcg

SEQ ID NO: 9110 - DNA, 538 bp, synthetic construct
  misc_feature 1..538: note = Description of Artificial Sequence: Synthetic polynucleotide
  source 1..538: mol_type = other DNA
cgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcg

SEQ ID NO: 9111 - DNA, 109 bp, synthetic construct
  misc_feature 1..109: note = Description of Artificial Sequence: Synthetic polynucleotide
  source 1..109: mol_type = other DNA
cggcgttcggagcgttggattatattttttagaggtatcgttttcggagcgtagttttattttcgttagtttgcgagatttggaggtttcgcgtggggagagggtcgcg

SEQ ID NO: 9112 - DNA, 901 bp, synthetic construct
  misc_feature 1..901: note = Description of Artificial Sequence: Synthetic polynucleotide
  source 1..901: mol_type = other DNA
cgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcg

SEQ ID NO: 9113 - DNA, 15 bp, synthetic construct
  misc_feature 1..15: note = Description of Artificial Sequence: Synthetic oligonucleotide
  source 1..15: mol_type = other DNA
cgggcggcgcgggcg

SEQ ID NO: 9114 - DNA, 383 bp, synthetic construct
  misc_feature 1..383: note = Description of Artificial Sequence: Synthetic polynucleotide
  source 1..383: mol_type = other DNA
cgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcg

SEQ ID NO: 9115 - skipped

SEQ ID NO: 9116 - DNA, 624 bp, synthetic construct
  misc_feature 1..624: note = Description of Artificial Sequence: Synthetic polynucleotide
  source 1..624: mol_type = other DNA
cgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcg

SEQ ID NO: 9117 - DNA, 94 bp, synthetic construct
  misc_feature 1..94: note = Description of Artificial Sequence: Synthetic oligonucleotide
  source 1..94: mol_type = other DNA
cgagatagttagcgagtttaggcggtttttgtagcgttgggagaggaatgtgcgcgaaattaattagagcgaaattagtcggaggagtcggtcg

SEQ ID NO: 9118 - DNA, 63 bp, synthetic construct
  misc_feature 1..63: note = Description of Artificial Sequence: Synthetic oligonucleotide
  source 1..63: mol_type = other DNA
cgtgtagggcgtagagttgggtcgagtcgtcgtcggcgttacgcgagtttcgtagtcgtcgcg

SEQ ID NO: 9119 - DNA, 41 bp, synthetic construct
  misc_feature 1..41: note = Description of Artificial Sequence: Synthetic oligonucleotide
  source 1..41: mol_type = other DNA
cgtcgcggtttttggggttttcgtttttttgttcgttatcg

SEQ ID NO: 9120 - DNA, 1041 bp, synthetic construct
  misc_feature 1..1041: note = Description of Artificial Sequence: Synthetic polynucleotide
  source 1..1041: mol_type = other DNA
cgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacg

SEQ ID NO: 9121 - DNA, 23 bp, synthetic construct
  misc_feature 1..23: note = Description of Artificial Sequence: Synthetic oligonucleotide
  source 1..23: mol_type = other DNA
cgttttcggttcgggttatggcg

SEQ ID NO: 9122 - DNA, 515 bp, synthetic construct
  misc_feature 1..515: note = Description of Artificial Sequence: Synthetic polynucleotide
  source 1..515: mol_type = other DNA
cgtagtagaatattttgatttaaaataaaaatattatgataaaaatattttaggaggtagtcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcg

SEQ ID NO: 9123 - DNA, 1017 bp, synthetic construct
  misc_feature 1..1017: note = Description of Artificial Sequence: Synthetic polynucleotide
  source 1..1017: mol_type = other DNA
cgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcg

SEQ ID NO: 9124 - skipped

SEQ ID NO: 9125 - DNA, 54 bp, synthetic construct
  misc_feature 1..54: note = Description of Artificial Sequence: Synthetic oligonucleotide
  source 1..54: mol_type = other DNA
cgagcgtaggcgggcggagagtagattacgcggaagaggtcgagagagaaagcg

SEQ ID NO: 9126 - DNA, 10 bp, synthetic construct
  misc_feature 1..10: note = Description of Artificial Sequence: Synthetic oligonucleotide
  source 1..10: mol_type = other DNA
cgcgttgtcg

SEQ ID NO: 9127 - DNA, 26 bp, synthetic construct
  misc_feature 1..26: note = Description of Artificial Sequence: Synthetic oligonucleotide
  source 1..26: mol_type = other DNA
cgggtaggttcgattaggcggtcgcg

SEQ ID NO: 9128 - DNA, 934 bp, synthetic construct
  misc_feature 1..934: note = Description of Artificial Sequence: Synthetic polynucleotide
  source 1..934: mol_type = other DNA
cgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcg

SEQ ID NO: 9129 - DNA, 279 bp, synthetic construct
  misc_feature 1..279: note = Description of Artificial Sequence: Synthetic polynucleotide
  source 1..279: mol_type = other DNA
cgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcg

SEQ ID NO: 9130-9131 - skipped (2 entries)

SEQ ID NO: 9132 - DNA, 11 bp, synthetic construct
  misc_feature 1..11: note = Description of Artificial Sequence: Synthetic oligonucleotide
  source 1..11: mol_type = other DNA
cgagcgtatcg

SEQ ID NO: 9133 - DNA, 30 bp, synthetic construct
  misc_feature 1..30: note = Description of Artificial Sequence: Synthetic oligonucleotide
  source 1..30: mol_type = other DNA
cgtttgtaattttagttatttaggaggtcg

SEQ ID NO: 9134 - DNA, 10 bp, synthetic construct
  misc_feature 1..10: note = Description of Artificial Sequence: Synthetic oligonucleotide
  source 1..10: mol_type = other DNA
cgttttcgcg

SEQ ID NO: 9135 - DNA, 56 bp, synthetic construct
  misc_feature 1..56: note = Description of Artificial Sequence: Synthetic oligonucleotide
  source 1..56: mol_type = other DNA
cggcgtttgatgagcggcgggttcggatacgaggggacggggtcgatttgtgggcg

SEQ ID NO: 9136 - DNA, 98 bp, synthetic construct
  misc_feature 1..98: note = Description of Artificial Sequence: Synthetic oligonucleotide
  source 1..98: mol_type = other DNA
cggttagtagggcggggtaggaggttgggagagggacgggtgcgggggtgggggagaggaagggagcggttacgtgtgaggggcggttcgaggttacg

SEQ ID NO: 9137 - DNA, 33 bp, synthetic construct
  misc_feature 1..33: note = Description of Artificial Sequence: Synthetic oligonucleotide
  source 1..33: mol_type = other DNA
cgggaggacgcgtaggggcggtcgtcgtcgtcg

SEQ ID NO: 9138 - DNA, 48 bp, synthetic construct
  misc_feature 1..48: note = Description of Artificial Sequence: Synthetic oligonucleotide
  source 1..48: mol_type = other DNA
cgttttattttttttattatatacgtattttttattttaattttttcg

SEQ ID NO: 9139 - DNA, 93 bp, synthetic construct
  misc_feature 1..93: note = Description of Artificial Sequence: Synthetic oligonucleotide
  source 1..93: mol_type = other DNA
cgatttgtttcggtcgtattcgttttcgttttagtacgcgacgttgttcggcgcgatttttgttttttcggtttagttttatcgttgttttcg

SEQ ID NO: 9140-9146 - skipped (7 entries)

SEQ ID NO: 9147 - DNA, 42 bp, synthetic construct
  misc_feature 1..42: note = Description of Artificial Sequence: Synthetic oligonucleotide
  source 1..42: mol_type = other DNA
cggagcgaggcgcgcgttcggttagagagcgagcgcgtaacg

SEQ ID NO: 9148-9157 - skipped (10 entries)

SEQ ID NO: 9158 - DNA, 40 bp, synthetic construct
  misc_feature 1..40: note = Description of Artificial Sequence: Synthetic oligonucleotide
  source 1..40: mol_type = other DNA
cggcgtattggcgttgggagtagggtcgtatttcggcgcg

SEQ ID NO: 9159-9179 - skipped (21 entries)

SEQ ID NO: 9180 - DNA, 42 bp, synthetic construct
  misc_feature 1..42: note = Description of Artificial Sequence: Synthetic oligonucleotide
  source 1..42: mol_type = other DNA
cgggcgggcggcgttcggtttgagggagcggggcggttttcg

SEQ ID NO: 9181-9190 - skipped (10 entries)

SEQ ID NO: 9191 - DNA, 20 bp, synthetic construct
  misc_feature 1..20: note = Description of Artificial Sequence: Synthetic oligonucleotide
  source 1..20: mol_type = other DNA
ygttygtygygygtattayg

SEQ ID NO: 9192 - DNA, 116 bp, synthetic construct
  misc_feature 1..116: note = Description of Artificial Sequence: Synthetic polynucleotide
  source 1..116: mol_type = other DNA
ygagagyggggyggggttgggggygggyggggagttgtttygggtggtttygtttttagtayggaggatttttttygygaggygtygtygttttggagtttygtttayggygttyg

SEQ ID NO: 9193-9202 - skipped (10 entries)

SEQ ID NO: 9203 - DNA, 44 bp, synthetic construct
  misc_feature 1..44: note = Description of Artificial Sequence: Synthetic oligonucleotide
  source 1..44: mol_type = other DNA
yggggggygygtgaggggtgygagyggggttyggggggygygyg

SEQ ID NO: 9204-9213 - skipped (10 entries)

SEQ ID NO: 9214 - DNA, 34 bp, synthetic construct
  misc_feature 1..34: note = Description of Artificial Sequence: Synthetic oligonucleotide
  source 1..34: mol_type = other DNA
ygtagttygattttttagagtygtygagtagayg

SEQ ID NO: 9215-9224 - skipped (10 entries)

SEQ ID NO: 9225 - DNA, 211 bp, synthetic construct
  misc_feature 1..211: note = Description of Artificial Sequence: Synthetic polynucleotide
  source 1..211: mol_type = other DNA
ygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatyg

SEQ ID NO: 9226-9235 - skipped (10 entries)

SEQ ID NO: 9236 - DNA, 95 bp, synthetic construct
  misc_feature 1..95: note = Description of Artificial Sequence: Synthetic oligonucleotide
  source 1..95: mol_type = other DNA
yggaagtttaagtttaattaattgagttygaggygggagggaagggttttgygygtygtggttygtttygtttttttttygygttttttttttyg

SEQ ID NO: 9237-9246 - skipped (10 entries)

SEQ ID NO: 9247 - DNA, 264 bp, synthetic construct
  misc_feature 1..264: note = Description of Artificial Sequence: Synthetic polynucleotide
  source 1..264: mol_type = other DNA
yggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttyg

SEQ ID NO: 9248-9257 - skipped (10 entries)

SEQ ID NO: 9258 - DNA, 59 bp, synthetic construct
  misc_feature 1..59: note = Description of Artificial Sequence: Synthetic oligonucleotide
  source 1..59: mol_type = other DNA
ygygygygggygtttyggygtgtyggattatgtygtyggtagtttygggayggggaayg

SEQ ID NO: 9259-9279 - skipped (21 entries)

SEQ ID NO: 9280 - DNA, 324 bp, synthetic construct
  misc_feature 1..324: note = Description of Artificial Sequence: Synthetic polynucleotide
  source 1..324: mol_type = other DNA
ygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtyg

SEQ ID NO: 9281-9287 - skipped (7 entries)

SEQ ID NO: 9288 - DNA, 102 bp, synthetic construct
  misc_feature 1..102: note = Description of Artificial Sequence: Synthetic polynucleotide
  source 1..102: mol_type = other DNA
ygttagttttaggtygagtttygagygtttgtaggaataygtttttttattyggygygggaygtagagttgygagagaattttgtttagygyggatttaayg

SEQ ID NO: 9289 - DNA, 24 bp, synthetic construct
  misc_feature 1..24: note = Description of Artificial Sequence: Synthetic oligonucleotide
  source 1..24: mol_type = other DNA
ygtgggyggtagygagtygttgyg

SEQ ID NO: 9290 - DNA, 521 bp, synthetic construct
  misc_feature 1..521: note = Description of Artificial Sequence: Synthetic polynucleotide
  source 1..521: mol_type = other DNA
ygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattayg

SEQ ID NO: 9291 - DNA, 1484 bp, synthetic construct
  misc_feature 1..1484: note = Description of Artificial Sequence: Synthetic polynucleotide
  source 1..1484: mol_type = other DNA
ygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyg

SEQ ID NO: 9292 - DNA, 34 bp, synthetic construct
  misc_feature 1..34: note = Description of Artificial Sequence: Synthetic oligonucleotide
  source 1..34: mol_type = other DNA
yggggaggyggggggagygggagygggygaygyg

SEQ ID NO: 9293 - DNA, 14 bp, synthetic construct
  misc_feature 1..14: note = Description of Artificial Sequence: Synthetic oligonucleotide
  source 1..14: mol_type = other DNA
ygagtttttygtyg

SEQ ID NO: 9294 - DNA, 37 bp, synthetic construct
  misc_feature 1..37: note = Description of Artificial Sequence: Synthetic oligonucleotide
  source 1..37: mol_type = other DNA
yggttgttttttagtatygtggagtgggygygttayg

SEQ ID NO: 9295 - DNA, 34 bp, synthetic construct
  misc_feature 1..34: note = Description of Artificial Sequence: Synthetic oligonucleotide
  source 1..34: mol_type = other DNA
yggtagttaaagataaagaagyggataaatttyg

SEQ ID NO: 9296 - DNA, 538 bp, synthetic construct
  misc_feature 1..538: note = Description of Artificial Sequence: Synthetic polynucleotide
  source 1..538: mol_type = other DNA
yggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygyg

SEQ ID NO: 9297 - DNA, 109 bp, synthetic construct
  misc_feature 1..109: note = Description of Artificial Sequence: Synthetic polynucleotide
  source 1..109: mol_type = other DNA
ygyggttttttttttaygygaggtttttaaatttygtaaattaayggaaatgaagttaygtttygggagyggtgtttttgggaaatgtagtttagygtttyggaygtyg

SEQ ID NO: 9298 - DNA, 901 bp, synthetic construct
  misc_feature 1..901: note = Description of Artificial Sequence: Synthetic polynucleotide
  source 1..901: mol_type = other DNA
ygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygyg

SEQ ID NO: 9299 - DNA, 15 bp, synthetic construct
  misc_feature 1..15: note = Description of Artificial Sequence: Synthetic oligonucleotide
  source 1..15: mol_type = other DNA
ygttygygtygttyg

SEQ ID NO: 9300 - DNA, 383 bp, synthetic construct
  misc_feature 1..383: note = Description of Artificial Sequence: Synthetic polynucleotide
  source 1..383: mol_type = other DNA
ygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttyg

SEQ ID NO: 9301 - skipped

SEQ ID NO: 9302 - DNA, 624 bp, synthetic construct
  misc_feature 1..624: note = Description of Artificial Sequence: Synthetic polynucleotide
  source 1..624: mol_type = other DNA
ygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygyg

SEQ ID NO: 9303 - DNA, 94 bp, synthetic construct
  misc_feature 1..94: note = Description of Artificial Sequence: Synthetic oligonucleotide
  source 1..94: mol_type = other DNA
yggtyggttttttyggttgatttygttttggttgatttygygtatattttttttttagygttgtaaggatygtttgaattygttggttatttyg

SEQ ID NO: 9304 - DNA, 63 bp, synthetic construct
  misc_feature 1..63: note = Description of Artificial Sequence: Synthetic oligonucleotide
  source 1..63: mol_type = other DNA
ygyggyggttgygggattygygtggygtyggygayggttyggtttagttttgygttttgtayg

SEQ ID NO: 9305 - DNA, 41 bp, synthetic construct
  misc_feature 1..41: note = Description of Artificial Sequence: Synthetic oligonucleotide
  source 1..41: mol_type = other DNA
ygatggyggataagagggyggggattttagaagtygyggyg

SEQ ID NO: 9306 - DNA, 1041 bp, synthetic construct
  misc_feature 1..1041: note = Description of Artificial Sequence: Synthetic polynucleotide
  source 1..1041: mol_type = other DNA
ygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygyg

SEQ ID NO: 9307 - DNA, 23 bp, synthetic construct
  misc_feature 1..23: note = Description of Artificial Sequence: Synthetic oligonucleotide
  source 1..23: mol_type = other DNA
ygttatggttygagtygaaggyg

SEQ ID NO: 9308 - DNA, 515 bp, synthetic construct
  misc_feature 1..515: note = Description of Artificial Sequence: Synthetic polynucleotide
  source 1..515: mol_type = other DNA
ygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtyggttgttttttggagtatttttgttatagtatttttattttgggttagggtattttgttgyg

SEQ ID NO: 9309 - DNA, 1017 bp, synthetic construct
  misc_feature 1..1017: note = Description of Artificial Sequence: Synthetic polynucleotide
  source 1..1017: mol_type = other DNA
yggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttyg

SEQ ID NO: 9310 - skipped

SEQ ID NO: 9311 - DNA, 54 bp, synthetic construct
  misc_feature 1..54: note = Description of Artificial Sequence: Synthetic oligonucleotide
  source 1..54: mol_type = other DNA
ygttttttttttyggtttttttygygtggtttgtttttygttygtttgygttyg

SEQ ID NO: 9312 - DNA, 10 bp, synthetic construct
  misc_feature 1..10: note = Description of Artificial Sequence: Synthetic oligonucleotide
  source 1..10: mol_type = other DNA
ygataaygyg

SEQ ID NO: 9313 - DNA, 26 bp, synthetic construct
  misc_feature 1..26: note = Description of Artificial Sequence: Synthetic oligonucleotide
  source 1..26: mol_type = other DNA
ygyggtygtttggtygaatttgttyg

SEQ ID NO: 9314 - DNA, 934 bp, synthetic construct
  misc_feature 1..934: note = Description of Artificial Sequence: Synthetic polynucleotide
  source 1..934: mol_type = other DNA
ygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattyg

SEQ ID NO: 9315 - DNA, 279 bp, synthetic construct
  misc_feature 1..279: note = Description of Artificial Sequence: Synthetic polynucleotide
  source 1..279: mol_type = other DNA
yggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygyg

SEQ ID NO: 9316-9317 - skipped (2 entries)

SEQ ID NO: 9318 - DNA, 11 bp, synthetic construct
  misc_feature 1..11: note = Description of Artificial Sequence: Synthetic oligonucleotide
  source 1..11: mol_type = other DNA
ygatgygttyg

SEQ ID NO: 9319 - DNA, 30 bp, synthetic construct
  misc_feature 1..30: note = Description of Artificial Sequence: Synthetic oligonucleotide
  source 1..30: mol_type = other DNA
yggttttttgagtagttgagattataagyg

SEQ ID NO: 9320 - DNA, 10 bp, synthetic construct
  misc_feature 1..10: note = Description of Artificial Sequence: Synthetic oligonucleotide
  source 1..10: mol_type = other DNA
ygygggagyg

SEQ ID NO: 9321 - DNA, 56 bp, synthetic construct
  misc_feature 1..56: note = Description of Artificial Sequence: Synthetic oligonucleotide
  source 1..56: mol_type = other DNA
ygtttataaatyggtttygttttttygtgttygggttygtygtttattagaygtyg

SEQ ID NO: 9322 - DNA, 98 bp, synthetic construct
  misc_feature 1..98: note = Description of Artificial Sequence: Synthetic oligonucleotide
  source 1..98: mol_type = other DNA
ygtgatttygggtygttttttataygtgatygtttttttttttttttttattttygtattygttttttttttagttttttgtttygttttgttggtyg

SEQ ID NO: 9323 - DNA, 33 bp, synthetic construct
  misc_feature 1..33: note = Description of Artificial Sequence: Synthetic oligonucleotide
  source 1..33: mol_type = other DNA
ygayggyggyggtygtttttgygygttttttyg

SEQ ID NO: 9324 - DNA, 48 bp, synthetic construct
  misc_feature 1..48: note = Description of Artificial Sequence: Synthetic oligonucleotide
  source 1..48: mol_type = other DNA
ygaaggaattggggtggggggtgygtgtgtggtggagggggtgggayg

SEQ ID NO: 9325 - DNA, 93 bp, synthetic construct
  misc_feature 1..93: note = Description of Artificial Sequence: Synthetic oligonucleotide
  source 1..93: mol_type = other DNA
ygagggtagyggtggggttgggtygggggagtaggggtygygtygggtagygtygygtgttggagyggaggygggtgyggtyggggtaggtyg

SEQ ID NO: 9326-9332 - skipped (7 entries)

SEQ ID NO: 9333 - DNA, 42 bp, synthetic construct
  misc_feature 1..42: note = Description of Artificial Sequence: Synthetic oligonucleotide
  source 1..42: mol_type = other DNA
ygttgygygttygttttttggtygggygygygtttygtttyg

SEQ ID NO: 9334-9343 - skipped (10 entries)

SEQ ID NO: 9344 - DNA, 40 bp, synthetic construct
  misc_feature 1..40: note = Description of Artificial Sequence: Synthetic oligonucleotide
  source 1..40: mol_type = other DNA
ygygtyggagtgyggttttgtttttagygttagtgygtyg

SEQ ID NO: 9345-9365 - skipped (21 entries)

SEQ ID NO: 9366 - DNA, 42 bp, synthetic construct
  misc_feature 1..42: note = Description of Artificial Sequence: Synthetic oligonucleotide
  source 1..42: mol_type = other DNA
yggagatygtttygtttttttagatygaaygtygttygttyg

SEQ ID NO: 9367-9376 - skipped (10 entries)

SEQ ID NO: 9377 - DNA, 20 bp, synthetic construct
  misc_feature 1..20: note = Description of Artificial Sequence: Synthetic oligonucleotide
  source 1..20: mol_type = other DNA
cgttcgtcgcgcgtattacg

SEQ ID NO: 9378 - DNA, 116 bp, synthetic construct
  misc_feature 1..116: note = Description of Artificial Sequence: Synthetic polynucleotide
  source 1..116: mol_type = other DNA
cgagagcggggcggggttgggggcgggcggggagttgtttcgggtggtttcgtttttagtacggaggatttttttcgcgaggcgtcgtcgttttggagtttcgtttacggcgttcg

SEQ ID NO: 9379-9388 - skipped (10 entries)

SEQ ID NO: 9389 - DNA, 44 bp, synthetic construct
  misc_feature 1..44: note = Description of Artificial Sequence: Synthetic oligonucleotide
  source 1..44: mol_type = other DNA
cggggggcgcgtgaggggtgcgagcggggttcggggggcgcgcg

SEQ ID NO: 9390-9399 - skipped (10 entries)

SEQ ID NO: 9400 - DNA, 34 bp, synthetic construct
  misc_feature 1..34: note = Description of Artificial Sequence: Synthetic oligonucleotide
  source 1..34: mol_type = other DNA
cgtagttcgattttttagagtcgtcgagtagacg

SEQ ID NO: 9401-9410 - skipped (10 entries)

SEQ ID NO: 9411 - DNA, 211 bp, synthetic construct
  misc_feature 1..211: note = Description of Artificial Sequence: Synthetic polynucleotide
  source 1..211: mol_type = other DNA
cgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcg

SEQ ID NO: 9412-9421 - skipped (10 entries)

SEQ ID NO: 9422 - DNA, 95 bp, synthetic construct
  misc_feature 1..95: note = Description of Artificial Sequence: Synthetic oligonucleotide
  source 1..95: mol_type = other DNA
cggaagtttaagtttaattaattgagttcgaggcgggagggaagggttttgcgcgtcgtggttcgtttcgtttttttttcgcgttttttttttcg

SEQ ID NO: 9423-9432 - skipped (10 entries)

SEQ ID NO: 9433 - DNA, 264 bp, synthetic construct
  misc_feature 1..264: note = Description of Artificial Sequence: Synthetic polynucleotide
  source 1..264: mol_type = other DNA
cggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcg

SEQ ID NO: 9434-9443 - skipped (10 entries)

SEQ ID NO: 9444 - DNA, 59 bp, synthetic construct
  misc_feature 1..59: note = Description of Artificial Sequence: Synthetic oligonucleotide
  source 1..59: mol_type = other DNA
cgcgcgcgggcgtttcggcgtgtcggattatgtcgtcggtagtttcgggacggggaacg

SEQ ID NO: 9445-9465 - skipped (21 entries)

SEQ ID NO: 9466 - DNA, 324 bp, synthetic construct
  misc_feature 1..324: note = Description of Artificial Sequence: Synthetic polynucleotide
  source 1..324: mol_type = other DNA
cgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcg

SEQ ID NO: 9467-9473 - skipped (7 entries)

SEQ ID NO: 9474 - DNA, 102 bp, synthetic construct
  misc_feature 1..102: note = Description of Artificial Sequence: Synthetic polynucleotide
  source 1..102: mol_type = other DNA
cgttagttttaggtcgagtttcgagcgtttgtaggaatacgtttttttattcggcgcgggacgtagagttgcgagagaattttgtttagcgcggatttaacg

SEQ ID NO: 9475 - DNA, 24 bp, synthetic construct
  misc_feature 1..24: note = Description of Artificial Sequence: Synthetic oligonucleotide
  source 1..24: mol_type = other DNA
cgtgggcggtagcgagtcgttgcg

SEQ ID NO: 9476 - DNA, 521 bp, synthetic construct
  misc_feature 1..521: note = Description of Artificial Sequence: Synthetic polynucleotide
  source 1..521: mol_type = other DNA
cgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacg

SEQ ID NO: 9477 - DNA, 1484 bp, synthetic construct
  misc_feature 1..1484: note = Description of Artificial Sequence: Synthetic polynucleotide
  source 1..1484: mol_type = other DNA
cgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcg

SEQ ID NO: 9478 - DNA, 34 bp, synthetic construct; identical to SEQ ID NO: 8734
  misc_feature 1..34: note = Description of Artificial Sequence: Synthetic oligonucleotide
  source 1..34: mol_type = other DNA

SEQ ID NO: 9479 - DNA, 14 bp, synthetic construct
  misc_feature 1..14: note = Description of Artificial Sequence: Synthetic oligonucleotide
  source 1..14: mol_type = other DNA
cgagtttttcgtcg

SEQ ID NO: 9480 - DNA, 37 bp, synthetic construct
  misc_feature 1..37: note = Description of Artificial Sequence: Synthetic oligonucleotide
  source 1..37: mol_type = other DNA
cggttgttttttagtatcgtggagtgggcgcgttacg

SEQ ID NO: 9481 - DNA, 34 bp, synthetic construct
  misc_feature 1..34: note = Description of Artificial Sequence: Synthetic oligonucleotide
  source 1..34: mol_type = other DNA
cggtagttaaagataaagaagcggataaatttcg

SEQ ID NO: 9482 - DNA, 538 bp, synthetic construct
  misc_feature 1..538: note = Description of Artificial Sequence: Synthetic polynucleotide
  source 1..538: mol_type = other DNA
cggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcg

SEQ ID NO: 9483 - DNA, 109 bp, synthetic construct
  misc_feature 1..109: note = Description of Artificial Sequence: Synthetic polynucleotide
  source 1..109: mol_type = other DNA
cgcggttttttttttacgcgaggtttttaaatttcgtaaattaacggaaatgaagttacgtttcgggagcggtgtttttgggaaatgtagtttagcgtttcggacgtcg

SEQ ID NO: 9484 - DNA, 901 bp, synthetic construct
  misc_feature 1..901: note = Description of Artificial Sequence: Synthetic polynucleotide
  source 1..901: mol_type = other DNA
cgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcg

SEQ ID NO: 9485 - DNA, 15 bp, synthetic construct
  misc_feature 1..15: note = Description of Artificial Sequence: Synthetic oligonucleotide
  source 1..15: mol_type = other DNA
cgttcgcgtcgttcg

SEQ ID NO: 9486 - DNA, 383 bp, synthetic construct
  misc_feature 1..383: note = Description of Artificial Sequence: Synthetic polynucleotide
  source 1..383: mol_type = other DNA
cgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcg

SEQ ID NO: 9487 - skipped

SEQ ID NO: 9488 - DNA, 624 bp, synthetic construct
  misc_feature 1..624: note = Description of Artificial Sequence: Synthetic polynucleotide
  source 1..624: mol_type = other DNA
cgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcg

SEQ ID NO: 9489 - DNA, 94 bp, synthetic construct
  misc_feature 1..94: note = Description of Artificial Sequence: Synthetic oligonucleotide
  source 1..94: mol_type = other DNA
cggtcggttttttcggttgatttcgttttggttgatttcgcgtatattttttttttagcgttgtaaggatcgtttgaattcgttggttatttcg

SEQ ID NO: 9490 - DNA, 63 bp, synthetic construct
  misc_feature 1..63: note = Description of Artificial Sequence: Synthetic oligonucleotide
  source 1..63: mol_type = other DNA
cgcggcggttgcgggattcgcgtggcgtcggcgacggttcggtttagttttgcgttttgtacg

SEQ ID NO: 9491 - DNA, 41 bp, synthetic construct
  misc_feature 1..41: note = Description of Artificial Sequence: Synthetic oligonucleotide
  source 1..41: mol_type = other DNA
cgatggcggataagagggcggggattttagaagtcgcggcg

SEQ ID NO: 9492 - DNA, 1041 bp, synthetic construct
  misc_feature 1..1041: note = Description of Artificial Sequence: Synthetic polynucleotide
  source 1..1041: mol_type = other DNA
cgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcg

SEQ ID NO: 9493 - DNA, 23 bp, synthetic construct
  misc_feature 1..23: note = Description of Artificial Sequence: Synthetic oligonucleotide
  source 1..23: mol_type = other DNA
cgttatggttcgagtcgaaggcg

SEQ ID NO: 9494 - DNA, 515 bp, synthetic construct
  misc_feature 1..515: note = Description of Artificial Sequence: Synthetic polynucleotide
  source 1..515: mol_type = other DNA
cgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcggttgttttttggagtatttttgttatagtatttttattttgggttagggtattttgttgcg

SEQ ID NO: 9495 - DNA, 1017 bp, synthetic construct
  misc_feature 1..1017: note = Description of Artificial Sequence: Synthetic polynucleotide
  source 1..1017: mol_type = other DNA
cggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcg

SEQ ID NO: 9496 - skipped

SEQ ID NO: 9497 - DNA, 54 bp, synthetic construct
  misc_feature 1..54: note = Description of Artificial Sequence: Synthetic oligonucleotide
  source 1..54: mol_type = other DNA
cgttttttttttcggtttttttcgcgtggtttgtttttcgttcgtttgcgttcg

SEQ ID NO: 9498 - DNA, 10 bp, synthetic construct
  misc_feature 1..10: note = Description of Artificial Sequence: Synthetic oligonucleotide
  source 1..10: mol_type = other DNA
cgataacgcg

SEQ ID NO: 9499 - DNA, 26 bp, synthetic construct
  misc_feature 1..26: note = Description of Artificial Sequence: Synthetic oligonucleotide
  source 1..26: mol_type = other DNA
cgcggtcgtttggtcgaatttgttcg

SEQ ID NO: 9500 - DNA, 934 bp, synthetic construct
  misc_feature 1..934: note = Description of Artificial Sequence: Synthetic polynucleotide
  source 1..934: mol_type = other DNA
cgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcg

SEQ ID NO: 9501 - DNA, 279 bp, synthetic construct
  misc_feature 1..279: note = Description of Artificial Sequence: Synthetic polynucleotide
  source 1..279: mol_type = other DNA
cggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcg

SEQ ID NO: 9502-9503 - skipped (2 entries)

SEQ ID NO: 9504 - DNA, 11 bp, synthetic construct
  misc_feature 1..11: note = Description of Artificial Sequence: Synthetic oligonucleotide
  source 1..11: mol_type = other DNA
cgatgcgttcg

SEQ ID NO: 9505 - DNA, 30 bp, synthetic construct
  misc_feature 1..30: note = Description of Artificial Sequence: Synthetic oligonucleotide
  source 1..30: mol_type = other DNA
cggttttttgagtagttgagattataagcg

SEQ ID NO: 9506 - DNA, 10 bp, synthetic construct
  misc_feature 1..10: note = Description of Artificial Sequence: Synthetic oligonucleotide
  source 1..10: mol_type = other DNA
cgcgggagcg

SEQ ID NO: 9507 - DNA, 56 bp, synthetic construct
  misc_feature 1..56: note = Description of Artificial Sequence: Synthetic oligonucleotide
  source 1..56: mol_type = other DNA
cgtttataaatcggtttcgttttttcgtgttcgggttcgtcgtttattagacgtcg

SEQ ID NO: 9508 - DNA, 98 bp, synthetic construct
  misc_feature 1..98: note = Description of Artificial Sequence: Synthetic oligonucleotide
  source 1..98: mol_type = other DNA
cgtgatttcgggtcgttttttatacgtgatcgtttttttttttttttttattttcgtattcgttttttttttagttttttgtttcgttttgttggtcg

SEQ ID NO: 9509 - DNA, 33 bp, synthetic construct
  misc_feature 1..33: note = Description of Artificial Sequence: Synthetic oligonucleotide
  source 1..33: mol_type = other DNA
cgacggcggcggtcgtttttgcgcgttttttcg

SEQ ID NO: 9510 - DNA, 48 bp, synthetic construct; identical to SEQ ID NO: 8766
  misc_feature 1..48: note = Description of Artificial Sequence: Synthetic oligonucleotide
  source 1..48: mol_type = other DNA

SEQ ID NO: 9511 - DNA, 93 bp, synthetic construct
  misc_feature 1..93: note = Description of Artificial Sequence: Synthetic oligonucleotide
  source 1..93: mol_type = other DNA
cgagggtagcggtggggttgggtcgggggagtaggggtcgcgtcgggtagcgtcgcgtgttggagcggaggcgggtgcggtcggggtaggtcg

SEQ ID NO: 9512-9518 - skipped (7 entries)

SEQ ID NO: 9519 - DNA, 42 bp, synthetic construct
  misc_feature 1..42: note = Description of Artificial Sequence: Synthetic oligonucleotide
  source 1..42: mol_type = other DNA
cgttgcgcgttcgttttttggtcgggcgcgcgtttcgtttcg

SEQ ID NO: 9520-9529 - skipped (10 entries)

SEQ ID NO: 9530 - DNA, 40 bp, synthetic construct
  misc_feature 1..40: note = Description of Artificial Sequence: Synthetic oligonucleotide
  source 1..40: mol_type = other DNA
cgcgtcggagtgcggttttgtttttagcgttagtgcgtcg

SEQ ID NO: 9531-9551 - skipped (21 entries)

SEQ ID NO: 9552 - DNA, 42 bp, synthetic construct
  misc_feature 1..42: note = Description of Artificial Sequence: Synthetic oligonucleotide
  source 1..42: mol_type = other DNA
cggagatcgtttcgtttttttagatcgaacgtcgttcgttcg

SEQ ID NO: 9553-9562 - skipped (10 entries)

SEQ ID NO: 9563 - DNA, 219 bp, Homo sapiens
  source 1..219: mol_type = unassigned DNA
cctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcg

SEQ ID NO: 9564 - DNA, 315 bp, Homo sapiens
  source 1..315: mol_type = unassigned DNA
cgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtc

SEQ ID NO: 9565 - DNA, 201 bp, Homo sapiens
  source 1..201: mol_type = unassigned DNA
gcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcg

SEQ ID NO: 9566 - DNA, 201 bp, Homo sapiens
  source 1..201: mol_type = unassigned DNA
aataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagc

SEQ ID NO: 9567 - DNA, 201 bp, Homo sapiens
  source 1..201: mol_type = unassigned DNA
cgcgcaccctccccgcccgcctgcccgcggttctcctcctgctcccggagcgccagtcgccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccg

SEQ ID NO: 9568 - DNA, 201 bp, Homo sapiens
  source 1..201: mol_type = unassigned DNA
atagagttgcttttccctttcttgggctttgcaagtctccgaattggaggcggaaatgggggaagggttggaagttgtgtgtgaaaaacaattattgcaacgggttttccccaggagcttagtccggcctgcatcctggtggaactgctgttaccggtccacagcgcccaggccgagccggcagggctgggcgggaggctt

SEQ ID NO: 9569 - DNA, 201 bp, Homo sapiens
  source 1..201: mol_type = unassigned DNA
cagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctg

SEQ ID NO: 9570 - DNA, 201 bp, Homo sapiens
  source 1..201: mol_type = unassigned DNA
aacaagcagcccgggagataccctcccctttcccagcccccgctcctccaccttgctaccccctagcccgtgaccagctgcctcccctccccctcgcgggcgctcagggttgagcaaacactccgggccgcccgccccgccaccagctggctccgaccggcgcaccgctggcgatcccccaggcaattcggcgtcatgaga

SEQ ID NO: 9571 - DNA, 201 bp, Homo sapiens
  source 1..201: mol_type = unassigned DNA
cgtggcctggccgaggagccaatgggccgggaggggcgcgcgggggaggagctcaggtgcagagtgccgattggccagttcgccctccggtatgcagatacggtgggagtcacgtgctaggggccgggacgacttcctgttggaggccaacgcggggcggggaagggggcgcgagcgccccgtctggctgaagcgggggga

SEQ ID NO: 9572 - DNA, 201 bp, Homo sapiens
  source 1..201: mol_type = unassigned DNA
ggaggaggggaggcgttgcccgacgcgccctttcaagtctccgcgctcccccccggcggcggctgcccgggggcggtggctcggcgtcgcctcccccgaccgccccctccagggcccctcctccgtgccgcggccaggctgcccggccggcggcgcgctggaaatatgaagagacgctgcagctgcggtggcggtggcggc

SEQ ID NO: 9573 - DNA, 201 bp, Homo sapiens
  source 1..201: mol_type = unassigned DNA
cccatctgggacgcgatccacaggggcgctgtcccgtcctgcgggaagaggaggcggcggccgccgtgactggggcgcccggccccacccgctcacagaacgtctttaacaccaggggtctgaaagcgaaaactccgggaaggcactccctgaccgcagatcacactctgcagctgatccacaccgcccaggaggcagtga

SEQ ID NO: 9574 - DNA, 201 bp, Homo sapiens
  source 1..201: mol_type = unassigned DNA
acaaaagagcagctcccgcggagcgggtccagagtctgcccggactgtccgatggccctcggccctctgagcgccgcggctgccgggctttgtgtccgcgcggggggcgggaaggacggccggggtccccagtgcgcgtcccgcggagcggcgcgcggcgcccgaactggaaagttgtcgccggcgcctgtcgcctccacg

SEQ ID NO: 9575 - DNA, 243 bp, Homo sapiens
  source 1..243: mol_type = unassigned DNA
gctaaggcccggaccgtcatcccagcaacagcctcagtcatgtgaccggcaatggcggcgctgacgagaggtaggtgagcccggcgccccccacacccaccgcgcgccccccgggccccgctcgcacccctcacgcgccccccgctcccccggcgccccctcctccacctcccctccccgcgcgcggctccgggctccccgctccgtgcccggccgatcatctttctagcaccctccagcctt

SEQ ID NO: 9576 - DNA, 201 bp, Homo sapiens
  source 1..201: mol_type = unassigned DNA
cagcccgctcacctcttcctggagaagcccgacgcagcgcccgccactccctcccctccgtgtgcagctccccggctctaaagcactcacttgtctaacccgattctcaccctacaagaccgcaaccggccatcacttctgccctccgccaggacaccgaggccagctgtgtcactgccccgaggggttgcaggtgcagag

SEQ ID NO: 9577 - DNA, 201 bp, Homo sapiens
  source 1..201: mol_type = unassigned DNA
tcgcagcaccggtcaccccactgccaagggtgttctttgtacctgttgcgatattttgggtcgttttcagcccagtttgcacagcacccttggccacgttcgcagcaccggtgaccccactgcagacagtgtccttggtaccggtcagcacggtcttggccgtgtctacacccatctggacggcccccttggccacattcg

SEQ ID NO: 9578 - DNA, 201 bp, Homo sapiens
  source 1..201: mol_type = unassigned DNA
tcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggc

SEQ ID NO: 9579 - DNA, 201 bp, Homo sapiens
  source 1..201: mol_type = unassigned DNA
agccggggcagaaggaggagcctgaaggtccaccatggggtggaggctgcctgctcgcgggcccgcccccagagcccggggctcatcacgctgctctatgcgcctctgttggctcctgccaaacagtccctcccttctgtgcctcagtttcctggctgtaaaaagggggtgctcacagagcccccttgaggagtcgtcaca

SEQ ID NO: 9580 - DNA, 201 bp, Homo sapiens
  source 1..201: mol_type = unassigned DNA
ttggcttttacctggtctgcgagaaatcaaactttgggcacaagtcatgaagccgacaagcccgggagacacagtgtcagaattacaaggtgagatcagccgcccggccaagctatcttctcgctagcaggtgaggcccgtgaacagccaagctccccttggcacggcggaaccgcagtggacgcgtggaggggctccgta

SEQ ID NO: 9581 - DNA, 201 bp, Homo sapiens
  source 1..201: mol_type = unassigned DNA
aaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacaggg

SEQ ID NO: 9582 - DNA, 201 bp, Homo sapiens
  source 1..201: mol_type = unassigned DNA
gacagaaggggagagtggccaggaaggaggggaggatggacacagggcgtctgcagaattggtgggcagatggacggagggacgggccgtgcagtgcagccggcggggccagggccaggccgagggcgcgaggtggcagccggcccggggaggcggaggctgagcgagcggtggtgtttgtggagctgtcggctgcggtgg

SEQ ID NO: 9583 - DNA, 201 bp, Homo sapiens
  source 1..201: mol_type = unassigned DNA
ggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgcc

SEQ ID NO: 9584 - DNA, 201 bp, Homo sapiens
  source 1..201: mol_type = unassigned DNA
ttactggtgagcttggtagggcacagagaggatggcactaccagctggagggggacaggccccaaccatgagcccaggatgcagagagcggcagggatcaccggagcccccccggctctggtgtcttggctcttcctgcacacggtctccacatgacgcccagcaagccggatctcaatttgttcacccatcctttatttt

SEQ ID NO: 9585 - DNA, 201 bp, Homo sapiens
  source 1..201: mol_type = unassigned DNA
gaggccaaggcgggcagaccactcgaggtcaggagccagagaccagcccggtcaacagggcgaaaccccgtctcctccaaaaatacaaaaaccagtcaggcgtggcggcgcccgcccgcaatcccaggcacttggcaggccgaggcaggagaaccacgggagcccggggcagggaggctgcagtgacccgagaccacggca

SEQ ID NO: 9586 - DNA, 233 bp, Homo sapiens
  source 1..233: mol_type = unassigned DNA
ggagagagagagagagagagagagacggagtcggagagggagggagcgagagaaagcgagagctcctcgccaccctccgccgcctctagaattcaccgggcgtctgctcggcggctctagaaggtcgggctgcgctgtgggctgcggggagccggaggcctcttgattggctctttgacgctttcggaccaattgtgttgctgcataggcgtggttttcacaggtcgagtgct

SEQ ID NO: 9587 - DNA, 201 bp, Homo sapiens
  source 1..201: mol_type = unassigned DNA
cgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccgg

SEQ ID NO: 9588 - DNA, 201 bp, Homo sapiens
  source 1..201: mol_type = unassigned DNA
tcctgagaagcagcagcagctggcctgcctgttgccccgcccccgtgcatggctgcccagcgctggccccagtgcccagcgtctccgcccagcacccccccggccctccctccccaccccccgcctccgagctgcggggagtcccagcctgggatctttgcctcatgtccttgggctcctgccctggctggcccgtccccc

SEQ ID NO: 9589 - DNA, 201 bp, Homo sapiens
  source 1..201: mol_type = unassigned DNA
ggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagctt

SEQ ID NO: 9590 - DNA, 201 bp, Homo sapiens
  source 1..201: mol_type = unassigned DNA
tttcctccagtacactttatgcaaaagtcagtaaaaatatttctcctataagtctaaacaaatgtttaaaaatatgtaagttaggaagttatttccaacacgcatattcttttcacatgcagaagtaatggtgagaatttttcatatcctttgcagcagactcccggccccggggctgggccctcagcaagctcattcctg

SEQ ID NO: 9591 - DNA, 201 bp, Homo sapiens
  source 1..201: mol_type = unassigned DNA
ctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgcccc

SEQ ID NO: 9592 - DNA, 201 bp, Homo sapiens
  source 1..201: mol_type = unassigned DNA
gggactgggaacgggatagggacgcgccccaactcactcagcggtggagctggggggcggcgcggtcacgtgggatggcgggcagctcaggggatccgggcgacggggtctggcgggcagggttgttccagccgcctttataaagccggcctccccgacccctcctcctctctgcagctctcccctcctcccttgggggct

SEQ ID NO: 9593 - DNA, 201 bp, Homo sapiens
  source 1..201: mol_type = unassigned DNA
cagccacccacctgccccccacgccccactcaccagcgcgcacggccccggcaacctcacccggagcggggcgccgccgccgcctctgccgcagcccggccgggccgctgggcgcaggggactccgcgccgccgctgccgctgccgccgccgccgccgccgctgccgctgctgcatcccccggcgagcgctgctgctcctc

SEQ ID NO: 9594 - DNA, 201 bp, Homo sapiens
  source 1..201: mol_type = unassigned DNA
tttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggac

SEQ ID NO: 9595 - DNA, 201 bp, Homo sapiens
  source 1..201: mol_type = unassigned DNA
gggagggaagaaggaggcggcgagcgggaagaggaagaagacgcaggcagcgctaggcgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggttcc

SEQ ID NO: 9596 - DNA, 201 bp, Homo sapiens
  source 1..201: mol_type = unassigned DNA
ttcagccggtccctcgcatgactggatcacatgagggacccaagcccggccagctgccacctttcggaccacatgcgtgctcagggaccgctctccaactcggcatggggacttggaaaaaaagatcagggcagagggactggggccgggcccggtgaccgctcctcggcaaccaaaggacagtaaaggacggtccctgac

SEQ ID NO: 9597 - DNA, 410 bp, Homo sapiens
  source 1..410: mol_type = unassigned DNA
cgcatgcgcccaggccggtccgcaggcctttctcgccccagccggcagccagctcgttcgcgctggggtcaccgcgagccggtccgcagcggggtcaccgcgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcgcggattggaggtttccggttggaaaagccccttggcggctaactggggaggactggaagaaatctaggatggagccagcactgctggcccaacatgtct

SEQ ID NO: 9598 - DNA, 201 bp, Homo sapiens
  source 1..201: mol_type = unassigned DNA
aagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctc

SEQ ID NO: 9599 - DNA, 201 bp, Homo sapiens
  source 1..201: mol_type = unassigned DNA
tctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccc

SEQ ID NO: 9600 - DNA, 201 bp, Homo sapiens
  source 1..201: mol_type = unassigned DNA
actcttggatcaggaaacagtgtgtgtgtacacgagagagagggacagagagaggggggacatgtggagtgcactggaaccaccataacccccatgaaggcggcaccggagttattggcattatttgtgcaactcttcttcatgcttgacgtcgtttcaaaataaagagtgagctgagcaaatcaactcggcagggcacat

SEQ ID NO: 9601 - DNA, 201 bp, Homo sapiens
  source 1..201: mol_type = unassigned DNA
gcggcggggctgggtctggggctggacgttgacctaggaccccgcccctgcccgccctgcgccgcgcccctcccgggccggccttgaccgagcagctccacgcgggcccggggctcgtccacccgacaggagcggggggctgcagcccacgagcccacgagcccgcagcgacgcacccggagtgtaacctcgcagagtcac

SEQ ID NO: 9602 - DNA, 201 bp, Homo sapiens
  source 1..201: mol_type = unassigned DNA
gcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctcc

SEQ ID NO: 9603 - DNA, 201 bp, Homo sapiens
  source 1..201: mol_type = unassigned DNA
gccgcgccgccgggcctcggggacacccctcgccgcctcccccgactcgcgccgccggggccgccgggccgcagggcacggggccggcgcggggggggagcggagaggggctggggagccccaggggtccggggcccgcccgcgggggatgggcagggaccccgggccgcgtggggtgcgggggccgcccgcattgaggac

SEQ ID NO: 9604 - DNA, 201 bp, Homo sapiens
  source 1..201: mol_type = unassigned DNA
ttcccttttaaaaagagcctcccagagctgtcgaaatctccgcggggtgaaagctaaacttttggagtcgctgtgtagccgggtagaggacacggcggcgcgagccggaaagataagtgtccaggcgaatgggaaaggaaagatcttaatttttgttcctactgttagctgaatgtccataaaaatcaaagggaatgcggg

SEQ ID NO: 9605 - DNA, 201 bp, Homo sapiens
  source 1..201: mol_type = unassigned DNA
atggctcactgcgcaagctcacacccagtcccaggaagcgagccccacgtcgccccagctctgcattcacagccgccaagcggtcccggaagccgaatgccggataggtcaaagacagcgccgctgctccggcactgccgccagagggcgcggagtcgccgtgttggcctgcacctcccttgtcacgtcagccgaacggct

SEQ ID NO: 9606 - DNA, 201 bp, Homo sapiens
  source 1..201: mol_type = unassigned DNA
gcggcccggaaatgagcgccctccggggacagggggctctgcggggcggcgacagctggattcccagcgcgcacaaagcctgcgggaggatccattgtagcggtcgctcctccccgcttagcgagggcgggcgcaggggcgggggatgtcgaagggtcaggtttgtccaggccgcgccaccttcgtttcagacgttcagtt

SEQ ID NO: 9607 - DNA, 201 bp, Homo sapiens
  source 1..201: mol_type = unassigned DNA
cctcgagggccgcgcgggctcaggcgcccacggccccgcagcgccgcgcttctcgcgagaacgcagagacccgggtccgccctgagccgccgattgcgggcgggagccggcgggcaaggcgcgcggccggcagccggagcggcgcgtaacgcagctgagtgaggtcgtcggtggaggcacggagcagcaggcgcccggggc

SEQ ID NO: 9608 - DNA, 294 bp, Homo sapiens
  source 1..294: mol_type = unassigned DNA
tcccgcgaaggccccggcccggccgggcggggtggggcggccccggcctcattaatcagcggcttgttgtggatgccggcggaggagatgccacccagggcgggaaaaggggcgcggaagaggggcggggcgggccacggcgcgcagggcccttccctcccgcctcggactcaattaattgggcttgagcttccgccggggagggggcgccgggcggggccgcggctgggcggggcgggggatcgggatcggcggcgggggctgcggccttgcagtggaagcatgggcggcgag

SEQ ID NO: 9609 - DNA, 201 bp, Homo sapiens
  source 1..201: mol_type = unassigned DNA
gtgtggaggctcacgcagcgcttctggctggaacggggaagcctgcacttagctttgggagtgggtttgggagagggaggaggagccgccgggagtctggcgggagggcggtgttcccgtctgggttcctctctgctgtcccagccccggtagcttccacagcagcctcgaagggtgagaatttgctcttctatggacttg

SEQ ID NO: 9610 - DNA, 201 bp, Homo sapiens
  source 1..201: mol_type = unassigned DNA
cttcccagcctccagagcaagccaatcagggacacgctctcgtggcccagttcggaaacaatgcttggtgggaacctgcaatcttggctgccggaaccttcggggaggattaacgccggcgcaccgtgcggccggggcggggcgccgcccaaactcaggccctgtgacagcgactgtggcggtctggaaagcgtgggcctc

SEQ ID NO: 9611 - DNA, 201 bp, Homo sapiens
  source 1..201: mol_type = unassigned DNA
aaccacccccaaaataacccctccggggggtgagaggcaattataaccccagcgagcggagggcgcgggggatgggcgccgggcgggcgggggcggggagcgcggcgcgggtccccaggtggcgagcggaggtgctcccgccgcggggggaggggcgggggcgcacgcggccggcggcggggggaggcggcgcgcggggga

SEQ ID NO: 9612 - DNA, 201 bp, Homo sapiens
  source 1..201: mol_type = unassigned DNA
aggccttcgcacccaccgcgtgggctcctgccctggcctcacctgcccccgacactccccgtccccgcgatgcccaactccggcccgagaaggctggccgcgacctcgcccggtacccgccgccccgacaccaccattcgcctcctcgacctcccccggcgccgctgcccacccgcccctcgccccgctcaccggggccgc

SEQ ID NO: 9613 - DNA, 201 bp, Homo sapiens
  source 1..201: mol_type = unassigned DNA
ggggacgcccgcccctcttccgggcagccccttccacccaggcgggatctgggtccccgctggactcagggccgccttcccgcaggcggggccggcccggcgcgcaccttgtctcggatgccctggcgcacggcctcgcgctccgcctccatcttggcgtacttggccttgcgctcctcctccgcctggcgcagcgcctcc

SEQ ID NO: 9614 - DNA, 201 bp, Homo sapiens
  source 1..201: mol_type = unassigned DNA
cactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaacttttttaccccctgccctggttttatctgtttcttttctcttt

SEQ ID NO: 9615 - DNA, 201 bp, Homo sapiens
  source 1..201: mol_type = unassigned DNA
cagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcg

SEQ ID NO: 9616 - DNA, 201 bp, Homo sapiens
  source 1..201: mol_type = unassigned DNA
ccagataggcatggtcaaggcagcctgtgactcatttcacaaaaccagagactcttgttctttgtggagcaagacttcccggaggctagagcaggatgatcgtcaacttttctccttagagccggttcagtctgataaagcaggggccaccccggagtttggaggggaagagagcccaggcacaaggccatccctgggaaa

SEQ ID NO: 9617 - DNA, 201 bp, Homo sapiens
  source 1..201: mol_type = unassigned DNA
gggcgcgcggcgccctccatccacgcccggccggggcgcggcgcggcggcgggcacccggacggccggcggaggcaggccggcccgggtactagcctgggcggcccgcgggccggggcggcggcggggtggcggtggcggcggcagcagcgcggagccggtgggcgcagccgcgcgccaggccggcggtcggggtttgggg

SEQ ID NO: 9618 - DNA, 201 bp, Homo sapiens
  source 1..201: mol_type = unassigned DNA
cttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccg

SEQ ID NO: 9619 - DNA, 463 bp, Homo sapiens
  source 1..463: mol_type = unassigned DNA
acgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgct

SEQ ID NO: 9620 - DNA, 201 bp, Homo sapiens
  source 1..201: mol_type = unassigned DNA
accgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccc

SEQ ID NO: 9621 - DNA, 201 bp, Homo sapiens
  source 1..201: mol_type = unassigned DNA
gctccacagccccggccagaacttggtgggggacgcggggggggggtgtttgacggggagggggcacagtcctttcgggccaacttccacattcctgctccgcccaggcggggggtgagtcggggtgagcagccggctccaagctggccggcttcctggaaagggagggccagcaggagaactgcagatcctcccagccct

SEQ ID NO: 9622 - DNA, 201 bp, Homo sapiens
  source 1..201: mol_type = unassigned DNA
gggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggagctccgccct

SEQ ID NO: 9623 - DNA, 201 bp, Homo sapiens
  source 1..201: mol_type = unassigned DNA
gcttccagaggcccagccctgtcccctactacacacagctaccaccccacccgcccctggggctcggctgcccttcccggtgtctcttaaacccctcccccgacctgggtgttaagcccacccacctcccggcgccgcccccggtcgaacagcctcttgcccttccttcgcctgggccggagccccccgcagcctcctccg

SEQ ID NO: 9624 - DNA, 201 bp, Homo sapiens
  source 1..201: mol_type = unassigned DNA
ggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgacta

SEQ ID NO: 9625 - DNA, 201 bp, Homo sapiens
  source 1..201: mol_type = unassigned DNA
accgagcccaaaagccgccggcggcacatcccagcggcctccctcctcccgggctgggattcgcctctgcaagaaacgtcatgttttctctcccagacatcgttccgggagccccagatgtaaaatcagaggtctcttatctggcattattgatctctgtgctaataaaatgtcagtccccaagggaaaacttaaaaaaag

SEQ ID NO: 9626 - DNA, 201 bp, Homo sapiens
  source 1..201: mol_type = unassigned DNA
gccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtct

SEQ ID NO: 9627 - DNA, 201 bp, Homo sapiens
  source 1..201: mol_type = unassigned DNA
ggcggcgcgcggcagagctgggtctcccgccaggtggccgggggtgtgccctcagggtaccctacccgctacccccgcgcctccagtcccggcggccgcgcggaccccgcccctgctgaccccggcgcacgctcccgcgccgcgcgcagcctcccgcctcccgccgaccccgccgcgccgccggcagccctccccagcccc

SEQ ID NO: 9628 - DNA, 201 bp, Homo sapiens
  source 1..201: mol_type = unassigned DNA
tcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggc

SEQ ID NO: 9629 - DNA, 201 bp, Homo sapiens
  source 1..201: mol_type = unassigned DNA
agccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactagg

SEQ ID NO: 9630 - DNA, 258 bp, Homo sapiens
  source 1..258: mol_type = unassigned DNA
gcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagag

SEQ ID NO: 9631 - DNA, 201 bp, Homo sapiens
  source 1..201: mol_type = unassigned DNA
ccgacggccaaggaaagcccaccagccctccgcaccgtgggcgacgggccaagacccggccctaaacggccagacccagcccctagtcggctgccgcccccgccccacgcaggcgcgctccggggccctcccctcccccaccgcgcgctcgcggggcccgacgggggcggagcgaccctcggaaggggcgtggcgaccggg

SEQ ID NO: 9632 - DNA, 201 bp, Homo sapiens
  source 1..201: mol_type = unassigned DNA
agggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctg

SEQ ID NO: 9633 - DNA, 201 bp, Homo sapiens
  source 1..201: mol_type = unassigned DNA
cccgtcgcgccccggccgggatggacccacacgcccgatgagccccgcgccggcggctgcgagcgccgagcctccccctgctgcggccccagccgccccccgcgcgcccggctccgcggaccaggacccctgggctccccggctgagggcgcggccgctccggagaggccgagcggggacgggcccgagatggcgcgggga

SEQ ID NO: 9634 - DNA, 201 bp, Homo sapiens
  source 1..201: mol_type = unassigned DNA
cagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggccc

SEQ ID NO: 9635 - DNA, 201 bp, Homo sapiens
  source 1..201: mol_type = unassigned DNA
tgccgggctcgacgtgcacagtccagcgctcctccccactagttactgcccaggccccccgatcctgcacccgccggaatgagagaaagtagcccctcgccgcccagctcccgggtagctgctccggccgggccttgcgttggtgagaaagttccatctagaggcggccgcgcgcaactgcaggcggcgccctaggcccgg

SEQ ID NO: 9636 - DNA, 201 bp, Homo sapiens
  source 1..201: mol_type = unassigned DNA
cgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgag

SEQ ID NO: 9637 - DNA, 201 bp, Homo sapiens
  source 1..201: mol_type = unassigned DNA
gtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgct

SEQ ID NO: 9638 - DNA, 201 bp, Homo sapiens
  source 1..201: mol_type = unassigned DNA
agtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccgggga

SEQ ID NO: 9639 - DNA, 201 bp, Homo sapiens
  source 1..201: mol_type = unassigned DNA
gcctgcggagggtgggaccccacagcttgtccacctgcccaggctgagacctcgtgtcctagtcctggatgccccacgggtttctcgtcccgggcagcggcgcacgggaggagaagactcccggtctgcagtcagacctccctctgagaccctccctagctcaggcttagagctttgggatttttctcgatcctttctagc

SEQ ID NO: 9640 - DNA, 201 bp, Homo sapiens
  source 1..201: mol_type = unassigned DNA
ccggcccctcctcccgcggggggctccgtcccgcgccccgtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggc

SEQ ID NO: 9641 - DNA, 203 bp, Homo sapiens
  source 1..203: mol_type = unassigned DNA
gcgagcggctacggggtggggagcaaggggcgcgcgggcggcaggcatggaacggacgcggcgcatctcgcccaccgcgggacgcccggacggcggccggcgcgcgcggcccgcctcgagcccgagagggcggggagacaatgcctgtccggcggggcagtccaggccgcacgctcccgcccgcggacacgggccgctcctac

SEQ ID NO: 9642 - DNA, 201 bp, Homo sapiens
  source 1..201: mol_type = unassigned DNA
tcgtggagccgcgctaggccacggggtcccggccagacgggagcgccagcccctccccctgtcccgatgtccccaaacccaggctcagcccctccctccccgacccgatgacacccctgggtcctagaatgctgctgggggcgggagaccggagaagaagcaggtgcacggggaggtgggtgtcctgccctctgcgaggag

SEQ ID NO: 9643 - DNA, 201 bp, Homo sapiens
  source 1..201: mol_type = unassigned DNA
cctgggggggcgggccggacctgaaggccacaggcctcctcctgcgcctacccctcctgcaacccccacagcctcccccgccgaccccttcatgcccccccgcccccctgcccggcgctcctccccggccgcgggctaattggctgtgacagctggagccctgggcagctgagcggtgtcactgcaaattaggcaggcgct

SEQ ID NO: 9644 - DNA, 201 bp, Homo sapiens
  source 1..201: mol_type = unassigned DNA
ctggaagggcgggggcggtgacagcggcaggggcgggacccggaggcggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgccc

SEQ ID NO: 9645 - DNA, 201 bp, Homo sapiens
  source 1..201: mol_type = unassigned DNA
ccgcaccccgcccgcctgctcttcaccggccaggccctgccgggtcgccgcggcctcggcgccccaccccctcccgggccagcggggggctgggagggggcgaggaggaagggggttctcctctcccctccccggagggggccgcagcggcggctccggctcctcctctccctcacaccccctcccgcccccctctacctg

SEQ ID NO: 9646 - DNA, 201 bp, Homo sapiens
  source 1..201: mol_type = unassigned DNA
ccggagggagggggcaaaggaagaaaaagaaagcgcgctcggaaagccggcttgggtcctgctaattattctgaaggcaaagtacctgcactctccccgccgaggctggctggcggcgccgcgccggaggggaggaggctcgggaggaggaggagaaagagcagcgggaggactcgggctgggaggggagcgcagggttgg

SEQ ID NO: 9647 - DNA, 201 bp, Homo sapiens
  source 1..201: mol_type = unassigned DNA
tcgccggggagccgcaaagcctgacggaagaggctgcggttctcgcgcttcagccgccggttctcgagccgcagccgggcgttctcctgacgcagccgcgcgttctgccggtcccactcgtcccgcgcacggatggcctccaagtggctcgccgccaggtcggcaaaccgctcctccagctgctgtcgggcgccgtccgcg

SEQ ID NO: 9648 - DNA, 201 bp, Homo sapiens
  source 1..201: mol_type = unassigned DNA
gcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggg

SEQ ID NO: 9649 - DNA, 201 bp, Homo sapiens
  source 1..201: mol_type = unassigned DNA
gcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggcca

SEQ ID NO: 9650 - DNA, 201 bp, Homo sapiens
  source 1..201: mol_type = unassigned DNA
aaccatcagagaatcctctcaaaaacacagacccgatgaggagtggcttccccgcctttcccctgtgccgagaagggatcccggtcgccaacaacaaagacgcttcccgctcccctccccccgccggcccgggctcgtccctcccgcgctgcggctcccggcctagcgccccctccccgagccgggctgcggcgtccccaa

SEQ ID NO: 9651 - DNA, 201 bp, Homo sapiens
  source 1..201: mol_type = unassigned DNA
ggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagacc

SEQ ID NO: 9652 - DNA, 523 bp, Homo sapiens
  source 1..523: mol_type = unassigned DNA
ctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcgaagcggcctcggcgctgccgggccaggggtgccgtcaccgtcactgtgcgcgcccagagccgcacacgcgctctgaggcagtgaggggcccggtactct

SEQ ID NO: 9653 - DNA, 201 bp, Homo sapiens
  source 1..201: mol_type = unassigned DNA
cggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccg

SEQ ID NO: 9654 - DNA, 201 bp, Homo sapiens
  source 1..201: mol_type = unassigned DNA
gcctccgcccaagtgtggctcccttgggcccacaccccatcaggccagcaaggagggggatagcggggggcggggcaggtgctgggactccgggcaggtgcggggaaggcagggggcggggggggaaggggttgggcgatgcaggtgttgggggccgggacagttgcgggggtaggcaggtaccgggaaggcgggagggcg

SEQ ID NO: 9655 - DNA, 201 bp, Homo sapiens
  source 1..201: mol_type = unassigned DNA
cgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccgggg

SEQ ID NO: 9656 - DNA, 201 bp, Homo sapiens
  source 1..201: mol_type = unassigned DNA
gggtcggctccgcggccgacctggggcaccgcgccggggtgaggcctggcgaggaggcgaaggctgcaggcgtgaggtgaaggccgcaggccggccgggccgattttcgctatgtaaatatcggtgagggggggggagggacgggggacaagatggcggcggctcggcgcctgctgcaggggacgatagagggggttgccg

SEQ ID NO: 9657 - DNA, 201 bp, Homo sapiens
  source 1..201: mol_type = unassigned DNA
ccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcg

SEQ ID NO: 9658 - DNA, 201 bp, Homo sapiens
  source 1..201: mol_type = unassigned DNA
gcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggaga

SEQ ID NO: 9659 - DNA, 201 bp, Homo sapiens
  source 1..201: mol_type = unassigned DNA
aatgtgattatagttaacacatgacccttctagcgtcccagccagtgtttttcctgacctctgttctttggagaggaggatggaagggaggggtccggcacgctgctggcattttgctgtgtcctgcagcccctttccgggacacctgggttcacacagctttttagcttacataactggtgcagattttctgtgtggaga

SEQ ID NO: 9660 - DNA, 301 bp, Homo sapiens
  source 1..301: mol_type = unassigned DNA
tttttttccaatttctggcggcgggcggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcgccctctgccaaccaagagaaacacggttaaatgagtgcgctgggacagaaatccacagctaatcaaggccccatccgc

SEQ ID NO: 9661 - DNA, 223 bp, Homo sapiens
  source 1..223: mol_type = unassigned DNA
gcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctgg

SEQ ID NO: 9662 - DNA, 720 bp, Homo sapiens
  source 1..720: mol_type = unassigned DNA
gacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctg

SEQ ID NO: 9663 - DNA, 1683 bp, Homo sapiens
  source 1..1683: mol_type = unassigned DNA
tagtggcagtgttgagcccaggaatacgcgcggagcccgcggcgatccccgcggccgctcagtcttcgcggcggactccggcgcgcaggagccactgggccgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcgatggtggaagctttgggctggagggctgggagcttattgagtttcgcctaatctgatctaccccccctccgccccccgccttttgcaccctccctcggt

SEQ ID NO: 9664 - DNA, 233 bp, Homo sapiens
  source 1..233: mol_type = unassigned DNA
ccccgcccgggccgctcggctcggctgtgctctgctcggctagggcgggcgggtccgcccctcctccggccggcgccctccccctggctccccccttccccgcgtcgcccgctcccgctccccccgcctccccggcgccggcgcagcccccgcgaacccgggcgcaccaccccgggtgtcccggcctggggaccgctgccgccccggccgctgctcctttaatctttttgttt

SEQ ID NO: 9665 - DNA, 213 bp, Homo sapiens
  source 1..213: mol_type = unassigned DNA
gactgcgcgtgcgtagagcacgccggcgcggccccgggactctcgcgataactgtactgagataaagtgtggcaactcgagctggctggtgattcatcctcggcgaggggctcgcgtgtgggccacgtcgccgtctccaccgggaaagcggggaccagtggggggggcccagctgcagggtagtgggaggatgctgtttgctttgggggaagg

SEQ ID NO: 9666 - DNA, 236 bp, Homo sapiens
  source 1..236: mol_type = unassigned DNA
ggcagcgccgcctgcgccgcgttcagcacgaagagctcgctccagctcaggcgcagcagcgccacctggtcggccaccggcagctcggggaagaagggcgcgtggcgcgcccactccacggtgctgaagagcagccgcgccgccagctcgcacacgttgtcgatgcccagcaccgcgcccgccgcgccgccccctgcgccgaagcgtccggccgccgcagggtagggctcagcgcg

SEQ ID NO: 9667 - DNA, 233 bp, Homo sapiens
  source 1..233: mol_type = unassigned DNA
gagggtggggttttaaacgttatccaatcagcgacgctgggctgggaactgtccaatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaa

SEQ ID NO: 9668 - DNA, 737 bp, Homo sapiens
  source 1..737: mol_type = unassigned DNA
aatgacgtcgtaaacaatagcactaaccaccatcgtccgcagctcccgcgtacagaggcctcaggctcccggctccacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccgaagaaggaactggagggccgggctgggaaggcctgaagcgggtacagcctttaggctggggagggtcgaggggagaactcggagcctgagtcgggcgag

SEQ ID NO: 9669 - DNA, 308 bp, Homo sapiens
  source 1..308: mol_type = unassigned DNA
tccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgt

SEQ ID NO: 9670 - DNA, 1100 bp, Homo sapiens
  source 1..1100: mol_type = unassigned DNA
ctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatca

SEQ ID NO: 9671 - DNA, 214 bp, Homo sapiens
  source 1..214: mol_type = unassigned DNA
ggcgagagcaaaaaaaaaaaaaaaaaaaaaaaaaaaaaccctaactgtaaatattatttggaggtgggcgagggcgcggcgtgcgcgcggcggcgggtggcgggcggcgcgggcgcccttgcggggattcccggtctctcagcgcgccctagtggacgccctgcctttcgctggctccccgtgctcgttacaatctgcaatatattatttcttc

SEQ ID NO: 9672 - DNA, 582 bp, Homo sapiens
  source 1..582: mol_type = unassigned DNA
ctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagct

SEQ ID NO: 9673 - DNA, 203 bp, Homo sapiens
  source 1..203: mol_type = unassigned DNA
ggcgacactcgcgccagctcccgggacggctgggctcgggctggtcgccgacctccgaccctccactagatgcctggcagagcccggcgcgtccggagcccgcgcccctcagagggaaggggtcgcgcgtcgccgcggcggccctgaggctgacggtcgggaggtgaaaggccggagtgcggggtcaggacgcctcctggagg

SEQ ID NO: 9674 - DNA, 823 bp, Homo sapiens
  source 1..823: mol_type = unassigned DNA
cgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttg

SEQ ID NO: 9675 - DNA, 293 bp, Homo sapiens
  source 1..293: mol_type = unassigned DNA
ccgcgcggccctcataatgcagggactcctctgagtggtggccgtcctcgtcccagccctcggtcacccgcagcttcacaccgggccactggttcatcaccgagatagccagcgagttcaggcggtccttgcagcgctgggagaggaatgtgcgcgaaatcaaccagagcgaaatcagccggaggagccggccgaggtgcaggtgtaggcgcagcctcgcccagaactctcccgccacacccaagggagctggaagcccgggagggtgctgtccctctcccttaggaacagag

SEQ ID NO: 9676 - DNA, 262 bp, Homo sapiens
  source 1..262: mol_type = unassigned DNA
cggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgc

SEQ ID NO: 9677 - DNA, 240 bp, Homo sapiens
  source 1..240: mol_type = unassigned DNA
ccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggc

SEQ ID NO: 9678 - DNA, 1240 bp, Homo sapiens
  source 1..1240: mol_type = unassigned DNA
agcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgcc

SEQ ID NO: 9679 - DNA, 222 bp, Homo sapiens
  source 1..222: mol_type = unassigned DNA
gggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttatt

SEQ ID NO: 9680 - DNA, 714 bp, Homo sapiens
  source 1..714: mol_type = unassigned DNA
ttcagggaaagtctttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggggcaggaaaaaggaatcaca

SEQ ID NO: 9681 - DNA, 1216 bp, Homo sapiens
  source 1..1216: mol_type = unassigned DNA
aagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaag

SEQ ID NO: 9682 - DNA, 207 bp, Homo sapiens
  source 1..207: mol_type = unassigned DNA
agttccccgcaaattccgcccttcccgcctggcacggttcccttgcaccgctgtgctccgctcccaggtttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggcc

SEQ ID NO: 9683 - DNA, 253 bp, Homo sapiens
  source 1..253: mol_type = unassigned DNA
acgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagcc

SEQ ID NO: 9684 - DNA, 209 bp, Homo sapiens
  source 1..209: mol_type = unassigned DNA
ggacggcctgtgagggatgcgccgcccactgccccgcgccgcctgaccgtccccgcctcgactcgcggtgcgccacagccgggcccgcggccgtccccgccgcgttgtcgcccggtcgccgcgcccgcggggccgcgcccggcacggccatgtggacccccacggaggaggagaaatacggcgtaggtaggtgaggctcaggcctggcc

SEQ ID NO: 9685 - DNA, 225 bp, Homo sapiens
  source 1..225: mol_type = unassigned DNA
cgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcag

SEQ ID NO: 9686 - DNA, 1133 bp, Homo sapiens
  source 1..1133: mol_type = unassigned DNA
aaggagagttggaagggttcgtgcagcaggacagcgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcgccctgccccgcaggtgagcggctgcgcctccccactgcttctcctcctcccgcgcctcgccggcgctgaaaagctacccacttgcgtcgcttctcctcc

SEQ ID NO: 9687 - DNA, 478 bp, Homo sapiens
  source 1..478: mol_type = unassigned DNA
cggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccgcccgggccctctaagctgccagccgcgcccgcctccgggctcctcgcccctcctcccgcgcgctcccctcctcagcggccgccggaccccctcagttca

SEQ ID NO: 9688 - DNA, 201 bp, Homo sapiens
  source 1..201: mol_type = unassigned DNA
ccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaa

SEQ ID NO: 9689 - DNA, 208 bp, Homo sapiens
  source 1..208: mol_type = unassigned DNA
gatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagc

SEQ ID NO: 9690 - DNA, 210 bp, Homo sapiens
  source 1..210: mol_type = unassigned DNA
actccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctgg

SEQ ID NO: 9691 - DNA, 229 bp, Homo sapiens
  source 1..229: mol_type = unassigned DNA
tggctcacctgagctcaggggtttgagaccaggatgaccaatatggtgaaaccctgtctctactaaaaaatacaaaaattagccgggctatggtggctgacgcttgtaatctcagctactcaggaggccgaggcaggagaatcacttgaacccaggagcggacgttgcagcgaccggagatcgtaccaccgcactccagcccgggcgagagggagaccctgtcttaaaa

SEQ ID NO: 9692 - DNA, 209 bp, Homo sapiens
  source 1..209: mol_type = unassigned DNA
aggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagag

SEQ ID NO: 9693 - DNA, 255 bp, Homo sapiens
  source 1..255: mol_type = unassigned DNA
gaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataac

SEQ ID NO: 9694 - DNA, 297 bp, Homo sapiens
  source 1..297: mol_type = unassigned DNA
aggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatggtgag

SEQ ID NO: 9695 - DNA, 232 bp, Homo sapiens
  source 1..232: mol_type = unassigned DNA
gtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgacta

SEQ ID NO: 9696 - DNA, 247 bp, Homo sapiens
  source 1..247: mol_type = unassigned DNA
ccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaaggg

SEQ ID NO: 9697 - DNA, 292 bp, Homo sapiens
  source 1..292: mol_type = unassigned DNA
gccccccgagccccctgcggcgactccgattcacccccgcgggtgcggggcgcggacccgcccggcccagctcctgctccccaggcgcttcctcctcccgcgacctgccccggccgcacccgcctccgctccagcacgcgacgctgcccggcgcgacccctgctcccccggcccagccccaccgctgccctcgactcaatcccagttgaacgcccgcagcctcagtcccacccccggcccagccccagcgcccccagtcccacccccggccccagcttcagcctcagcgccc

SEQ ID NO: 9698 - DNA, 201 bp, Homo sapiens
  source 1..201: mol_type = unassigned DNA
gcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagca

SEQ ID NO: 9699 - DNA, 201 bp, Homo sapiens
  source 1..201: mol_type = unassigned DNA
ggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggt

SEQ ID NO: 9700 - DNA, 201 bp, Homo sapiens
  source 1..201: mol_type = unassigned DNA
gggcgcggccgggcaggttggggggcaggtaggggccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcg

SEQ ID NO: 9701 - DNA, 201 bp, Homo sapiens
  source 1..201: mol_type = unassigned DNA
acccccttcctccatcctccctcttcttcccccattgtcctccccatccttcccttcctcccgcctcctcccctggctcctcctctccccgtccgggactcggggggaggcgcgctgggtggtccggcagccgggggcgggcggtagcctgcaggcgtaattggcatgcacgccgttgtagctgagaccgcttaataaagc

SEQ ID NO: 9702 - DNA, 201 bp, Homo sapiens
  source 1..201: mol_type = unassigned DNA
ccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtg

SEQ ID NO: 9703 - DNA, 201 bp, Homo sapiens
  source 1..201: mol_type = unassigned DNA
gtgcggccggggcgctgcccggcagtgcggtgtccacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccc

SEQ ID NO: 9704 - DNA, 201 bp, Homo sapiens
  source 1..201: mol_type = unassigned DNA
catcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctg

SEQ ID NO: 9705 - DNA, 241 bp, Homo sapiens
  source 1..241: mol_type = unassigned DNA
ctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcg

SEQ ID NO: 9706 - DNA, 201 bp, Homo sapiens
  source 1..201: mol_type = unassigned DNA
ggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggc

SEQ ID NO: 9707 - DNA, 201 bp, Homo sapiens
  source 1..201: mol_type = unassigned DNA
aagtggggtgaaaatgacctcagtgaatagcccagctccctgggacagtggcctggtatttttgacgtgggagtggcgtctgctctgactcaacctggaccggcccagggacaacacctccttcggagtagccgctttgtttcgtttcgagcagcccagctgcgttctgcatgaccgaattggacacctctcacttcctct

SEQ ID NO: 9708 - DNA, 201 bp, Homo sapiens
  source 1..201: mol_type = unassigned DNA
cccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgc

SEQ ID NO: 9709 - DNA, 201 bp, Homo sapiens
  source 1..201: mol_type = unassigned DNA
acggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggacc

SEQ ID NO: 9710 - DNA, 201 bp, Homo sapiens
  source 1..201: mol_type = unassigned DNA
tccagatggtttcaatcactggaggaaaaaagcggctcttctggtatgcgtgaaaagccggagctgggagagtctgggaaaagctgcctgcaccgcccgccggccttcaaacaaaccgatgagctctttcccttctcccagttctcgggcctcgggggagccctacaaaacccaaatgaaattcaaagaagctacttttgg

SEQ ID NO: 9711 - DNA, 201 bp, Homo sapiens
  source 1..201: mol_type = unassigned DNA
ccacaaagcatcagtggtgtctccccgaggaatccaagaccccccggccggttgccaagccgccggaatttcagcaggagaggaaggctcaccctcccaccgcatggcgatgcccgggagactggagaagctcaggcaggcttggaagccaatccccggcatacagcagctctcgggaatgcagagccctagagcaagacc

SEQ ID NO: 9712 - DNA, 201 bp, Homo sapiens
  source 1..201: mol_type = unassigned DNA
tagtagagacggggtttcaacatgttgcccagggtggtttcgaactcctgagctcaggcaatccgcccacctcatcctcccaaagtactgggattacaggcgtgagtcaccgcgcccggtctgacagcctttccagaatgaagtttgtctcggaaaaaagagccctggccagtgtctcctctggggatcagcggaaagcac

SEQ ID NO: 9713 - DNA, 201 bp, Homo sapiens
  source 1..201: mol_type = unassigned DNA
aggggagctgaggggcggagtcaccggggcgcgcccccgcggctgcgctcctccccgccggggagcgcgggcacgtaactcggagggtgctgggccggcccggagcacgcgagcagcgggaggagggaccggggaatgactgacggaggcgggccgtagaggccgctgtgccccgccggcccgcacccggccggagtgtgc

SEQ ID NO: 9714 - DNA, 201 bp, Homo sapiens
  source 1..201: mol_type = unassigned DNA
ggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcggggg

SEQ ID NO: 9715 - DNA, 201 bp, Homo sapiens
  source 1..201: mol_type = unassigned DNA
cggggagggaggcttccggaaccccgagagagcacccgtgcctcgcgggccccgtgccccgtccccgggctccccttcctctaacgcaggggacccagcccggggcagtgccgggcactggcgctggcgccccgctcagccctgcgatccttctccgccccgcccctccccgctccgccccgcccctccccgctccgcccc

SEQ ID NO: 9716 - DNA, 239 bp, Homo sapiens
  source 1..239: mol_type = unassigned DNA
agagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctc

SEQ ID NO: 9717 - DNA, 201 bp, Homo sapiens
  source 1..201: mol_type = unassigned DNA
ttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaaga

SEQ ID NO: 9718 - DNA, 201 bp, Homo sapiens
  source 1..201: mol_type = unassigned DNA
ctgccggggagaacatgcaccaggtggctgatggctctgtggatgtggtggtctgcaccctggtgctgtgctctgtgaagaaccaggagcggattctccgcgaggtgtgcagagtgctgagaccggtgagtgaaagggtgtgaggaggactagttagtagcagctattatcatagagggcaggcctgtcaatttcaggtgg

SEQ ID NO: 9719 - DNA, 201 bp, Homo sapiens
  source 1..201: mol_type = unassigned DNA
gaggcggaactcaacggaagtgaagaaaagactaacgggaaagaaggacgagtacgcggtcccgggacagacctccaaagcttcttcctgcgccccctggcggccggagggggagcagcgcggacacgtcccccggccaaccgttggttaccaggctggagtggggtttttttctgttgttttccatgagactactgtttt

SEQ ID NO: 9720 - DNA, 201 bp, Homo sapiens
  source 1..201: mol_type = unassigned DNA
gcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggc

SEQ ID NO: 9721 - DNA, 201 bp, Homo sapiens
  source 1..201: mol_type = unassigned DNA
tcgcccccgccgctcggggcaggcgcgccgatggcgtttctgaggtgacgccgcccacaccgggcttctccgggggcggaggaaacacctatgaaccctccggcagccttccttgccgggcgccaggtaagcagcggttccgggcgcggcggggcgccgcgggaacggtgcacattggtcgaaatctattgcttctcaaga

SEQ ID NO: 9722 - DNA, 201 bp, Homo sapiens
  source 1..201: mol_type = unassigned DNA
cccgccacttggggcgcctggggggctctggggcgggggaggcgggggctttgtctaactccgccactgccaccaccggccaggccgcggcttggcaacccgtgaacaggaggcagggctgcagggcgtgagggatgatgacaaggaagccggaggagcagcggcggcagcggagagtccatcttggatgcaaatggcagg

SEQ ID NO: 9723 - DNA, 201 bp, Homo sapiens
  source 1..201: mol_type = unassigned DNA
accccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagccgggagtggaggcggccgccctaggg

SEQ ID NO: 9724 - DNA, 201 bp, Homo sapiens
  source 1..201: mol_type = unassigned DNA
cgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaag

SEQ ID NO: 9725 - DNA, 201 bp, Homo sapiens
  source 1..201: mol_type = unassigned DNA
cggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccg

SEQ ID NO: 9726 - DNA, 201 bp, Homo sapiens
  source 1..201: mol_type = unassigned DNA
gcaacctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtc

SEQ ID NO: 9727 - DNA, 201 bp, Homo sapiens
  source 1..201: mol_type = unassigned DNA
aggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctg

SEQ ID NO: 9728 - DNA, 201 bp, Homo sapiens
  source 1..201: mol_type = unassigned DNA
ccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtg

SEQ ID NO: 9729 - DNA, 201 bp, Homo sapiens
  source 1..201: mol_type = unassigned DNA
cacgcctggggcggccgggggcggggcctggctggaattgacgcgtggagctccggtggagggggcggggcctggctgggccgctgcctacagcggcttccggggcttggaggtcacggggctcggaggtcacggggctcggaggtcacggggctggctgtgtggggggctcaggggcgtagagtggccaagcagcggtct

SEQ ID NO: 9730 - DNA, 201 bp, Homo sapiens
  source 1..201: mol_type = unassigned DNA
ggccctgcagccctgcagcgttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgc

SEQ ID NO: 9731 - DNA, 201 bp, Homo sapiens
  source 1..201: mol_type = unassigned DNA
gcgctcccgggggctgcgccgtgccgcctgttgtgcgcgcgcagaggccggacagcccggctgcgggaagggacccgagcgcagggtctgccccgcgtcccggaaagtgcctagtctgcggagccggaggttgagctggggcagatcggcgccagacgggggcctgggtgagatacgagttgggggtgcggcctgcagaat

SEQ ID NO: 9732 - DNA, 201 bp, Homo sapiens
  source 1..201: mol_type = unassigned DNA
ctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcct

SEQ ID NO: 9733 - DNA, 201 bp, Homo sapiens
  source 1..201: mol_type = unassigned DNA
gctcgtgccgctgctgctggctccagcgcccgggtcctcggtgagtgcggtcctgccccggcccccggaggaacctgcaggggagtcgggggcggggacgcgcgggcccgcaggcaacgtccccaggaaaggggcgatgtcagggaagctgggctgggaggaggcgagcccgcaccgctgagctccctcagaaagggctgg

SEQ ID NO: 9734 - DNA, 201 bp, Homo sapiens
  source 1..201: mol_type = unassigned DNA
cgctgggcgtcgcccgccggtctaggcgcgcgaacctggcgttcccagtgaatcacccgcggcccgggcgcccgggttcgggaccggccccctcccctcccgctgagccgcggccgagctggctccctgcaccctacccagcgtcgccgggacgcgatcacaccgagatggcaccgagcctccttcaaaggcttcggcttg

SEQ ID NO: 9735 - DNA, 201 bp, Homo sapiens
  source 1..201: mol_type = unassigned DNA
gcctcagtctctgggccggaagccccctctcctcccccgccgcagccccctcctagtccctctccctccgccgatgcgggaaaccttctccgccccgtcccgccctcttcctccagttgcatctccgcccggctcctccgtccagtctccaacccaggccccgcccctccccacccatttcccgccctgggccgggccccc

SEQ ID NO: 9736 - DNA, 201 bp, Homo sapiens
  source 1..201: mol_type = unassigned DNA
gatggcgacgcggatctgcaccgccgtcttgggcccgggccgagcctccccgccggactgggccatggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgc

SEQ ID NO: 9737 - DNA, 201 bp, Homo sapiens
  source 1..201: mol_type = unassigned DNA
gtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaa

SEQ ID NO: 9738 - DNA, 241 bp, Homo sapiens
  source 1..241: mol_type = unassigned DNA
cgcgctggcccggcccccagctcctccggccgccgccccccgcccgccgcgccgcggcgccaggagggcggggccggggcgcgcgccgctcctcagcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgaga

SEQ ID NO: 9739 - DNA, 201 bp, Homo sapiens
  source 1..201: mol_type = unassigned DNA
ggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgagga

SEQ ID NO: 9740 - DNA, 201 bp, Homo sapiens
  source 1..201: mol_type = unassigned DNA
gcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtc

SEQ ID NO: 9741 - DNA, 201 bp, Homo sapiens
  source 1..201: mol_type = unassigned DNA
ccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgc

SEQ ID NO: 9742 - DNA, 201 bp, Homo sapiens
  source 1..201: mol_type = unassigned DNA
cagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaagg

SEQ ID NO: 9743 - DNA, 201 bp, Homo sapiens
  source 1..201: mol_type = unassigned DNA
gtgtgagtctcgggggtccgggccggcggccctgccagccgggtcgtgcggttgcgggggtggggcggcggcgccgctgccatattagccccgggagcggcgagagggaggctggggtgggggcgcgaggggggcggcgcgaggggggccgattctgcgggcaggtgacatcacacctcgaaggccccagtgcgcgggcgg

SEQ ID NO: 9744 - DNA, 201 bp, Homo sapiens
  source 1..201: mol_type = unassigned DNA
gccgcgccatggtgagccgggcggggcaggccgcgcgctcgggccgggcgggggcgccggggcccgggggcgggaagggggaggccaggacgaggaggggcgcgcgcggcggcggggccgggccggggtctgcgggcgggggaggggcggcccggcgggcgcggctcgggggagggtccgttccaggggccgcgcccgcgg

SEQ ID NO: 9745 - DNA, 201 bp, Homo sapiens
  source 1..201: mol_type = unassigned DNA
caaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggcc

SEQ ID NO: 9746 - DNA, 201 bp, Homo sapiens
  source 1..201: mol_type = unassigned DNA
acacgacatggccaagcgccgccgcccgaaccggccgccgccgacaccccgctccggcccggggctgaggaggaagccgagaaggaggaggaggaggcggcggcggagggcgggggaagaggacggccgttccgggttccgcctgagcccgcagggcaggacgagggagcggcgcggtgagagaggcggatgaaggcgagg

SEQ ID NO: 9747 - DNA, 201 bp, Homo sapiens
  source 1..201: mol_type = unassigned DNA
cgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttgg

SEQ ID NO: 9748 - DNA, 201 bp, Homo sapiens
  source 1..201: mol_type = unassigned DNA
cctcaggggagctaagcagctcgcctgaagccccccatctggaaatgacgtgtttaactcggcgcccctgcagctccggccgcccttttttgtttaactccgcgcccctccagctccggccgcccttttcgtcgctctcccctcgcggtcgctcacccctgagatccctggttccactgagacgctcagcttcattcggca

SEQ ID NO: 9749 - DNA, 219 bp, Homo sapiens
  source 1..219: mol_type = unassigned DNA
cgcctgcctcgccgcccgcaccggcccagcccccggcgtccgcccgctctcctcgcccggagcgctgtgagccaggagcagccgcaggctcctcggacgcgcccgccgcgcgcaccacgtggcccggaggcggccgccagtctgcgcccgcgaccgggggcggacgctgcaccaccggctcggagctgggcaggggaggcctcccgccccctccctagg

SEQ ID NO: 9750 - DNA, 315 bp, Homo sapiens
  source 1..315: mol_type = unassigned DNA
gacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcg

SEQ ID NO: 9751 - DNA, 201 bp, Homo sapiens
  source 1..201: mol_type = unassigned DNA
cgcgccgccccagcgctctgcagcggaggcgccgtcctcatcccgaccgcaggcccgcccgggccgcccgcccgccgggcaccgagccgctctgccgcgcgctgcgcctcggggcggggtgggaggagagggagcagccgccaccctgcccaggtcgccgcgggccagccctgcagccagctccagccctgggccgggtgc

SEQ ID NO: 9752 - DNA, 201 bp, Homo sapiens
  source 1..201: mol_type = unassigned DNA
gctcggagcggccgtgaggggcggacggggggcttcggggcgggcctgcaggtcttggggacctgaggctgccgggaggggctgccagggggcgctggccgggcgccgggttctgcggagctggggcgccgacctctgacccgcgagaggggcgccttcgccgtgctggtcgtagttgttattctcagcgtccctattatt

SEQ ID NO: 9753 - DNA, 201 bp, Homo sapiens
  source 1..201: mol_type = unassigned DNA
cggcggtgactgcggccccgcgcgcggctcggctcaggcaggacccgaagcgcggctccgggcggcggcggcggcggcggcggcgtggtcccgtccgggcgggtcctgcgggacaagacggggagccggtcacggggtggggcgactggcgctccgggagcaggaggagaaccgcgggcaggcgggcggggagggtgcgcg

SEQ ID NO: 9754 - DNA, 201 bp, Homo sapiens
  source 1..201: mol_type = unassigned DNA
aagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctat

SEQ ID NO: 9755 - DNA, 201 bp, Homo sapiens
  source 1..201: mol_type = unassigned DNA
cagcatcgtcccggctccgcgccaggcggcgggggaggggaggagggatctctttaggggtgggcttggagggggtgggggcggctccttcccccgccccgccgcgggctcactgtccgggaggggcggggagacagtggggggcagtcccgggcgggagtggaggcggagatgccgccgccgcagccgccgcggtggctg

SEQ ID NO: 9756 - DNA, 201 bp, Homo sapiens
  source 1..201: mol_type = unassigned DNA
tctcatgacgccgaattgcctgggggatcgccagcggtgcgccggtcggagccagctggtggcggggcgggcggcccggagtgtttgctcaaccctgagcgcccgcgagggggaggggaggcagctggtcacgggctagggggtagcaaggtggaggagcgggggctgggaaaggggagggtatctcccgggctgcttgtt

SEQ ID NO: 9757 - DNA, 201 bp, Homo sapiens
  source 1..201: mol_type = unassigned DNA
tccccccgcttcagccagacggggcgctcgcgcccccttccccgccccgcgttggcctccaacaggaagtcgtcccggcccctagcacgtgactcccaccgtatctgcataccggagggcgaactggccaatcggcactctgcacctgagctcctcccccgcgcgcccctcccggcccattggctcctcggccaggccacg

SEQ ID NO: 9758 - DNA, 201 bp, Homo sapiens
  source 1..201: mol_type = unassigned DNA
gccgccaccgccaccgcagctgcagcgtctcttcatatttccagcgcgccgccggccgggcagcctggccgcggcacggaggaggggccctggagggggcggtcgggggaggcgacgccgagccaccgcccccgggcagccgccgccgggggggagcgcggagacttgaaagggcgcgtcgggcaacgcctcccctcctcc

SEQ ID NO: 9759 - DNA, 201 bp, Homo sapiens
  source 1..201: mol_type = unassigned DNA
tcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatggg

SEQ ID NO: 9760 - DNA, 201 bp, Homo sapiens
  source 1..201: mol_type = unassigned DNA
cgtggaggcgacaggcgccggcgacaactttccagttcgggcgccgcgcgccgctccgcgggacgcgcactggggaccccggccgtccttcccgccccccgcgcggacacaaagcccggcagccgcggcgctcagagggccgagggccatcggacagtccgggcagactctggacccgctccgcgggagctgctcttttgt

SEQ ID NO: 9761 - DNA, 243 bp, Homo sapiens
  source 1..243: mol_type = unassigned DNA
aaggctggagggtgctagaaagatgatcggccgggcacggagcggggagcccggagccgcgcgcggggaggggaggtggaggagggggcgccgggggagcggggggcgcgtgaggggtgcgagcggggcccggggggcgcgcggtgggtgtggggggcgccgggctcacctacctctcgtcagcgccgccattgccggtcacatgactgaggctgttgctgggatgacggtccgggccttagc

SEQ ID NO: 9762 - DNA, 201 bp, Homo sapiens
  source 1..201: mol_type = unassigned DNA
ctctgcacctgcaacccctcggggcagtgacacagctggcctcggtgtcctggcggagggcagaagtgatggccggttgcggtcttgtagggtgagaatcgggttagacaagtgagtgctttagagccggggagctgcacacggaggggagggagtggcgggcgctgcgtcgggcttctccaggaagaggtgagcgggctg

SEQ ID NO: 9763 - DNA, 201 bp, Homo sapiens
  source 1..201: mol_type = unassigned DNA
cgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcga

SEQ ID NO: 9764 - DNA, 201 bp, Homo sapiens
  source 1..201: mol_type = unassigned DNA
gccgcgcccctgggaacggtcagggaagcaagcagaagccgggaagccgcgaaagaggcgagaaagtgcgaccccctccccagatccccggtcccccgtcgaaatccctgtcggccggtcaaaccctagacaatggaagctccacgttttcatcctcattctcccccacaagtccggtcgcgggttcccctcggcccggga

SEQ ID NO: 9765 - DNA, 201 bp, Homo sapiens
  source 1..201: mol_type = unassigned DNA
tgtgacgactcctcaagggggctctgtgagcaccccctttttacagccaggaaactgaggcacagaagggagggactgtttggcaggagccaacagaggcgcatagagcagcgtgatgagccccgggctctgggggcgggcccgcgagcaggcagcctccaccccatggtggaccttcaggctcctccttctgccccggct

SEQ ID NO: 9766 - DNA, 201 bp, Homo sapiens
  source 1..201: mol_type = unassigned DNA
tacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggtaaaagccaa

SEQ ID NO: 9767 - DNA, 201 bp, Homo sapiens
  source 1..201: mol_type = unassigned DNA
ccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggtgagtggagggtt

SEQ ID NO: 9768 - DNA, 201 bp, Homo sapiens
  source 1..201: mol_type = unassigned DNA
ccaccgcagccgacagctccacaaacaccaccgctcgctcagcctccgcctccccgggccggctgccacctcgcgccctcggcctggccctggccccgccggctgcactgcacggcccgtccctccgtccatctgcccaccaattctgcagacgccctgtgtccatcctcccctccttcctggccactctccccttctgtc

SEQ ID NO: 9769 - DNA, 201 bp, Homo sapiens
  source 1..201: mol_type = unassigned DNA
ggcgcccctcccgcccgcttgcgggcccgctgcgctagccgccgcaacaaagtttgacagggcgtggccccgcgggaagcgggcccggcgctgcccggccggggcgcaggcggctcggctcgggcccctccggcagcgccgagcctagggctccccaactcgccaccgccgccgcctgctccgccggggcgtcccagcccc

SEQ ID NO: 9770 - DNA, 201 bp, Homo sapiens
  source 1..201: mol_type = unassigned DNA
aaaataaaggatgggtgaacaaattgagatccggcttgctgggcgtcatgtggagaccgtgtgcaggaagagccaagacaccagagccgggggggctccggtgatccctgccgctctctgcatcctgggctcatggttggggcctgtccccctccagctggtagtgccatcctctctgtgccctaccaagctcaccagtaa

SEQ ID NO: 9771 - DNA, 201 bp, Homo sapiens
  source 1..201: mol_type = unassigned DNA
tgccgtggtctcgggtcactgcagcctccctgccccgggctcccgtggttctcctgcctcggcctgccaagtgcctgggattgcgggcgggcgccgccacgcctgactggtttttgtatttttggaggagacggggtttcgccctgttgaccgggctggtctctggctcctgacctcgagtggtctgcccgccttggcctc

SEQ ID NO: 9772 - DNA, 233 bp, Homo sapiens
  source 1..233: mol_type = unassigned DNA
agcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcc

SEQ ID NO: 9773 - DNA, 201 bp, Homo sapiens
  source 1..201: mol_type = unassigned DNA
ccggagctgcagtagaagcgcttccgacctcgtccaggccctcagcctatcccctcctgaaggtcggcagggggcgtcattaccgttggcttctccgcgcggctccggcctccgcttcgggaaccgagtgcctgcagcccgcgatcctggggaggcacagggttagggtaccgcctcggcggagaaagtggctgtgccgcg

SEQ ID NO: 9774 - DNA, 201 bp, Homo sapiens
  source 1..201: mol_type = unassigned DNA
gggggacgggccagccagggcaggagcccaaggacatgaggcaaagatcccaggctgggactccccgcagctcggaggcggggggtggggagggagggccgggggggtgctgggcggagacgctgggcactggggccagcgctgggcagccatgcacgggggcggggcaacaggcaggccagctgctgctgcttctcagga

SEQ ID NO: 9775 - DNA, 201 bp, Homo sapiens
  source 1..201: mol_type = unassigned DNA
aagctcgtgcagcgcgcgccgctccaccaacgcgtcccggcgcaggcggcagaggaaagcggcctccacgcgcggcgcccgcggccccggggccaggggcgcggccagcagtgccagcacgtcccccaccacgtcgtcgtcgtcctccccggcggtggccgagaccggggcgaggctcgcagcgaccggcccggcggggcc

SEQ ID NO: 9776 - DNA, 201 bp, Homo sapiens
  source 1..201: mol_type = unassigned DNA
caggaatgagcttgctgagggcccagccccggggccgggagtctgctgcaaaggatatgaaaaattctcaccattacttctgcatgtgaaaagaatatgcgtgttggaaataacttcctaacttacatatttttaaacatttgtttagacttataggagaaatatttttactgacttttgcataaagtgtactggaggaaa

SEQ ID NO: 9777 - DNA, 201 bp, Homo sapiens
  source 1..201: mol_type = unassigned DNA
ggggcggggaggagggcggagggggtgtaaactaagtggtgggaaagagacaaaggaagagtgaagagcgagacggtgcggatggggaagggggaggggcgcggaggggcagccggtgggcagcgcgccgaggagctcgagcttgaacttgatcaagcactgggggccctgccgtgggggtggggcgggggtacggccgag

SEQ ID NO: 9778 - DNA, 201 bp, Homo sapiens
  source 1..201: mol_type = unassigned DNA
agcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagtgagttggggcgcgtccctatcccgttcccagtccc

SEQ ID NO: 9779 - DNA, 201 bp, Homo sapiens
  source 1..201: mol_type = unassigned DNA
gaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcaggtgggtggctg

SEQ ID NO: 9780 - DNA, 201 bp, Homo sapiens
  source 1..201: mol_type = unassigned DNA
gtccggagaagtggatcccgtcccaccgagaggccagggctcctatgccctcgtccccgacctcggtccagtggcccctgcctcccggactgtcctcggcggggcggggctgcaccccggagccccagctcacctcgcagtcctcttcgtacttgacattatcggttattttccacaacatggcgtccggcgtcccccaaa

SEQ ID NO: 9781 - DNA, 201 bp, Homo sapiens
  source 1..201: mol_type = unassigned DNA
ggaacctggaggaacatggcgctgtcgcctcctggcggaagcgcccgggcctgcgggcaggggcagccctccagggcccggaggcgcagtgaactcccgcgagtccgtagcccgagctccgcgctcccggcgcccctgagctcgcctagcgctgcctgcgtcttcttcctcttcccgctcgccgcctccttcttccctccc

SEQ ID NO: 9782 - DNA, 201 bp, Homo sapiens
  source 1..201: mol_type = unassigned DNA
gtcagggaccgtcctttactgtcctttggttgccgaggagcggtcaccgggcccggccccagtccctctgccctgatctttttttccaagtccccatgccgagttggagagcggtccctgagcacgcatgtggtccgaaaggtggcagctggccgggcttgggtccctcatgtgatccagtcatgcgagggaccggctgaa

SEQ ID NO: 9783 - DNA, 410 bp, Homo sapiens
  source 1..410: mol_type = unassigned DNA
agacatgttgggccagcagtgctggctccatcctagatttcttccagtcctccccagttagccgccaaggggcttttccaaccggaaacctccaatccgcgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcgcggtgaccccgctgcggaccggctcgcggtgaccccagcgcgaacgagctggctgccggctggggcgagaaaggcctgcggaccggcctgggcgcatgcg

SEQ ID NO: 9784 - DNA, 201 bp, Homo sapiens
  source 1..201: mol_type = unassigned DNA
gagccagagatgcattcctggccggcctgagcatctgcgggaaccctgtgagcccctgaggttcacttcttgctccccacttctctctcctgcaaactccgagcccggggtaaagctgcttcccctccccacaccccttttcaacccgacaactaacgccctctagcttccgggaatgggacggatctttcccaaggactt

SEQ ID NO: 9785 - DNA, 201 bp, Homo sapiens
  source 1..201: mol_type = unassigned DNA
gggatcccccgctccccggcctagggggcacccactccgcacgtggagcccgggcagcgtccccagacgcacccagcgggataccggagaggacgccgacgcagtgcaacgccccggccgaagcgccgaacaacatgcgcgcgtcgcggaggaggtgcggggcgtgctcgctcaggcagcgggtcgccccgacgtggtaga

SEQ ID NO: 9786 - DNA, 201 bp, Homo sapiens
  source 1..201: mol_type = unassigned DNA
atgtgccctgccgagttgatttgctcagctcactctttattttgaaacgacgtcaagcatgaagaagagttgcacaaataatgccaataactccggtgccgccttcatgggggttatggtggttccagtgcactccacatgtcccccctctctctgtccctctctctcgtgtacacacacactgtttcctgatccaagagt

SEQ ID NO: 9787 - DNA, 201 bp, Homo sapiens
  source 1..201: mol_type = unassigned DNA
gtgactctgcgaggttacactccgggtgcgtcgctgcgggctcgtgggctcgtgggctgcagccccccgctcctgtcgggtggacgagccccgggcccgcgtggagctgctcggtcaaggccggcccgggaggggcgcggcgcagggcgggcaggggcggggtcctaggtcaacgtccagccccagacccagccccgccgc

SEQ ID NO: 9788 - DNA, 201 bp, Homo sapiens
  source 1..201: mol_type = unassigned DNA
ggagggagaaagggagagagttccagccgccccggctgtggcaggaggagccccaagagcgctccccgagcccgccccgcacctccaggctcagcccggcgcaggctccctctcccgccccctccacccccgccagctgctgaaacccccccaccgtccctccgcgggcaacagtgcccgccaggcgccgccgcgcggtgc

SEQ ID NO: 9789 - DNA, 201 bp, Homo sapiens
  source 1..201: mol_type = unassigned DNA
gtcctcaatgcgggcggcccccgcaccccacgcggcccggggtccctgcccatcccccgcgggcgggccccggacccctggggctccccagcccctctccgctccccccccgcgccggccccgtgccctgcggcccggcggccccggcggcgcgagtcgggggaggcggcgaggggtgtccccgaggcccggcggcgcggc

SEQ ID NO: 9790 - DNA, 201 bp, Homo sapiens
  source 1..201: mol_type = unassigned DNA
cccgcattccctttgatttttatggacattcagctaacagtaggaacaaaaattaagatctttcctttcccattcgcctggacacttatctttccggctcgcgccgccgtgtcctctacccggctacacagcgactccaaaagtttagctttcaccccgcggagatttcgacagctctgggaggctctttttaaaagggaa

SEQ ID NO: 9791 - DNA, 201 bp, Homo sapiens
  source 1..201: mol_type = unassigned DNA
agccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccat

SEQ ID NO: 9792 - DNA, 201 bp, Homo sapiens
  source 1..201: mol_type = unassigned DNA
aactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgc

SEQ ID NO: 9793 - DNA, 201 bp, Homo sapiens
  source 1..201: mol_type = unassigned DNA
gccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagg

SEQ ID NO: 9794 - DNA, 294 bp, Homo sapiens
  source 1..294: mol_type = unassigned DNA
ctcgccgcccatgcttccactgcaaggccgcagcccccgccgccgatcccgatcccccgccccgcccagccgcggccccgcccggcgccccctccccggcggaagctcaagcccaattaattgagtccgaggcgggagggaagggccctgcgcgccgtggcccgccccgcccctcttccgcgccccttttcccgccctgggtggcatctcctccgccggcatccacaacaagccgctgattaatgaggccggggccgccccaccccgcccggccgggccggggccttcgcggga

SEQ ID NO: 9795 - DNA, 201 bp, Homo sapiens
  source 1..201: mol_type = unassigned DNA
caagtccatagaagagcaaattctcacccttcgaggctgctgtggaagctaccggggctgggacagcagagaggaacccagacgggaacaccgccctcccgccagactcccggcggctcctcctccctctcccaaacccactcccaaagctaagtgcaggcttccccgttccagccagaagcgctgcgtgagcctccacac

SEQ ID NO: 9796 - DNA, 201 bp, Homo sapiens
  source 1..201: mol_type = unassigned DNA
gaggcccacgctttccagaccgccacagtcgctgtcacagggcctgagtttgggcggcgccccgccccggccgcacggtgcgccggcgttaatcctccccgaaggttccggcagccaagattgcaggttcccaccaagcattgtttccgaactgggccacgagagcgtgtccctgattggcttgctctggaggctgggaag

SEQ ID NO: 9797 - DNA, 201 bp, Homo sapiens
  source 1..201: mol_type = unassigned DNA
tcccccgcgcgccgcctccccccgccgccggccgcgtgcgcccccgcccctccccccgcggcgggagcacctccgctcgccacctggggacccgcgccgcgctccccgcccccgcccgcccggcgcccatcccccgcgccctccgctcgctggggttataattgcctctcaccccccggaggggttattttgggggtggtt

SEQ ID NO: 9798 - DNA, 201 bp, Homo sapiens
  source 1..201: mol_type = unassigned DNA
gcggccccggtgagcggggcgaggggcgggtgggcagcggcgccgggggaggtcgaggaggcgaatggtggtgtcggggcggcgggtaccgggcgaggtcgcggccagccttctcgggccggagttgggcatcgcggggacggggagtgtcgggggcaggtgaggccagggcaggagcccacgcggtgggtgcgaaggcct

SEQ ID NO: 9799 - DNA, 201 bp, Homo sapiens
  source 1..201: mol_type = unassigned DNA
ggaggcgctgcgccaggcggaggaggagcgcaaggccaagtacgccaagatggaggcggagcgcgaggccgtgcgccagggcatccgagacaaggtgcgcgccgggccggccccgcctgcgggaaggcggccctgagtccagcggggacccagatcccgcctgggtggaaggggctgcccggaagaggggcgggcgtcccc

SEQ ID NO: 9800 - DNA, 201 bp, Homo sapiens
  source 1..201: mol_type = unassigned DNA
aaagagaaaagaaacagataaaaccagggcagggggtaaaaaagttccccgcgcctctcggaatccagcggccgcggccgcggctaccgccgccgccgccgggggtgggctccggaagagcctgcccagcagggaaggggaggacgggccaggagcgaaatcctgcaggcgaggaagggacagacgcgcaaagaaaaagtg

SEQ ID NO: 9801 - DNA, 201 bp, Homo sapiens
  source 1..201: mol_type = unassigned DNA
cgcgggcgcagcggcggccgggcacgaggccgggctgacaccaccatctgctggggcgcgggaagaacggcagctgctctgcgttgccccggcgagggacgcctggaaaaggctgaagccctgggcgtcctcaagcccgttatccacggggtccccgtcaccccagcctgctcgccgccggccgtcttttgtgattccctg

SEQ ID NO: 9802 - DNA, 201 bp, Homo sapiens
  source 1..201: mol_type = unassigned DNA
tttcccagggatggccttgtgcctgggctctcttcccctccaaactccggggtggcccctgctttatcagactgaaccggctctaaggagaaaagttgacgatcatcctgctctagcctccgggaagtcttgctccacaaagaacaagagtctctggttttgtgaaatgagtcacaggctgccttgaccatgcctatctgg

SEQ ID NO: 9803 - DNA, 201 bp, Homo sapiens
  source 1..201: mol_type = unassigned DNA
ccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccc

SEQ ID NO: 9804 - DNA, 201 bp, Homo sapiens
  source 1..201: mol_type = unassigned DNA
cggccggacctcctcccagactgcctgcggtctgaaggggtcaggtccgcgcaaggtcccaggctgcttgggcgccgggtcgcactgtcaggagctgcccgggagtggctttccaggaacaccaggcactgaccacacaccaggggctgggaaaccaggtggcctgcaccaaggcggcttcggggacttgtctgtggcaag

SEQ ID NO: 9805 - DNA, 463 bp, Homo sapiens
  source 1..463: mol_type = unassigned DNA
agcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgt

SEQ ID NO: 9806 - DNA, 201 bp, Homo sapiens
  source 1..201: mol_type = unassigned DNA
ggggacgccagtggactggagccgcggagcttcgagggaaaaactttgcaggcgccgcggccgggattcggttacggctccagcccaccccagcaggtgcgggaggaagaggcagcgccggagtcccgaggccagagagcctcggcggcggcggccgcttctttcccccgagctggcctgaagtcgctgggcactcccggt

SEQ ID NO: 9807 - DNA, 201 bp, Homo sapiens
  source 1..201: mol_type = unassigned DNA
agggctgggaggatctgcagttctcctgctggccctccctttccaggaagccggccagcttggagccggctgctcaccccgactcaccccccgcctgggcggagcaggaatgtggaagttggcccgaaaggactgtgccccctccccgtcaaacaccccccccccgcgtcccccaccaagttctggccggggctgtggagc

SEQ ID NO: 9808 - DNA, 201 bp, Homo sapiens
  source 1..201: mol_type = unassigned DNA
agggcggagctcccggggcagaggcgctccgcggcaagaccgtcgaagtgggtttcgacggctgggccgctgcccccggggggccgaagggtgcgggctcgggctccgggggccggggcttcttcctcagcaccacgaacttgacgccgtcgagctccttcaccaccgccacgttgttgacgaactgcttgaagcggtccc

SEQ ID NO: 9809 - DNA, 201 bp, Homo sapiens
  source 1..201: mol_type = unassigned DNA
cggaggaggctgcggggggctccggcccaggcgaaggaagggcaagaggctgttcgaccgggggcggcgccgggaggtgggtgggcttaacacccaggtcgggggaggggtttaagagacaccgggaagggcagccgagccccaggggcgggtggggtggtagctgtgtgtagtaggggacagggctgggcctctggaagc

SEQ ID NO: 9810 - DNA, 201 bp, Homo sapiens
  source 1..201: mol_type = unassigned DNA
tagtcgacatgacgcgcggcgcagccaatgggaggcggagttggcgtttcttggtcgggggggggccggaggggtgggccccgcgtctccggtgtctgccgtgctcactgaatggagagagcgagcgccggccagctcacccggccgccccgtgccccagccgcagccgccgcgctccccagcccagccccaagccggacc

SEQ ID NO: 9811 - DNA, 201 bp, Homo sapiens
  source 1..201: mol_type = unassigned DNA
ctttttttaagttttcccttggggactgacattttattagcacagagatcaataatgccagataagagacctctgattttacatctggggctcccggaacgatgtctgggagagaaaacatgacgtttcttgcagaggcgaatcccagcccgggaggagggaggccgctgggatgtgccgccggcggcttttgggctcggt

SEQ ID NO: 9812 - DNA, 201 bp, Homo sapiens
  source 1..201: mol_type = unassigned DNA
agactggacccgaacccggcccaccccacccgagcggcgacgccagcgctgaccccaggcgtgtcccggcccccggcgcggctccggcccaaccgtgcacgcccgcggaaggcctcgcacccgcgtcagaagtggcctgcccggggccaccggcccgcaagtccccggtgttctcgaggtccctgccccgtcccgcgcggc

SEQ ID NO: 9813 - DNA, 201 bp, Homo sapiens
  source 1..201: mol_type = unassigned DNA
ggggctggggagggctgccggcggcgcggcggggtcggcgggaggcgggaggctgcgcgcggcgcgggagcgtgcgccggggtcagcaggggcggggtccgcgcggccgccgggactggaggcgcgggggtagcgggtagggtaccctgagggcacacccccggccacctggcgggagacccagctctgccgcgcgccgcc

SEQ ID NO: 9814 - DNA, 201 bp, Homo sapiens
  source 1..201: mol_type = unassigned DNA
gccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggagga

SEQ ID NO: 9815 - DNA, 201 bp, Homo sapiens
  source 1..201: mol_type = unassigned DNA
cctagtgctgcccgggcgccctcccgcagcagccccagggcgaggaggatggggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggct

SEQ ID NO: 9816 - DNA, 258 bp, Homo sapiens
  source 1..258: mol_type = unassigned DNA
ctctctgggacaagaagtggagtggggcggccaggacgcgggccgtggggatcgcgagggaggagggggcggccgcccggacttaccccgtggggtccccgcgcgcgggcgccccggcgtgtcggatcatgccgccggcagctccgggacggggaacggaggcgctcaggcgccgggccgcgcggaacgcggagtcccgggcgcccgcatgtccctggctctggccctctggaagggccaggccgccgctgccgccgc

SEQ ID NO: 9817 - DNA, 201 bp, Homo sapiens
  source 1..201: mol_type = unassigned DNA
cccggtcgccacgccccttccgagggtcgctccgcccccgtcgggccccgcgagcgcgcggtgggggaggggagggccccggagcgcgcctgcgtggggcgggggcggcagccgactaggggctgggtctggccgtttagggccgggtcttggcccgtcgcccacggtgcggagggctggtgggctttccttggccgtcgg

SEQ ID NO: 9818 - DNA, 201 bp, Homo sapiens
  source 1..201: mol_type = unassigned DNA
cagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccct

SEQ ID NO: 9819 - DNA, 201 bp, Homo sapiens
  source 1..201: mol_type = unassigned DNA
tccccgcgccatctcgggcccgtccccgctcggcctctccggagcggccgcgccctcagccggggagcccaggggtcctggtccgcggagccgggcgcgcggggggcggctggggccgcagcagggggaggctcggcgctcgcagccgccggcgcggggctcatcgggcgtgtgggtccatcccggccggggcgcgacggg

SEQ ID NO: 9820 - DNA, 201 bp, Homo sapiens
  source 1..201: mol_type = unassigned DNA
gggcccttagcacgcgccccagcgccggagcagggtcagggtcttcttgcgacccggccccgctccagatccccccagctctcggccgcggacccgggccgcgtgtgagcgccctttgcacctcctatctccagggtccgccgagagccacgattttttacagaaaatgagcgataaagagattttgtactgtcctgactg

SEQ ID NO: 9821 - DNA, 201 bp, Homo sapiens
  source 1..201: mol_type = unassigned DNA
ccgggcctagggcgccgcctgcagttgcgcgcggccgcctctagatggaactttctcaccaacgcaaggcccggccggagcagctacccgggagctgggcggcgaggggctactttctctcattccggcgggtgcaggatcggggggcctgggcagtaactagtggggaggagcgctggactgtgcacgtcgagcccggca

SEQ ID NO: 9822 - DNA, 201 bp, Homo sapiens
  source 1..201: mol_type = unassigned DNA
ctcgccccacctcctgcctgttcccggctgtcagagacccaggtgcagagagacctcagaggtggcgtccggggtcctggcgtccctcctgcggacgctcgctgcagagcaggaagccgccgccccggggcggaggggcgagccgggccagggggccggggtggagaggtctgcagggcctgcgcgctttccttacccgcg

SEQ ID NO: 9823 - DNA, 201 bp, Homo sapiens
  source 1..201: mol_type = unassigned DNA
agcaccaggtccggctccccgtacaccgccccgaaccccgggggtacgggcgcgggctccccgggctcctcgggggacgcggggtcctcaagccaaacgcgcggttcgggggacggcgccgcgggctcttccgggcacgcgcgctcctcaggggacgcgagctcctccggggacgcggcgcccgcgctgccggcctcccac

SEQ ID NO: 9824 - DNA, 201 bp, Homo sapiens
  source 1..201: mol_type = unassigned DNA
tccccggccgaggaggggccgcgtggcgccgcggggggcgggccgcgcacgccccccgcagggaggactcagggacagtcagggccccgggagagtccgcgcgcatcgcccggctccgcggcgccagccatggcgtccgtgcgtggccccgccagggatggggcgacgcggtcagagccgcacgcgaccgaaatccgcact

SEQ ID NO: 9825 - DNA, 201 bp, Homo sapiens
  source 1..201: mol_type = unassigned DNA
gctagaaaggatcgagaaaaatcccaaagctctaagcctgagctagggagggtctcagagggaggtctgactgcagaccgggagtcttctcctcccgtgcgccgctgcccgggacgagaaacccgtggggcatccaggactaggacacgaggtctcagcctgggcaggtggacaagctgtggggtcccaccctccgcaggc

SEQ ID NO: 9826 - DNA, 201 bp, Homo sapiens
  source 1..201: mol_type = unassigned DNA
gccgctgagtacgcgctccaggcaggctctgggaagtccgggatggaagcagctccctttctctcgccttcctccctcccctctcccctccctcctctccgcgcctctcctcctccctccgccctccctggacgtgggctgccggctgcagcccggagggacggggcgcgggacggagccccccgcgggaggaggggccgg

SEQ ID NO: 9827 - DNA, 203 bp, Homo sapiens
  source 1..203: mol_type = unassigned DNA
gtaggagcggcccgtgtccgcgggcgggagcgtgcggcctggactgccccgccggacaggcattgtctccccgccctctcgggctcgaggcgggccgcgcgcgccggccgccgtccgggcgtcccgcggtgggcgagatgcgccgcgtccgttccatgcctgccgcccgcgcgccccttgctccccaccccgtagccgctcgc

SEQ ID NO: 9828 - DNA, 201 bp, Homo sapiens
  source 1..201: mol_type = unassigned DNA
ctcctcgcagagggcaggacacccacctccccgtgcacctgcttcttctccggtctcccgcccccagcagcattctaggacccaggggtgtcatcgggtcggggagggaggggctgagcctgggtttggggacatcgggacagggggaggggctggcgctcccgtctggccgggaccccgtggcctagcgcggctccacga

SEQ ID NO: 9829 - DNA, 201 bp, Homo sapiens
  source 1..201: mol_type = unassigned DNA
agcgcctgcctaatttgcagtgacaccgctcagctgcccagggctccagctgtcacagccaattagcccgcggccggggaggagcgccgggcaggggggcgggggggcatgaaggggtcggcgggggaggctgtgggggttgcaggaggggtaggcgcaggaggaggcctgtggccttcaggtccggcccgcccccccagg

SEQ ID NO: 9830 - DNA, 201 bp, Homo sapiens
  source 1..201: mol_type = unassigned DNA
gggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacgtgagcaaacgccccgcctccgggtcccgcccctgccgctgtcaccgcccccgcccttccag

SEQ ID NO: 9831 - DNA, 201 bp, Homo sapiens
  source 1..201: mol_type = unassigned DNA
caggtagaggggggcgggagggggtgtgagggagaggaggagccggagccgccgctgcggccccctccggggaggggagaggagaacccccttcctcctcgccccctcccagccccccgctggcccgggagggggtggggcgccgaggccgcggcgacccggcagggcctggccggtgaagagcaggcgggcggggtgcgg

SEQ ID NO: 9832 - DNA, 201 bp, Homo sapiens
  source 1..201: mol_type = unassigned DNA
ccaaccctgcgctcccctcccagcccgagtcctcccgctgctctttctcctcctcctcccgagcctcctcccctccggcgcggcgccgccagccagcctcggcggggagagtgcaggtactttgccttcagaataattagcaggacccaagccggctttccgagcgcgctttctttttcttcctttgccccctccctccgg

SEQ ID NO: 9833 - DNA, 201 bp, Homo sapiens
  source 1..201: mol_type = unassigned DNA
cgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcga

SEQ ID NO: 9834 - DNA, 201 bp, Homo sapiens
  source 1..201: mol_type = unassigned DNA
cccgcctccccgcctcagtccgcgcactcaccgcgcacgcagagcagtgacatggccgaggatcgggcaagcctctgccgcgccccagccgcgccggaccgctccctctttcctctcagcaggtgccgcgactgctctcgttaccggccccacgggtctggcagctcctcatggtcccggtcgcaggtagcgtcccgccgc

SEQ ID NO: 9835 - DNA, 201 bp, Homo sapiens
  source 1..201: mol_type = unassigned DNA
tggccattgttgcgcaggcgcagttctgggagcggcgggagctggaagcccaggagttccagggggcgcagggccgggcagaaggcggcgagctgggggcggatatccaccggggactggaagcggcccgcgcaggctggggacacccggggccagggcgggtcgcctggggtgggagagtatagtgaggaagtctgacgc

SEQ ID NO: 9836 - DNA, 201 bp, Homo sapiens
  source 1..201: mol_type = unassigned DNA
ttggggacgccgcagcccggctcggggagggggcgctaggccgggagccgcagcgcgggagggacgagcccgggccggcggggggaggggagcgggaagcgtctttgttgttggcgaccgggatcccttctcggcacaggggaaaggcggggaagccactcctcatcgggtctgtgtttttgagaggattctctgatggtt

SEQ ID NO: 9837 - DNA, 201 bp, Homo sapiens
  source 1..201: mol_type = unassigned DNA
ggtctctgggaggcgccgcgtgggggcgcggcccgtggagcccgggcgctagggaccggccggggccggcgtacgggtgcgctctgggttcgcccgggccgcgggagccagggagccagggagccagggaccccggctcccgcacggggcagacaggggcagcgcgggcgacccggagcgcctgcgtctccgcggccctcc

SEQ ID NO: 9838 - DNA, 523 bp, Homo sapiens
  source 1..523: mol_type = unassigned DNA
agagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccaggtgagcgccggccggggcgaggccgggccccgggcggcaggcacggggctaggtggttctgaaacttggcgcag

SEQ ID NO: 9839 - DNA, 201 bp, Homo sapiens
  source 1..201: mol_type = unassigned DNA
cggcggcaggcgggggagggggtgggggtgcaggggcggccccgcgggccgcggggggggcgcgcggcgcagcggggtcccgggcggggcgcagcgggccgcggggctccgggcgcgctccccgcgctactccagtgccatggtgcgcccgctgagccgccgggtttagagctggggctggcggcggagggatacgggccg
